United States Patent 11,098,302 (IDENTIFICATION OF POLYNUCLEOTIDES ASSOCIATED WITH A SAMPLE) - sequence listing, part 60

SEQ ID NO: 206766 - DNA, 590 bp, Homo sapiens
  misc_feature: GYAE6OF01A6EPK.17.25.C03.1.454.CMB.1.raw
  modified_base (280)..(280): a, c, t, g, unknown or other
  misc_feature (280)..(280): n is a, c, g, or t
  modified_base (436)..(436): a, c, t, g, unknown or other
  misc_feature (436)..(436): n is a, c, g, or t
  modified_base (451)..(451): a, c, t, g, unknown or other
  misc_feature (451)..(451): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgcctgagtggatgggatcgggaccgaaccctaacacgtgggtcgtccacgtagttcgtccttccaccccatcccgtaccgggactacgtaccttaccatcgaaccacgaacctcctaccaataaaccacacgcctanagtggagttgaggcncctgaccatcgagaccgacgaccggtccttactacttacgtggtacgcggacgtaccgtccccgaaggtcgttcccgggtagaccgccgtacgggccacgggtcccggtaccgttttcggaccgtttcgggtaccgggg

SEQ ID NO: 206767 - DNA, 619 bp, Homo sapiens
  misc_feature: GYAE6OF01B6HQB.17.25.C03.1.454.CMB.1.raw
  modified_base (448)..(448): a, c, t, g, unknown or other
  misc_feature (448)..(448): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtgcgccaggccgctggacaacgacctggagtggagtggggatcggggaccgaaacccctaacgacgttgggtcgtcaacgagtcgttccttccacccctactcccgtaccggggacacgtaccttaccgatcgaccacgaacctcctaccaataaaccacacgtaccctanagtagggagttggacggtacgcccgtgacagtctaggaaccgacgaccgggtcccgttacttacgttaccgtggtcgacggtagtaccgtaccccgaacggtacgttcccgggtagaccgcccgtacgggctacgggtccggttaccctttcggtccgttcggtcgggggg

SEQ ID NO: 206768 - DNA, 552 bp, Homo sapiens
  misc_feature: GYAE6OF01EMVZV.17.25.C03.1.454.CMB.1.raw
  modified_base (281)..(281): a, c, t, g, unknown or other
  misc_feature (281)..(281): n is a, c, g, or t
  modified_base (352)..(352): a, c, t, g, unknown or other
  misc_feature (352)..(352): n is a, c, g, or t
  modified_base (407)..(407): a, c, t, g, unknown or other
  misc_feature (407)..(407): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtggggtcagagtcaccatcacttgccggacaagtcacggtacgttaaaacctatttaaacttggtaatcagtcaagaaacctggaaaacnccccagacctctgatctctggtgcatccatctgcgaagtcgctcccatcgagttcagtggcagtggatcgnggacagtatttcaatctacaccatcacctactctcgacaaccgtagaggtattgngtactaatcctatactgtacaactagtaacgtactccgttacccctcgtcttaacgtttcgacccggaagggtaacctaaacggttagacgtaactaacgaaacgtactaggtacggactacggacaaccctattcgtcgttacc

SEQ ID NO: 206769 - DNA, 643 bp, Homo sapiens
  misc_feature: GYAE6OF01EW7HW.17.25.C03.1.454.CMB.1.raw
  modified_base (459)..(459): a, c, t, g, unknown or other
  misc_feature (459)..(459): n is a, c, g, or t
  modified_base (501)..(501): a, c, t, g, unknown or other
  misc_feature (501)..(501): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctactgcaaggtcttctggattcaccgttttacctcctatagtatcaacgtgggtgcgccaggccgcgtggacaacgacctggaggtggagtgggacgtggggaccgaaaccctaacgacgttgggtcgtcgaacgtagttcgttaccttacacccctaacgtcccgtaccggggacacgtaccttaccgagtacgacccaacgtaacccttccctacaactaaaccncgtaacgacctactagtcggagttggagacgtccgtagaccntacgtacgaaccgaccggaccgggtcccgttacttaacgttaccgtgtacggacggtagtacccgtacccgacgtacgtccgggtagacggtccgtaacggctacgggtccggttacctttcgtaccgttcgggtaccgggg

SEQ ID NO: 206770 - DNA, 603 bp, Homo sapiens
  misc_feature: GYAE6OF01CAU0I.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaaggtctcctgcaaggtcttcgtggattcacgtttacctctatagtatcaacgtgggtgcgccaggccgctggacacgacctgagtggagtgggatgggacgtaaccctaacgacgtggtgtacacgtagtcgtccttacaccctagtcccgtaccgggacacgtaccttaccacgtacgaccctaacgtaacctaccctaccaactaaacaccaacgtacctaacagtaggacgttaggaggacgacctagacagtcagaccgacgaccgtccgtactacgttactggtgtacgagtacgtaccccaggtccgtaccgggtagaccgtccgtacggcgtaccggtccggtactttcggtaccgttcgggtaccgggg

SEQ ID NO: 206771 - DNA, 769 bp, Homo sapiens
  misc_feature: GYAE6OF01BEZWB.17.25.C03.1.454.CMB.1.raw
  modified_base (285)..(285): a, c, t, g, unknown or other
  misc_feature (285)..(285): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcccgtgcaaggtcttctggattcacgttttacctcctatagtatcaacgtgggtcncgccaggccgctcggacaacgacctggagtggatgggagtgggaccgaaccctacacgtggtcgtcacgagtgtccttccgaccccagttcccgtaccgggactaacggtaccttacccgattaccgacccacgtaaccttccctaccaacttaaaaccacctacggtaccctaacgagtacgggtacgtttaggaacggtacgtacccgttaggaacccgtagtttacccgtaaggtaacccggtaacccggaacccgggggtacccctttaaccgtttaaccgtttaacccggtttacgggtacggtacccggtaacgggtaacccgggttaccccccgtaacgggtaaccgttaccccgggggttaggtaaaccccgggttaccccccgttaaaccggggccccgtaaaccggggttccccgggtttaacccccggtttttacgggtaaacccccggttttcggggtaacccccggggggg

SEQ ID NO: 206772 - DNA, 732 bp, Homo sapiens
  misc_feature: GYAE6OF01D7XFD.17.25.C03.1.454.CMB.1.raw
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtcgccccactcccaggtgcagctggtgctagtcgtggggctggagggtggaaagacggccggtcggggcctcgaggtggaacggtcctccgtgacgtaggtcttcgtaggtacttccgtaccgttttaccctaccttagttacgtactacgtaacgttgggtcgccgaccggacggtcccgcgtacggaaccgaaccgtaccgtggaggtggagtgggagtcgggaccgtaaccctacgtacgtggtcgtacacgtaggtctaccttcccacctaccgttccggaccggactacgttacctaaccacgttaccgaaccctaacgtacccttaccctaccctaaactaaaccaccaaccgtaacccttacgacggtaggttaacggttacggacggtaccgtccgagttaacacgttacggacgaacccggtaccgacccgggttaccttacgttacgttacgtcggtacggaccgtacggacccgtaccgaacggttccggtacgggtacgacgtcccggtacggaccgtaccggtcggttacccgtttacggtcgttaccggggtccgggg

SEQ ID NO: 206773 - DNA, 722 bp, Homo sapiens
  misc_feature: GYAE6OF01ALU7T.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaacgccgtggggcctcgaggtagaacggtcctccgtgcgaaggtcttcgtggtacttctaccgtttacctctatagtatcacgtgggtgccgccgaggccgcgtacggaaccaacggtacctggagtggagtgggagtcggggaaccgtaaacccctaacgacgttggtcgtacaacgtaggttcgttaccttaccacccctacgtcccggtaccggggactaacggtacccttaccacgttaccgaacccgtaccgtaacccttccctaaccaaagtaaaccccacgtaaccggtacccttaagaacggttcgggtaaggtttacggaacgggtacctcccgtaggaactacgttcgtaccggaacccgtaccggtacccgggtccgttacttaacgtttaccgtggtaccggacggtacgtacccgtaccccgacggtaccggttcccgggaggacccggtacccgtacggaccgtacgggtcccggttacctttacggacgtttcggacggg

SEQ ID NO: 206774 - DNA, 728 bp, Homo sapiens
  misc_feature: GYAE6OF01ASRH2.17.25.C03.1.454.CMB.1.raw
  modified_base (607)..(607): a, c, t, g, unknown or other
  misc_feature (607)..(607): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggcctcagtgaggtctcctgcaggtcttgtggtacttctacgtttacctctatagtatctaacgtgggtcgacgccgaggccgcgtacggaacaaccggtccgtggaggtggagtaggggagtcggggaaccgtaaacccgtaacgacgttgggtacgtaccgacgtacggttcgttccttaccaccccgtaccgttcccggtaccgggtaacctacggtacctttaccgacttaccgaaccctacgaacccttccgtaaccaaactaacaacccgaccgtaccgtaaccaggttacgggtaacgtttaggacggtacgtccgtagaacgtagtaccgtacggaaccggtaccggaccggttaccgttactttaacgttacggtcgtaccggnggtaaccgtaccggttccccgaaggttacccggtaccgggtcggaaacggtccccggtaacggaccggtaaccgggttccggttaccgtttaccgggttccggttccggggtacccggggg

SEQ ID NO: 206775 - DNA, 743 bp, Homo sapiens
  misc_feature: GYAE6OF01BH76W.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtacccactcccaggtgcagctggtgcagtctggggctgaggtgaagaagccgtggggcctcagtgaaggtcctcctgacaaggcttcgtggattccacgtttacctcctatagtatcaacgtgggtgcgccaggccgcgtggaccaacgcctggaggtggagtggggatcgggaccgtaacccgtaacacgttgggtcgtaccgacgtaggtcgttccttaccaacccgtacgttccccgtaccggggaactacggtaaccctttaaccgacgttaccggaacccctaaccgtaacccttcccctaacctaacttaaaaccaccgtaacgacccttaacctaagttacgggtaacgtttagggaacgggtacgtacccgttagaacctagttcccgtaacggaacccgaaccgaacccgggtcccgttacttaacgtttaccgttgggtacgaccggtaacggtaccggtacccccgaacggtaccggtcccgggtaggacccggtacccggtacgggaccggaccggtcccgggttacccgttttacgggacccggtttcccgggtcggggggtaaccccggg

SEQ ID NO: 206776 - DNA, 619 bp, Homo sapiens
  misc_feature: GYAE6OF01A2Y2B.17.25.C03.1.454.CMB.1.raw
  modified_base (344)..(344): a, c, t, g, unknown or other
  misc_feature (344)..(344): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcgagtgaacggtctccgtgcaaggcttctggattcacgtttacctctatagtatcaactgggtagcgccaggccgcgtaggactaaccgacctggagtggagtgggagtggggacaacccgtaanacgtggtcgtacacgtagttcgtcgttaccaaccccgtatcccgtaccgggactaacgtaccttaccatacgaccctacgaacctccctacaactaaaccactacgacctaacatgggtaagttacgaaggacgcctagacatcgtagaccgacgaccggccttacgtattaccgtgacggacggacgtcgtaccccgtaagtaccgttaccgggtggaccgtcccgtacgggacctacgggccggttccttacggtaccgtttcggaccggggg

SEQ ID NO: 206777 - DNA, 652 bp, Homo sapiens
  misc_feature: GYAE6OF01ESH7J.17.25.C03.1.454.CMB.1.raw
  modified_base (259)..(259): a, c, t, g, unknown or other
  misc_feature (259)..(259): n is a, c, g, or t
  modified_base (346)..(346): a, c, t, g, unknown or other
  misc_feature (346)..(346): n is a, c, g, or t
  modified_base (353)..(353): a, c, t, g, unknown or other
  misc_feature (353)..(353): n is a, c, g, or t
  modified_base (469)..(469): a, c, t, g, unknown or other
  misc_feature (469)..(469): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagcctggggcctcgagtgaagtctcctgcaggcttctggattcacgtttaccncttatagtatcaacgtgggtgccgccaggccgctggaccaacgccgtggagtggagtgggatggggaccaaccctaacgacgttggngtcacgngtgttcttcacccctatcccgtaccggggacaacggtaccttaaccgacttcggaacccaacgtaacctccctaccaataaaccacaacgacctaacagtaggtagttgacggacncctacgacagtctaggaaccgtacgaccgggtaccttagttacttacgtaggtcggacggtaacggtaccgtaccccgtaacggtaccgttaccggggtacgtacccggtacccggtaccggggacctaccggggtaccggtttacccgttttacgggaaccgttttcccgggaaccgggggg

SEQ ID NO: 206778 - DNA, 652 bp, Homo sapiens
  misc_feature: GYAE6OF01CXAU8.17.25.C03.1.454.CMB.1.raw
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
  modified_base (347)..(347): a, c, t, g, unknown or other
  misc_feature (347)..(347): n is a, c, g, or t
  modified_base (367)..(367): a, c, t, g, unknown or other
  misc_feature (367)..(367): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtcgcccactcccaggtgcagctggtgcagtcgtggggctggaggtgaagagccgtggggcctcgagtgaaggtctcctgcaggcttctggattctacgtttacctcctatagtatcaacgtgggtcncgcaggccgngtggacaacgctgacgtggatcgggatcgggacaaacctacgacgtggtncacagtctcttcaacccgtntcccggtcgggacacgtaccttacacgtcgaacccaacgtaccctacctacgaactaaccataaccgactaacgagttaggagttacggaacgggctaccgtagaacctaagtccgtaacgaaccggacccgtaccgggtaccttcgttaaacgtttaccgtcggtacgaccgggtagtacccgtaaccctaccgggaccgtttacccggggataacccgggtcccgttaacgggcctaaccgggtccggttacccttttaccggccgtttcgggtacccggggg

SEQ ID NO: 206779 - DNA, 654 bp, Homo sapiens
  misc_feature: GYAE6OF01CIJOS.17.25.C03.1.454.CMB.1.raw
  modified_base (573)..(573): a, c, t, g, unknown or other
  misc_feature (573)..(573): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctgaggtgaagagccgtggggcctcgagtgaaggtcctccgtgacgaaggtcttcgtggtacttctaccgtttacctcctatagtactcaacgtggtcgcgccgaggccgtcgtcggaaccgaacgaccgtggaagtggagtgggacgtcgggaccgtaaaccctaacgtaccgtgggtactcgaacgtagtcgtacttcccaaccctacgtcccggtaccgggtactacgtaaccttaccaagtaccgaaccctaaccgaacccttaccctaccaaactaaacacgtaaccgaccttaacgagttcgggaaggttcggaacggacgtcctagactactcgtacgaaccgaccgaccggtccgttactagttaccgnggcgacgacgccgtaccgacgtacgtcggtagacggtaccgagggacgtccggttacttcggtacgtcgggcgggaaccgg

SEQ ID NO: 206780 - DNA, 617 bp, Homo sapiens
  misc_feature: GYAE6OF01CLB0S.17.25.C03.1.454.CMB.1.raw
  modified_base (323)..(323): a, c, t, g, unknown or other
  misc_feature (323)..(323): n is a, c, g, or t
  modified_base (367)..(367): a, c, t, g, unknown or other
  misc_feature (367)..(367): n is a, c, g, or t
  modified_base (463)..(463): a, c, t, g, unknown or other
  misc_feature (463)..(463): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagcctggggcctcagtgaaggtctcctgcaaggcttctggattctacgtttacctcctatagtatcaactgggtcgcgccgaggccgcgtaggacaacgacctgacgtggagtgggngtagggcgaaaccctacacgtggtctcacagtcgtctcgacccncgtccgtccggacacgtaccttaccagtacgaacccgacgtaacctcctaccaataaaccacgtacgtaccctacaagtggtacggtagacggacncctagacactcgtcgaacgcgaaccggtccttacttaacgttactggtacgcggtaacgaccgtcccgaacgtacggttcccgggagtaccggtacccggtaccggcgtacgggtcccggttacctttacggcccgtttcgggtacccgggggg

SEQ ID NO: 206781 - DNA, 743 bp, Homo sapiens
  misc_feature: GYAE6OF01CVZJZ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtagaaagaagtccgtgggggcccttgaggtggaaacggtcctccgtggaccaagggtctttcgtgggatttcgtaccgttttaacctcctaataacggtatacgaaaccgttgggtcgcggccagggccctacgtaggaaccgaaccgtaccgtaggtaggtaggtagtggggtaactacggggacctaaacccgtaacaccggtggtacgttacaacgtagttcggttccttacccaaaccccgtacgttcccgttacccggggaacacggtaaccctttaaccaacgttacgaaccctaaccgaaacccttccctaaccaaactaaaaccactaacgacccgtaaacgtagtacggtaggttacggaaggtcgaccttacgaactactacgtaggaaccaaccgacggtccttacttaacgttaacgtcggtacgaacggacgtacggtaccccgaaggtaaccgtcccgggttacggaccggtacccgtaacggcgtaacggtccggttaccgtttcggaccgttttcggaccggggg

SEQ ID NO: 206782 - DNA, 665 bp, Homo sapiens
  misc_feature: GYAE6OF01E0WEV.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagccgtggggcctcgagtgaaggtcctcctgcgaaggtcttcgtggattcaccgtttacctcctatagtatcgaacgtgggtcgccgccaggccgctcggacaacgaccgtgagtggagtgggagtcgggaccgtaaacccctaacacgtggtcgtacacgtagttgtccttccacccacgtcccgtccgggactacgaccttaccatacgaacccaacgtaacccttcccgtaaccaaacttaaaaccacgaaaccgtacccttaaacgacggttaacggggtacgttacgggaacgggacgtacccgtagacctacgtcgtacgaccgaccgtaccggtccgttacttattacgtgacggacgtacgtaccgtacccgacgttaccgtaccgggagtaccgaccgtaccggccgtacgggtcccggttacctttacggtccgtttcgggaccggggg

SEQ ID NO: 206783 - DNA, 632 bp, Homo sapiens
  misc_feature: GYAE6OF01CN9YK.17.25.C03.1.454.CMB.1.raw
  modified_base (251)..(251): a, c, t, g, unknown or other
  misc_feature (251)..(251): n is a, c, g, or t
  modified_base (588)..(588): a, c, t, g, unknown or other
  misc_feature (588)..(588): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggttctcctgcgaaggcttcgnggtattctacgtttacctcctatagtatcaacgtgggtcgccgccgaggccgcgtacggacaaccgaccgtgaggtggagtgggagtcggggacctaaacccgtaacgtacgttggtcgtcaacgtacgttcgtccttaccgaccctacgtccccgtaccggggactaacgtaacctttacccgaataccgaacctaaccgtaaccctcctaaccaaactaaaccgacaacgtaccctacagtacggtaacggttgaacggacgcctacgactagtcacgacgaccgacggccttattacgttacgtgtcgacggtagccgtacccgagacgtcggngccgacgtacggcgtacgccgttcgttcgtcgttcgggaccggg

SEQ ID NO: 206784 - DNA, 606 bp, Homo sapiens
  misc_feature: GYAE6OF01DPHP7.17.25.C03.1.454.CMB.1.raw
  modified_base (244)..(244): a, c, t, g, unknown or other
  misc_feature (244)..(244): n is a, c, g, or t
  modified_base (280)..(280): a, c, t, g, unknown or other
  misc_feature (280)..(280): n is a, c, g, or t
  modified_base (377)..(377): a, c, t, g, unknown or other
  misc_feature (377)..(377): n is a, c, g, or t
  modified_base (442)..(442): a, c, t, g, unknown or other
  misc_feature (442)..(442): n is a, c, g, or t
  modified_base (458)..(458): a, c, t, g, unknown or other
  misc_feature (458)..(458): n is a, c, g, or t
  modified_base (469)..(469): a, c, t, g, unknown or other
  misc_feature (469)..(469): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcgagtgaggtctcctgcaggcttcnggattcacgtttacctcctatagtatcaactgggtncgccaggccgcgtcggacaacgacctgaggtggagtggggatcggggaccaaaccccgtaacgacgttggtcgtcactagttcgtccttccaccctntcccgtacgggacagaccttaccagtacgacccacgaacctccaccaataaaccacacgacctanagtggagttgaggacncctgactagtncggaacgaccgaccggtccgtacttacgttacgtggtcgacgtacgaccgtaccccgaggtacgtcccgggtagaccggtacccgtacgggccgtacggtccggttaccctttacggtccgttcgggtacccggggg

SEQ ID NO: 206785 - DNA, 752 bp, Homo sapiens
  misc_feature: GYAE6OF01DM1LC.17.25.C03.1.454.CMB.1.raw
  modified_base (282)..(282): a, c, t, g, unknown or other
  misc_feature (282)..(282): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcgagtgaaggtctcctgcaaggcttctggattcacgtttacctcctatagtatcaacgtgggtncgccgaggccgcgtaggacaacgacctgaggtggagtgggacgtacgggacctaaacccgtaagtacgtggtcgtcacgtagttcgtcctttccgaacccctacgttacccgtaccggggaactacggtaacctttaacccgacgttacgaaccccgtaaccgtaacccttccctaacctaaacttaaaaccaccgtacgtaccctaacgtaacgttacgggtaagttacggaacgggtacgcccgttagaacctacgttacgtaaccggaaccggtacccgtaacccgggttaccgttaccgtttaacgttttaacccgttggtacgggtaacccggtaaacgggtacccggtttacccccgaacgggtaaccggtttccccgggaggtaacccggtacccggtaccgggtaccgtacgggtacccggttacccgtttttacggaccggttttccgggaacccgggggg

SEQ ID NO: 206786 - DNA, 660 bp, Homo sapiens
  misc_feature: GYAE6OF01BRITT.17.25.C03.1.454.CMB.1.raw
  modified_base (343)..(343): a, c, t, g, unknown or other
  misc_feature (343)..(343): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttcgtggattcacgtttacctcctatagtatcaacgtgggtgcgccaggccgctggacaacgacctggagtggagtgggatgggacaaccctaacactggtntcacagttcgtcttaccaccctatcccgtaccgggacacgtaccttaccatacgaaccaacgtaacctcctaccaactaaaccacaacgacctaacacgtggaagttggaacggacgtccgtaggaactacgtcgtacggaaccgaacggacccgggtacccgttacgttaagttacctaggtaccggacgaacggttacccggtaccccgtaacggtaccggttacccgggtacggaaccggtaccccgtaacgggaccgaccgggttacccgggttacccgttttacggtaacccggtttcgggtaaccgggggg

SEQ ID NO: 206787 - DNA, 553 bp, Homo sapiens
  misc_feature: GYAE6OF01A8XM4.17.25.C03.1.454.CMB.1.raw
  modified_base (284)..(284): a, c, t, g, unknown or other
  misc_feature (284)..(284): n is a, c, g, or t
  modified_base (372)..(372): a, c, t, g, unknown or other
  misc_feature (372)..(372): n is a, c, g, or t
  modified_base (425)..(425): a, c, t, g, unknown or other
  misc_feature (425)..(425): n is a, c, g, or t
  modified_base (434)..(434): a, c, t, g, unknown or other
  misc_feature (434)..(434): n is a, c, g, or t
  modified_base (448)..(448): a, c, t, g, unknown or other
  misc_feature (448)..(448): n is a, c, g, or t
  modified_base (454)..(454): a, c, t, g, unknown or other
  misc_feature (454)..(454): n is a, c, g, or t
  modified_base (457)..(457): a, c, t, g, unknown or other
  misc_feature (457)..(457): n is a, c, g, or t
  modified_base (472)..(472): a, c, t, g, unknown or other
  misc_feature (472)..(472): n is a, c, g, or t
  modified_base (480)..(480): a, c, t, g, unknown or other
  misc_feature (480)..(480): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctcctgcaaggcttctggattcacgtttacctcctatagtatcaacgtgggtncgccaggccgctggaccaacgcctggagtggagtggggatcggggaccgaaccctaacgacgtggtcgtcacgagtcgtcttcacccntcccgtccgggacacgtacttaccatcgaccacgacctcctaccaactaaacncacgcctanagtggagttgagcnctgacntcngacgcgacggtcctntattacgngtgcgagcgtacccagtacgccggtggacgaccgtcggcacgggccgttaccgttcgtcgttcgggaccgggg

SEQ ID NO: 206788 - DNA, 625 bp, Homo sapiens
  misc_feature: GYAE6OF01BMXJC.17.25.C03.1.454.CMB.1.raw
  modified_base (248)..(248): a, c, t, g, unknown or other
  misc_feature (248)..(248): n is a, c, g, or t
  modified_base (448)..(448): a, c, t, g, unknown or other
  misc_feature (448)..(448): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagagccgtggggcctcgagtgaaggtctcctgcaaggtcttcgnggtattctaccgtttacctctatagtatcaacgtgggtgccgccgagggcccgtacgtcggaaccaacgtacctggacggtggagtgggagtcgggaccgtaacccgtaacgacgtggtctacacgtagtcgtacttaccaccctagtcccgtacggacacgtacttaccatcgaaccacgtacctcctaccaataaacncaacgtcctaacagtagggagttaggagtacgcccgtagactactcgtacggaacgaccgtaccggtccgttacttacttacggtgtacggacgtacgaccgttcccgaacggtcgtccgggtacgaccggtaccgtacgcgtacggtccggtacgtttcggcgttcgggaccgggg

SEQ ID NO: 206789 - DNA, 640 bp, Homo sapiens
  misc_feature: GYAE6OF01CHJ3X.17.25.C03.1.454.CMB.1.raw
  modified_base (243)..(243): a, c, t, g, unknown or other
  misc_feature (243)..(243): n is a, c, g, or t
  modified_base (280)..(280): a, c, t, g, unknown or other
  misc_feature (280)..(280): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgcaggcttntggattcacgtttacctcctatagtatcaactgggtncgccaggccgctggacacgacctgagtggatggggatggggaccaaacccctaacgacgtgggtgtaccacgtagttcgttccttccgaacccctcgtccccggtacgacgtacgttacctactacgtacccaccgaaccgtacctccctaactaaactaaccaacgacctaccgtaactaggtacggtagtaggacggtacctacgtacgtactacgtcgtaccggaaccaccggtaccggtaccttacttacgttacgtggtaccggcgtacgtcccgtaccgaccggtaccggtacggtacgcccggtaccggaccgcgtaccggttccgttacggtcgttccgtggggtacccggg

SEQ ID NO: 206790 - DNA, 782 bp, Homo sapiens
  misc_feature: GYAE6OF01BHXBC.17.25.C03.1.454.CMB.1.raw
  modified_base (316)..(316): a, c, t, g, unknown or other
  misc_feature (316)..(316): n is a, c, g, or t
tcagcgtagactagcacgaccggtgctcgatttagtagtgtagatttggggtttggggactcaacaaccacatctgtcctctagacgaaaaccctgtgacgcacagctcctcaccatcggactggacctggaggactccttcttcgttggtggcagcagctacaagtcgcccactcccgaggtcgcagtcgtggtgctaggtcgtggggctggaggtgaagacgcgtgggcctgagtgaacggtctccgtgacgtaaggtcttcgtggtacttccgtacgtttacctacgtatacggtactccgaacgtgggtacncgccgaggcccagtacggaacaacggtcctaggacggttcggaagtgggaatcggggaacctaacccgtaaacggtcgtaggttaccgacgagtacggttacgtcctaccgaccctacgtcccgaacgggatacgaacgttacacgtacgaaccctacgtaaccttccgaactaactaaaccacgtacgtacctaacgaagtacgggtattacgggacgtacgtcccgtaaggtcctaacggttcctaacggggaacccgttaaccgaccgggttacccgttaacgtttacgttaacggtcggtaaccgggggtactaaacggtacccggttaaccccgaaacggttaccgggttaccggggtacttaaaccccgggttacccgaaacgggttccccgggtaaacgggttccccgggttttaccgtttaaccggtaacccgggttccccggggttaacccgggggg

SEQ ID NO: 206791 - DNA, 598 bp, Homo sapiens
  misc_feature: GYAE6OF01CUY78.17.25.C03.1.454.CMB.1.raw
  modified_base (287)..(287): a, c, t, g, unknown or other
  misc_feature (287)..(287): n is a, c, g, or t
  modified_base (454)..(454): a, c, t, g, unknown or other
  misc_feature (454)..(454): n is a, c, g, or t
  modified_base (513)..(513): a, c, t, g, unknown or other
  misc_feature (513)..(513): n is a, c, g, or t
  modified_base (519)..(519): a, c, t, g, unknown or other
  misc_feature (519)..(519): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtgggcctcaggtgaaggtctcctgacaggcttcgtggtattcgtacgtttacctcctatagtatacaactgggtnccgcgacggccgcgtcggaacaacgcctagaggtggatgggagtcggggacctaaaccctaacgacgtggtcgtacacgtaagttgtccttaccaccctactccgtaccggactacgacttacatacgaccaacgtaacctcctaccaactaaaccacacgcctaanacgtggagttagaacgtgcctagactatcgtacgacgacacgggtcctattacttacgngtacgngacgtaccgaccgacggtacgtaccgggtgacggacccgtagggcgacggtccgttaccgttgccgtttcggacggggg

SEQ ID NO: 206792 - DNA, 636 bp, Homo sapiens
  misc_feature: GYAE6OF01CXPO1.17.25.C03.1.454.CMB.1.raw
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgcaggcttctggattcacgtttacctcctatagtatcaactgggtgcgccgaggccgctggaccaacgacctgagtggagtgggatgggacaacccctaagaccgtggtcgtcacgtagtcgttccttccaccctacttcccgtacccgggacagtacccttaccactacgacccacgaacctccctaccaactaaacacacgcctaacatgggagttaggacggagcctagactatcgtacgaaccgaccgaccgggtcccgttacttaacgttaccgtaggttcgaccggtacgaccgtccccgaacggtacgtacccgggtacggaccggaccccggttacgggacccgtacgggtcccggttaccgttttcggtaccgtttcccgggtaccgggggg

SEQ ID NO: 206793 - DNA, 739 bp, Homo sapiens
  misc_feature: GYAE6OF01DVGBS.17.25.C03.1.454.CMB.1.raw
  modified_base (674)..(674): a, c, t, g, unknown or other
  misc_feature (674)..(674): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtagaagaacgccgtggggcctcgaggtggaaggttcctcctggacgaaggtccttcgtggtatttacctaccgttttaccctacctaattagtactacaacgtgggtcgccgtccgacggccgtcgtacggaaccaacgtaccgtggtacggtggagtgggagtcgggaaccgtaaacccgtaacgacgtggtcgtacgtacgtagttcgtccttacccacccgtacttacccggtacccgggactaaccgtaaccttacccgagtaccgaaccctaaccgtaaccctaccccttaaccgaaactaaaaccaacccgtaaccgtaccctaacgtaggttacgggtacgttacgggaccggtacgtaccctaaggaccttagtaccgtacggaaccgaaccgtccgggtacccttagttacgtttacgtcggtacgacgacgtacccggtaccctaacggtccgtccgggaacncccgggtacccgttacggccgtaacggtcccgttacgtttccggtagttcccgggtaaccggggg

SEQ ID NO: 206794 - DNA, 572 bp, Homo sapiens
  misc_feature: GYAE6OF01BXV63.17.25.C03.1.454.CMB.1.raw
  modified_base (298)..(298): a, c, t, g, unknown or other
  misc_feature (298)..(298): n is a, c, g, or t
  modified_base (338)..(338): a, c, t, g, unknown or other
  misc_feature (338)..(338): n is a, c, g, or t
  modified_base (366)..(366): a, c, t, g, unknown or other
  misc_feature (366)..(366): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggcctcagtgaaggtctcctgcaaggcttcgtggattcgacgtttacctccgtatacgtatcaaacgtgggtgcgccaggccgntggacaacgcctgagtggatgggatgggacaacccgtaanacgtggtcgtcacgagtgtcttcacccntccgtccgggacagaccttacattcgaccacgactccgtccaataaacacagcctacatggagttgaggagcccgtgacacgtctggaccgaacaccgggtccgtctacttactggtcgcggacgacgtccccaacggtacgttaccgggtacggacgtcccgtaacggcaacggtccggacctttcggactttccggtacggggg

SEQ ID NO: 206795 - DNA, 540 bp, Homo sapiens
  misc_feature: GYAE6OF01ATVZO.17.25.C03.1.454.CMB.1.raw
  modified_base (280)..(280): a, c, t, g, unknown or other
  misc_feature (280)..(280): n is a, c, g, or t
  modified_base (290)..(290): a, c, t, g, unknown or other
  misc_feature (290)..(290): n is a, c, g, or t
  modified_base (329)..(329): a, c, t, g, unknown or other
  misc_feature (329)..(329): n is a, c, g, or t
  modified_base (353)..(353): a, c, t, g, unknown or other
  misc_feature (353)..(353): n is a, c, g, or t
  modified_base (423)..(423): a, c, t, g, unknown or other
  misc_feature (423)..(423): n is a, c, g, or t
  modified_base (434)..(434): a, c, t, g, unknown or other
  misc_feature (434)..(434): n is a, c, g, or t
  modified_base (492)..(492): a, c, t, g, unknown or other
  misc_feature (492)..(492): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcaatgaaggtctcctgcaaggcttctggattcacgtttacctcctatagtatcaactgggtncgccaggccnctggacacgacctgagtggatgggatgggacaacctaanactggtgcacagtgtcttcacccntcccgtcggacagaccttacatacgacccacgaactcctacaataaacacagcctacatgagttgaggancctgacatcgngaacgcacgggtccgtcttagttactgtcgcgaacggactccccgagcttacccgggngtaacgcccgtaggcacggtccggcctttggaaccttcgtaccggggg

SEQ ID NO: 206796 - DNA, 682 bp, Homo sapiens
  misc_feature: GYAE6OF01D5F5G.17.25.C03.1.454.CMB.1.raw
  modified_base (181)..(181): a, c, t, g, unknown or other
  misc_feature (181)..(181): n is a, c, g, or t
  modified_base (369)..(369): a, c, t, g, unknown or other
  misc_feature (369)..(369): n is a, c, g, or t
  modified_base (405)..(405): a, c, t, g, unknown or other
  misc_feature (405)..(405): n is a, c, g, or t
  modified_base (613)..(613): a, c, t, g, unknown or other
  misc_feature (613)..(613): n is a, c, g, or t
tcagcgtagactagcacgaccggtgctcgatttagtagtgtagatttgggtttggggactcaacaaccacatctgtcctctagagaaaaccctgtgagcacagctcctcaccagtggactggacctggaggactcctcttcgttggtggcagaagctacaagtcgcccactcccgaggtcncagctggtgcagtcgtgggctagaggtagaagacgccgtcgggcctcgtaggtgaacggttcctccgtcggactaggtctttcgtaggtacttaccgttaccgtttaccctctaagtagtactccgtagtggtacgtccgtaccgacggccgacgtaggaaccaccgtacgtgaggtcgagtacgggngtacgggaccaaaccgtacgaccgtggtacgtaccngtacgtgtaccctcacctcgtacccgtaggacacctactacagtaccgacctactacctacctaaccaacgtacaccgtactactacgtagtacggtaggtcgacgggtatcctaggactagtaccacggaaccgtaccgaccggttacgttactaacgttcgtagaccggtacacggtaccgtacccgaacgttccggtaccggtanacccggtccgttacggaccgaccgggttccgttacgtttccgtaccggttcggaaccggggtacccggg

SEQ ID NO: 206797 - DNA, 761 bp, Homo sapiens
  misc_feature: GYAE6OF01A3I7P.17.25.C03.1.454.CMB.1.raw
  modified_base (221)..(221): a, c, t, g, unknown or other
  misc_feature (221)..(221): n is a, c, g, or t
  modified_base (286)..(286): a, c, t, g, unknown or other
  misc_feature (286)..(286): n is a, c, g, or t
  modified_base (362)..(362): a, c, t, g, unknown or other
  misc_feature (362)..(362): n is a, c, g, or t
tcagcgtagactagcacgaccggtgctcgatttagtagtgtagatttgggtttggggacgtcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctnagtgaaggtctccgtgcaaggtcttctggattctacgtttacctctatagtatcaacgttgggtnccggccagggccgtcgtagggacctaaacggaccctggaagtgggacgttggggatggggaccaaaccccgttaanacgttcgggtgtaccaacgtagtcggttcctaccgacccactcccgtacgggactaggtaccttaccagtccgaacccgtaccgtaaaccttccctaaccgtaaacgttaaaaccaaccgtaacggtacccttaacgaacggttagggtaacggtttacgggaacggtaccgggtaccctttacgggaaattaccgttaaccgttacgggaaccccggtaacgtaaccccgggggttacccgtttaccttaacgtttaacccgtgggttaccgtaaccggtaacgggaccgtttaccccgaaacgggtaccgttccggggtaacggacggtaccccgttaaaccgggcgtacgggtccccggtttaccgtttcggtaacccggttccgggtaacggggg

SEQ ID NO: 206798 - DNA, 710 bp, Homo sapiens
  misc_feature: GYAE6OF01CKXER.17.25.C03.1.454.CMB.1.raw
  modified_base (288)..(288): a, c, t, g, unknown or other
  misc_feature (288)..(288): n is a, c, g, or t
  modified_base (488)..(488): a, c, t, g, unknown or other
  misc_feature (488)..(488): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagccgtggggcctcgagtgaggtctccgtgcaaggtcttcgtggattcgtacgtttacctctatagtatacaacgtggggtnccgccgaggcccgcgtggaacacgaccgtggacggtggagtgggagtcggggaccgtaaccctaacgacgttggtcgtacacgtaggttcgttccttaccgacccgtactcccgtcgggaacctacgtaaccttaccgactaccgaaccctaaccgtaaccctcctaaccgtaactaaaacccacgtacgaccctaacgngtagggtaagttcggacggtacgtaccgtgaactacgtccgtacgaaccggtaccgaccgggtacccgtttacttaacggtttaccttgggtaccgtaccgggtaacgtacccggtaccccgaacgggtacgttcccggggtacgtaccggaccccggttaacgggcgtaacccggggttccggttacccttttcgggaacccgtttcggggtacccggggg

SEQ ID NO: 206799 - DNA, 727 bp, Homo sapiens
  misc_feature: GYAE6OF01ELLFV.17.25.C03.1.454.CMB.1.raw
  modified_base (626)..(626): a, c, t, g, unknown or other
  misc_feature (626)..(626): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcgttggtggcagcagctacagtcgcccactcccgaggtgcagcgtggtgcagtcgtgggctggaggtagaagagccgtgggcctcgagtgaagtctaccgtgacgacggtcttcgtaggtacttccgttaccgtttacctaccttatacgttactacgtacggtgggtacgccgaccgacggccgtcgtacggaaccaaccggtacgtaggtaggtaggacggtgggaacggtccgggtaacccgaaacccgtaacggtacggtacggtacgtacgacgtacggtcgttcccttacccgaccctacgtcccggtacgggacctacgtaaccgttaccacgttaccgaacctaaccgtaccccttaccaaccaaacgtaaaccgctaaccggacccttaagtacggttacgggtagtacgggacgtacgaccgttagactacgttcgacgaacccggtaccgtaccggtaccttacggtaacttcggnggtccgaacgtacgtaccccgtacgaacggtccgtacggtacacccggttcgaccgtaggtacccggttccgttaccttcgggtccgttacggggcccggg

SEQ ID NO: 206800 - DNA, 744 bp, Homo sapiens
  misc_feature: GYAE6OF01DICIK.17.25.C03.1.454.CMB.1.raw
  modified_base (275)..(275): a, c, t, g, unknown or other
  misc_feature (275)..(275): n is a, c, g, or t
tcagcgtagactagcacgaccggtgctcgatttagtagtgtagatttgggtttggggactcaacaaccacatctgtcctctagaagaaaaccctgtgagcacagctcctcaccatggactggacctggaggatcctctttcgttggtggcagcagctaacaagtcgccccactcccgaggtgcagctggtgcagtcgtggggctggaggtgaagacgccgtggggcctcgagtgaaggtctctgacaaggcaggtgatatatctacaacaaaatntaggtatagtaagttgggcgacggacgaccggacccccggaagaagggtcttaggagggttgggggtgggggtggtacgagggtcggttcgtttagggaaccggttaaggctaacgtagtagtcgacgaacggaagagtaggaacgggacaaggacgtacaacgtaacgttaacccgaccggaacccaaccccgaacgaaccacgacgttacctaacacgtacgacgtaaacgtcggaaccgacgtaccgtaggaacggaacgtaccgtaacggaaacccggtaccggaacccggggttaccctttaacgttaacccgttttaaggtccgggttaacggaaccggttaaaacggtttaacgtttttcggtttttacccgtagggttacctaaaccggtttacgtttaaacccgttaagtttttacggaaacgtttacggaccctttacggttaaggtcgggttaaacgg

SEQ ID NO: 206801 - DNA, 695 bp, Homo sapiens
  misc_feature: GYAE6OF01CF9RG.17.25.C03.1.454.CMB.1.raw
  modified_base (279)..(279): a, c, t, g, unknown or other
  misc_feature (279)..(279): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatctcttcttggtggcagcagctacaagtgcccactcccaggtgcagctggtgcagtctggggctgaggtgaagaagcctggggcctcagtgaaggtctcctgcaggcttctggatttcacgtttacctcctatagtatcaactgggtncgccaggccgctggacaacgccgtgagtggagtgggatcggggaccgaaacccttaacgacgttggtcgttaccacgagtttcgtcctttaccacccctagtccccgtaccggggacaagtacccttaccgacgtcgaacccaacgtaaccctccctaccaactaaacacacgaccctaacagtgggtaagttggacggtacgcccttgaacgtattaccgacggtaaccgacccggaccgggtcccgttacttaacgtttacccgttaggtacgtaccgggtaacgtacccggttaccccgaaccgggtaacgtccccggggtttacgaccgggtaccccggttaaacggggtcccgaacggggtccccggtttcccgttttaacggtccccggtttacgggtaccccggggggg

SEQ ID NO: 206802 - DNA, 692 bp, Homo sapiens
  misc_feature: GYAE6OF01DC05J.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggagtatcctcttcttggtggcagcagctacaagtgcccactcccaggtgcagctggtgcagtcgtggggctgaggtgaagaagccgtggggcctcagtgaaggtctcctgcgaaggtcttcgtggattcacgtttacctctatagtatcaacgtgggtgcgccgaggccgtcgtaggacaacgcctggaggtggagtggggatcgggaccgtaaaccctaacgcgtaggtcgttacaacgtacggttacgttccctttaccgaacccctacgttcccgtaacccggggactacgtaaccttaccgattacgaacccgaacgtaacccttcccaacctaagtaaaaacccacgaacgtaccctaaacgtacggttagggtaaggttagggacggtaacggtccctaggaacctagtccgtaggaacccgtaacgaccgggttccttacgttaatttaccgtggtacggcgtaacgtacccggtaccgacggtacggtcccgggtagaccggtacccgtaaccggcgtaacgggcccgttccgtttcggccgttcgggtacccggggg

SEQ ID NO: 206803 - DNA, 655 bp, Homo sapiens
  misc_feature: GYAE6OF01BGBJW.17.25.C03.1.454.CMB.1.raw
  modified_base (281)..(281): a, c, t, g, unknown or other
  misc_feature (281)..(281): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtgggcctcagtgaaggtctcctgcaggcttctggattcacgtttacctcctatagtatcaacgtgggtncgccaggcccgccggacacgacctgagtggatgggatgggaccaaccctagacgttgggtcgtcacgagttcgtcttaccaccctagtcccgtaccgggacacgtaccttaccatcgaacccacgtaacctcctaccaataaaccacacgaccctaactagtcggagttcggaacgggacgtcccgtgaacctagtccgtacggaccgaaccggacccgggtaccgttaccgttattaacgttcggtacgtaccggaacggtaccgtaccccgacggtaccggtcccgggttaggacccggtcccgtaacggggccgtaccgggtcccgggttaccttttagggacccgtttccgggtcggggggtaaccccgg

SEQ ID NO: 206804 - DNA, 693 bp, Homo sapiens
  misc_feature: GYAE6OF01B8IZW.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagagccgtggggcctcagtgaaggtctccgtgcaaggtcttgtggtattctacgtttacctcctatagtatcaacgtggtgcgccaggccgcgtgacacgacctgagtggagtgggagtcgggccgaaaccctaacgacgtggtcgtacgacgtagtcgttaccttaccacccgtacgtcccggttaccgggaactacgtaacctttaaccagttaccggaaccctaccgtaacccttaccctaaccaaactaaaccaaccgactacctaactagtacgtagttaggacggtacgtcctagactacgttacgtcgaaccggaccgacccgggttaccttacttaaccgttacgtggtaccgtcggtaacgtacccggtacccgtacggtaccggttcccggggttacggacccggtaccggtaccgggaccgtaaccggggtccccgtttacggtttccggtaaccgggtttcgggtaaccccgggggg

SEQ ID NO: 206805 - DNA, 775 bp, Homo sapiens
  misc_feature: GYAE6OF01D2BDA.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagaacgccgtgggggcctcgaggtgaacggtctccgtgacaaggtcttcgtggtactttcgtaacgttttaccctccttaattacggtaatccgaaacgttggggtcgccgtcccgaacggggcccgtcgtacggaaccgaaaccggacccgttggaacggtgggacggtgggggaacgttacggggaccgtaaacccctaaacgtaccgttgggtacgtaccacgtaggttcgttcccttacaccccgtagtccccggtaccggggaactacgtaccttacccgaagtaccggtaacccaaccgtaacctcccgtaacaacttaaaaccgaccgacgtacctacgagttacgggaagtttgaggtacgtcctagactagtccgaggtaaccgaccgtacccgggtacccgtttacgttaacgttaacgttcggacgtacccggaaaggtaccccggtacccgtaacggtaaccggttaccccgggtaggacccgggtacccgtacccggggacgtaacgggtccccggttaccgttttaccgggacccgtttcggggtacccgggggg

SEQ ID NO: 206806 - DNA, 567 bp, Homo sapiens
  misc_feature: GYAE6OF01B45DK.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaacctatttaaattggtatcagcaagaaacctggaaaacgccccagacctcctagactctcgtggtcgcactccactctgcgaagtggcctccatcgaggttcagtggcagtggatcgtaggactagtatttcaatcctacaccatccaccactctgacctaaccgtgagtattgtagtactaattcctaacttactagtaccaacgtagtacgttacgtaccgttcccctcgtaccttacgtttcggaccgtacggggtaacctaaagttacgaagtactaacgaaacggtacgtggtacgacgtcgactacctattccgtcgttacccg

SEQ ID NO: 206807 - DNA, 676 bp, Homo sapiens
  misc_feature: GYAE6OF01B1I0F.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggcctcgagtgaaggtctcctgcaaggcttcgaggatctacgttacctctatagtatcaacgtggtcgcgccgaggcccgcgtcggaaccaacgtaccgtggaggtaggagtgggagtcgggaccgtaaaccctaacgacgtgggtacgtccaacgtacgttcgttaccttaccaacccctacgtcccgtacccggggacctacggtaaccctttaaccacgttacgaaccaaccgtaaccgttcccctaacaaacgtaaacaccgtacgtacctacaaggttggtaacgttaggaaggtccgccgtaacgtactacgtcgtacggaaccgtactacccgggtcttacttacgttacgtgtcggaccgtagtacccgtcccgaaacgtccgttaccggtaggtcccgtcccggtaaggccgacggtcccggttactttcggtaccggttcgggtacccgggg

SEQ ID NO: 206808 - DNA, 699 bp, Homo sapiens
  misc_feature: GYAE6OF01BCGYJ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtctcctgcaaggcttcgtggattctacgtttacctcctatagtatcaacgtgggtgcgccaggccgctggacaaccgacctggagtggacgtggggagtcgggaccgaaccctaagacgtggtcgtccacgtagttcgtcctttccaacccctacttcccggtcccggggaaccacggtaacctttaacccagtaccgaacccaaccgtaacccgttcccttaacccgaataaaacccacgaacgtacctaacctaggtagggtaacggtttggaacgggtaccgaccctaggaacctatccgtagaaccggtaaccgaccgggtacccgttacgttactttaacgtccggttacggaccgtaacggtaccggtaccccgaacggtcgttacccggggtaggaccggtacccgtaccgggcgtaccggccgggttacccgtttcggaccgtttccgggtaccgggggg

SEQ ID NO: 206809 - DNA, 870 bp, Homo sapiens
  misc_feature: GYAE6OF01EL2BS.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggactcctcttcgttggtggcagcagctacaagtcgcccactcccaggtgcagctggtgcgagtcgtggggctggaggtagaagacggccgtggggcctacgaggtgaacggttctaccgtgacgaaggtcttcgtaggtactttaccgttaccgttttaccctaccttaagtaaggttactaccgtaaacggttcggggtacgcccggacccgaacggggtcccggaccgtacggggaaccctaaaccgggtccgttagggaagggttcggggaaggtacgggggtaacggtacggggtaaccccgtaaaacccccgttaaggtacccggttaggggttaccgtaccgaacggttacggttacggtttaccccttaccccgaaccccgttaccggttacccggtacccggggaactacggttaaacccttacgtaacgtaacccggaaccctaacccgtaaacccttccctaacctaaaccgtaaaacccacgtaaccgtacccttaagacggttagggttacggttaacggaacggtacgtacctaacggtacctaaccgttacggacggtaaccgtaaccggtaccggggttacccttaactttaacggtttacccgagggttacccgacggtaaccggtaccccgtaaccgtacgggtaccggtcccggggtaacgtccggtaccgtaccggacgtcgggtacccgtttacgttacgttccggttcggggtaccgggg

SEQ ID NO: 206810 - DNA, 793 bp, Homo sapiens
  misc_feature: GYAE6OF01BJXGV.17.25.C03.1.454.CMB.1.raw
  modified_base (281)..(281): a, c, t, g, unknown or other
  misc_feature (281)..(281): n is a, c, g, or t
  modified_base (293)..(293): a, c, t, g, unknown or other
  misc_feature (293)..(293): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagcgtggggcctcagtgaggtctcctgcaggcttctggattcctacgtttacctcctatagtatcaacgtgggtncgccgaggccgntaggacaacgcctggagtggtatgggatcggggaccgaaaccgtacacgtggtacgtcgaacgtagttcgtaccgtttccaaccccgtacgttccccgtaccggggactaacgtacctttaacccgaagttacccggaaccctaaccggtaacccttaccccgtaacccgtaaattaaaaccccaccgtaaccgtaccccgttaaacgagttacggggtaagtttacgggaaggggtaaccgtccgttaacggaacctaacgttaccgttaccggaaacccggacccggtaacccggggttcccccgtttaacgtttaaccggtttacccgttacggggttaccgtaccggggtaaccgggttaaccccggtacccccctaagggggtaacccgttaccccggggttaggccccggttaacccggtaccgggtaacccgtacggggtcccgggttttaccccgttttagggtaccccggttttccgggggaaccgggggg

SEQ ID NO: 206811 - DNA, 729 bp, Homo sapiens
  misc_feature: GYAE6OF01DG9BU.17.25.C03.1.454.CMB.1.raw
tcagcgtagactagcacgaccggtgctcgatttagtagtgtagatttgggtttggggactcaaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaacgccgtggggcctcgagtgaaggtcctccgtgacgaggtcttcgtggattcctacgtttacctcctatagtatctaacgtgggtcgcgccgacggccgcgtacggaacaaccgactggagtggagtgggatcgggaccaaccctaacgacgtggtctcacgtaggttcgttcttccaacccctacgtcccggtacccgggactaacggtacctttaaccacgtaccgaaccctaaccgtaaccttacccctaacctaaactaaacccacgtaaccgaccttaacgtagtacgggtaagttacggacgggactccgtacgactacgtcgtaacgaccggaaccgtaccgggtaccgttacgttacgtttaaccgttcggtacggtaccggtaacgtaccgtacccccggaaacggtacccggttaccgggttaacggaccggtaccccggtaacgggacccgtacgggttaccccgggtttccgtttaaccggttcccggttccggggtaacccgggggg

SEQ ID NO: 206812 - DNA, 631 bp, Homo sapiens
  misc_feature: GYAE6OF01DR3CZ.17.25.C03.1.454.CMB.1.raw
  modified_base (103)..(103): a, c, t, g, unknown or other
  misc_feature (103)..(103): n is a, c, g, or t
  modified_base (224)..(224): a, c, t, g, unknown or other
  misc_feature (224)..(224): n is a, c, g, or t
  modified_base (451)..(451): a, c, t, g, unknown or other
  misc_feature (451)..(451): n is a, c, g, or t
  modified_base (602)..(602): a, c, t, g, unknown or other
  misc_feature (602)..(602): n is a, c, g, or t
tcagcgtagactagcacgaccggtgctcgatttagtagtgtagatttggggtttgggggagtcagtctcagtcaggacacagcatggacatggagggtccccntcagctccgtggggctcctgctactctggctcgagctgccagatgtgacatccagatcgacccagtcctccacttccctcctgtcctcgccttcgtgggtggggtacaaggtcgtcacctntacctaccgttggaccggacaagtccgaacggttaacttaaaacttatttaaagttgatacaggacaaagtaaccaggaaaaccgcccagtaccctcgtgtacttcgacgtggtcaccatcccattcgcgacggacgtcgacctcctaagtccggtaaggtcaagggtcgacgtaggtagtcgtaccggtagggaacttagtactttacgaacttccgacctaaccnctaccctaactctaccacgtacaaccggtgaggtacttgacacgtactactactacgtacacaactggttactacccgttccgttacccctgttaccgttcggtacggtaccggaagggtaacctagtaacgagtaaccgtaacaacggtncgtaagtcagtaccaggtctcttcgttac

SEQ ID NO: 206813 - DNA, 697 bp, Homo sapiens
  misc_feature: GYAE6OF01A8GJP.17.25.C03.1.454.CMB.1.raw
  modified_base (387)..(387): a, c, t, g, unknown or other
  misc_feature (387)..(387): n is a, c, g, or t
tcagcgtagactagcacgaccggtgctcgatttagtagtgtagatttgggtttgggactcaacaaccacatctgtcctctagagaaaaccctgtgagcacagctcctcaccatggactggacctggaggatcctcttcttgggtggcagcagctacaagtcgcccactcccgaggtgcagcgtggtgcagtcgtggggctgaggtagaagagcgtggggcctcgagtgaacggtctccgtgacaaggtcttcgtggtattacgtacgtttaccgtcttaagtagtatacaacgttcgggtgccgaccgaggccgacgtacggaccaacgccgtggaaggttgaagtggggacgtacgggaccgtaaaccctaacgtacgtacgggtntacgacgtacgttcttaccttaccaacccgtacttacccggtaccgggtacctaacgtaccctttaaccgaacttaccgaaacccgtaaccgtaacccgttaccctaaccctaaacgtaaacctaaccgaacgtacctaacgtagtacgggtaggttacggacgtacgccgtacgactatacgtacggaaccgtaccgtacccgaccgttacttacttacgtgaacgtcggaacgtccgtaccgtacggcgtccggtacggcgtaccgacggcgtaccgacggttaccttcggaccgttcgggacccggg

SEQ ID NO: 206814 - DNA, 747 bp, Homo sapiens
  misc_feature: GYAE6OF01C4AS7.17.25.C03.1.454.CMB.1.raw
  modified_base (355)..(355): a, c, t, g, unknown or other
  misc_feature (355)..(355): n is a, c, g, or t
tcagcgtagactagcacgaccggtgctcgatttagtagtgtagatttggggtttgggggagtcagtctcagtcaggacacagcatggacatgacgggtccccgctcagctccgtggggctcctgctactctggctccgagctgccagatgtgacatccagatcgacccagtcctccactccctccctgtctcgtcctcgtgggtgggggtcagacgtacaccatcacgttcggaccggaataacgtccaacggtaaccgtttaaaaaccttagtttaaagttggtaactcgaaggacaaagaaacccgtaaggaaaaccgccccaagtaccctaccgtagacttcctcgttggancctactcccgacttcgtggaacggaggtccggtcccgtaccgtacggtcggtaggttacgaggtggagaggttaggacttcgaggtaacagttatttacaatcctacacctataccctacgacctcgtacaccgtaaccgtaggtacgtagttgtactaactaacttacctaacgtaacgttagaaactaaccggtaagttaaccgttaccgtacccggttacccctaccgttacgtttaaccggtttccggggaaaccggttaaaccggggaaaccctttaaaagggtacggtaaaagtacccggtaaaactaaaccgggtacggtttacgggtacgtaccggttaaccaccccggttaaacctaacggtttccctttaaccggttttccc

SEQ ID NO: 206815 - DNA, 652 bp, Homo sapiens
  misc_feature: GYAE6OF01BLV4R.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagcgtggggcctcagtgaaggtctcctgcaggcttctggattctacgtttacctctatagtatcaacgtgggtcgcgccaggccgctggaccaacgacctggagtggatgggagtggggaccaaaccctaagaccgtgggtcgtacctaacgtaggtcgttccttacgacccctatcccggtccggggaactacgtaccttaaccgatcgaacccacgtaacctcccactaactaaaccaccacgacctacgagtacggagttggaggacgcctagacacgttacgacggtaaccgaccggacggtacccgttacttaacgttacgtcggtcggaccggaacgtaccgtaccccgtacggtaccgttcccgggagtaccggtaccccgtaacgggccgtaccggtcccgggttaccctttacgggtcccgttccgggtccgggggg

SEQ ID NO: 206816 - DNA, 589 bp, Homo sapiens
  misc_feature: GYAE6OF01AGHUB.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctggtggggtcagagtcaccatcacttgccggacaagtcacggtacgttaaaacctatttaaattggtatcagcaagaaacctggaaaacgcccagaccctctgatctcgtggtgcactccactcgtgccgtaagtcggccgtccatcggaggttcaggtcggcaggtggatcgtagggactagtatttacaattctaccacctactaccaaccctactctacgaccctaaccgtaggaaggtattgtacactaacttcctaacttacgtcgtaaccaacgtagtaacttaccgtaccgtttcccctacgtccttacgtttcgggacccgtaacggggtacctaaaggttcgaacgtacgtacgaaacgtacgtgtcggactcgacctacctattcgtcgttc

SEQ ID NO: 206817 - DNA, 941 bp, Homo sapiens
  misc_feature: GYAE6OF01ALZ2X.17.25.C03.1.454.CMB.1.raw
  modified_base (311)..(311): a, c, t, g, unknown or other
  misc_feature (311)..(311): n is a, c, g, or t
tcagcgtagactagcacgaccggtgctcgatttagtagtgtagatttggggtttgggggagtcagtctcagtcaggacacagcatggacatgagggtccccgctcagctccgtggggctcctgctactctggctccgagctgccagatgtgacatccagatcgacccagtctccactccctcctgtctcgtcctcgtgggtgggggtcagacgtcaccatctacgtcggccggacaacgtccgaaccggtaacgtttaaaaccttattttaaagttaggtactacgagacgaacgaaaccgtaggaaaccncccacgaccctctacgtacttccgttacgtcggtcgactactaccctaccgttcgtacggtaccggtaacgggtccgggtaccccgttaccccgtacggttaccgggttaacggggtttacggtaacggggtcgggtacggtaacggggttacgggtaacggttacgggtacggggtaacctaacggtttaacgttttaccgtaaaccttccctaacccgtaacccttaacctacccctaaaccccgttcttacccggttaaccgaacccgttaaacccggtagggttaacggtttacgtttcggtaaccgtaaacctttaaccctttaacccgtttaaccgtttaaacccggttaccgttaaaccccgtaaacgtttaaaccggggttttaaccccgtttaaccccgtttacccccgggttttaccccccggttaggttttaacccccggttttaaccgggggtttaaccccgggtaacccggggtaaaacggggttaaccccgtttaaaagggttaaccgtaaacccggttaaaccggtaaaacggtaaaccccggttggttaaccgggttaccggtacccgttacgtaaccccgtaacgtttacgttcccgtttacggtttaccccg

SEQ ID NO: 206818 - DNA, 588 bp, Homo sapiens
  misc_feature: GYAE6OF01BCZR1.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgcgtggacaacgacctggagtggatggggatgggacgaaccctaacgacgtggtcgtcacgagtcgtcttcaccctatccgtccgggacagacttaccatcgaccacgaacctccacataaacacacgcctaacatggagttggacgacgcctgactatcgtagaccgacgaccggtcccgttacttaacgttactcggtacgacggtagtaccgtaccccaacggtccgtcccgggtagaccggtccgtacgggccgacggtccgggttaccctttcggaccgtttcggtaccggggg

SEQ ID NO: 206819 - DNA, 557 bp, Homo sapiens
  misc_feature: GYAE6OF01AREET.17.25.C03.1.454.CMB.1.raw
  modified_base (304)..(304): a, c, t, g, unknown or other
  misc_feature (304)..(304): n is a, c, g, or t
  modified_base (434)..(434): a, c, t, g, unknown or other
  misc_feature (434)..(434): n is a, c, g, or t
  modified_base (441)..(441): a, c, t, g, unknown or other
  misc_feature (441)..(441): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgtttaaaacctattttaaagtggtatcaccgcaagaaacctggaaaacgccccagacctcctgatctctggtncatcccactctgcgaagtggcgtcccatcgaggttcaggtggcagtggatcgtgggacagtatttcaatcctacaccactccacctactctcgacctaactgaggtattgtagacctaatctaactactntaccaanagtacgttacacgttccctcgtacttacgttttcggaccgtacgggtaacctaaagttggaacgtactaacgaaacgtacttacggtcggactacgccaactactcttcggttacc

SEQ ID NO: 206820 - DNA, 591 bp, Homo sapiens
  misc_feature: GYAE6OF01ET22S.17.25.C03.1.454.CMB.1.raw
  modified_base (296)..(296): a, c, t, g, unknown or other
  misc_feature (296)..(296): n is a, c, g, or t
  modified_base (309)..(309): a, c, t, g, unknown or other
  misc_feature (309)..(309): n is a, c, g, or t
  modified_base (342)..(342): a, c, t, g, unknown or other
  misc_feature (342)..(342): n is a, c, g, or t
  modified_base (350)..(350): a, c, t, g, unknown or other
  misc_feature (350)..(350): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctcctgcaaggtcttcgtggattcacgtttacctctatagtatcaacgtgggtgccgcaggccgntcggacaacgccngagtggagtgggatcgggcaacctagacgtggntcagagtntctcaccctagtcccgtacgggacacgtacttaccagtacgaacccacgtaaccctcctacaataaaccacacgccctaagacgtaggagttaggaggacgtcctagacctagtccgagtaacccgacgtaccggtccgtattacttacgagtcgacggtacgtacgtcccgaacgtcggtaccgggtacgacgtcccgtaggcgacggtccggttacctttggccgttcggtaccggggg

SEQ ID NO: 206821 - DNA, 599 bp, Homo sapiens
  misc_feature: GYAE6OF01CGBIB.17.25.C03.1.454.CMB.1.raw
  modified_base (293)..(293): a, c, t, g, unknown or other
  misc_feature (293)..(293): n is a, c, g, or t
  modified_base (450)..(450): a, c, t, g, unknown or other
  misc_feature (450)..(450): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagccgtggggcctcagtgaaggtctcctgcaaggcttcgtggattcacgtttacctcctatatatcaacgtgggtgcgccgaggccncgtcggacaaccgactggaggtggagtgggagtcgggaccgaaaccctaacgacgtggtcgtacgactaggttctcttacgaccctacgttcccgtacgggacaacgtaccttaccatacgaaccacgaacctcctaccaataaaccacacgcctanagtaggtagttgacggacgtccgtgaacctatccgtagaaccgacgtcccgggtaccgttcttaacttcgtcgtacgcgaacgtccgtaccgacgtcgtccggagaccggtccacggtcacggtcgtacgttcgtacgtcggaccgggg

SEQ ID NO: 206822 - DNA, 808 bp, Homo sapiens
  misc_feature: GYAE6OF01EBNF1.17.25.C03.1.454.CMB.1.raw
tcagcgtagactagcacgaccggtgctcgatttagtagtgtagatttgggtttgggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcgagtgaaggtctcctgcaaggcttctggattcacgtttacctccttatagtatacaacgtggggtcgcgccacggccgctaggaccaacgaccttggaaggtggagtggggagtcgggaaccgtaaccctaacgacgtgggtacgtcaacgtacgttcgttacctttacccgaacccctacgttccccggtaccggggtaaccaacggttacccttaacccgacgtaccggaacccctaaccggtaacccttacccccttaacccaactttaaaaaacccgaacccgtaacgtaaccccctttaaacgaacggtttacggggtaaggttttacgggaaacgggtacggtaccccgttagtaacctacgttcccgtaaacgggaacccgtaacccggtaacccggggtccccgttttaacgttaacgtttacccggttaggtaaccggaccgggtaaaggtaccccggttaaccccggtaccggtaaccggttccccggggtaaggtacccgggaccccggtaccgggtacccgtaacgggggttcccggttacccgtttttacgggcccgttttacggggtacccgggggg

SEQ ID NO: 206823 - DNA, 703 bp, Homo sapiens
  misc_feature: GYAE6OF01EJR5Y.17.25.C03.1.454.CMB.1.raw
  modified_base (246)..(246): a, c, t, g, unknown or other
  misc_feature (246)..(246): n is a, c, g, or t
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcgagtgaggtctcctgcaaggcttcnggtattcacgtttacctcctatagtatcacgtgggtcncgccaggccgntcggacaacgccgtgagtggagtgggagtcgggaccgaacccgtaagacgtggtacgtcacgtagtcgttacctccgacccctacgttcccggtaccggggaacctacggtaaccttacccaacgttaccgaacccctaacgtaacccttcccctaaccgtaaactaaaaccaccgtaaccgacccttaacgagtacgggtaagttacgggaacgggacgtacccgttggaacctacgttccgaacggaacccgtaccggaccgggtacccttacgttaacgtttaccgtcggtacggaccgtaacggtacccgtacccgtaacggtacgttcccgggtagaccggtaccccggtacggaccgtacgggtccggttaccctttcggtaccgttccggggtaccggggg

SEQ ID NO: 206824 - DNA, 624 bp, Homo sapiens
  misc_feature: GYAE6OF01D06ZN.17.25.C03.1.454.CMB.1.raw
  modified_base (262)..(262): a, c, t, g, unknown or other
  misc_feature (262)..(262): n is a, c, g, or t
  modified_base (281)..(281): a, c, t, g, unknown or other
  misc_feature (281)..(281): n is a, c, g, or t
  modified_base (293)..(293): a, c, t, g, unknown or other
  misc_feature (293)..(293): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtgcccactcccaggtgcagctggtgcagtctggggctggaggtgaagaagccgtggggcctcagtgaaggtctcctgcaggcttctggattcacgtttaccnctatagtatcaactgggtncgccgaggccgntggacaacgccgtgagtggatgggatgggaccgaaccctaacgacgtggtgtacacgtagtgtccttccaacccagttcccgtacgggacacgtaccttaaccagtacgacctacgaacctccctaaccaataaaccacacgtaccctaagagtgggtagttagacggactcctagactactcgtacgacgaaccgtacgggtccttacttacttacgtggtacgacggaacgtaccgtaccccgacggtacgttcccgggtagtaccggacccgtacgggacgtacgggtacccggttccgttttacgggccgtttcggggtaccggggg

SEQ ID NO: 206825 - DNA, 756 bp, Homo sapiens
  misc_feature: GYAE6OF01ESTTA.17.25.C03.1.454.CMB.1.raw
  modified_base (299)..(299): a, c, t, g, unknown or other
  misc_feature (299)..(299): n is a, c, g, or t
tcagcgtagactagcacgaccggtgctcgatttagtagtgtagatttgggtttggggactcaacaaccacatctgtcctctagagaaaaccctgtgagcacagccctcctcaccatggactggacctggaggatcctcttcttgggtggcagcgagctacaagtgcccactcccaggtgcagctggtgcagtctgggctggaggtgaagagccgtggggcctcagtgaggtctcctgcaaggcttctggattcacgtttacctcctatagtatcaacgtgggtgccgccgagggcccgngtacggaccaacggcctggaggtggacgttggggagtcggggacccgtaaaccctaacgacgttggtacgtaccacgtaggttcgttccttaccaaccccgtactcccggtaccgggaactacgtaaccttaccgatcgaaccctacgaaccttccctaccaacgtaaaccacgacgtaccctaacgtacgttagggtaggtttacggaacgggtaccgtcccgtagaaccctagttaccggtacggaaaccggtaacccgtacccggggttacccgtttaacgtttaacttaccggtaggttccgggaaccggtaaaccggtacccggttacccccggaaacgggttacccgttaccgggggtacggaaccgtaccccgggtaacccgggcgtaaacccggggttcccggtttacccgtttttacggggacccgttttcgggggaaccccgggggg

SEQ ID NO: 206826 - DNA, 627 bp, Homo sapiens
  misc_feature: GYAE6OF01EBP0M.17.25.C03.1.454.CMB.1.raw
  modified_base (280)..(280): a, c, t, g, unknown or other
  misc_feature (280)..(280): n is a, c, g, or t
  modified_base (445)..(445): a, c, t, g, unknown or other
  misc_feature (445)..(445): n is a, c, g, or t
  modified_base (560)..(560): a, c, t, g, unknown or other
  misc_feature (560)..(560): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaacgtgggtncgccgaggccgcgtaggaccaacggacctggagtggagtgggatcggggaccgaaaccctaacgacgtggtctacacgagtcgtcttccaccctagtcccgtaccgggacacgtaccttacagtcgacccaacgtaacctcctaccaactaaacacacgcctaanagtgggtagttgacggacgccctagactactcgtacgaccgtacgaccgggtccttaattacttaccgtggttcgaccggtagtaccgtaccccgaaggtaccgtcccggggtanaccgggtacccgttaacggggctacgggtcccggttacctttacggtaccgttcggggacccggggg

SEQ ID NO: 206827 - DNA, 667 bp, Homo sapiens
  misc_feature: GYAE6OF01BGGTL.17.25.C03.1.454.CMB.1.raw
  modified_base (284)..(284): a, c, t, g, unknown or other
  misc_feature (284)..(284): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcgtagtcgtggggctggaggtgaagagccgtggggcctcgagtgaaggtctccgtgacgaggtcttcgtggtacttctaccgtttacctacctatagtntacgacgtgggtcgcgccgacggccgtcgtaggaccaaccggaccgtggaggtaggtagtgggagtcgggaccgaacccgtaacacgtggtccgtacacgtagttcgttccttaccgaccctacgtccgtacgggactacgtaccttaccatacgaaccctaacgtaccctcccgtaacaacttaaaaccaccgtacgaccttaacgagtcggtaagttacggaggtacgccgtagtacacgttacacggaaccacgtacccggtccgttacttaacgtcgtaggtcgacggagtacccgtaccgaacggttccgaccggacggtaccgccggtacggccgtacggttccggttaccttcgggtaccgttggggtacccgggg

SEQ ID NO: 206828 - DNA, 698 bp, Homo sapiens
  misc_feature: GYAE6OF01CO4UN.17.25.C03.1.454.CMB.1.raw
  modified_base (317)..(317): a, c, t, g, unknown or other
  misc_feature (317)..(317): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagccgtggggcctcgagtgaaggtcctcctgacaaggcttcgtggtactttccgtaccgttttacctccttaatagttataccaacgtggggtcgccgccgagggccccgngtacggaaccaaccgaccgttggaagtgggatgggatcgggaccgaaccctaacgacgtggtcgtacacgtagttcgttaccttccgaccctacgtcccgtaccggggaactacgtaaccgtttaaccagttaccgaacccgtaaccgaacccttcccaaccctaaactaaaccgaccaccgtaccttaacgaggtaggtacgttacggacggacgtcccttagactactcgtgaaccgtacgaccgggtccgttactatttcgtgtcgtagacggtaccgtacccctaagggtaccgttcccgggtaggcccgtacccggttaccgggccgtaacgggtacccggtttacccgttttacgccggtttcgggtaccggggg

SEQ ID NO: 206829 - DNA, 750 bp, Homo sapiens
  misc_feature: GYAE6OF01DQA4O.17.25.C03.1.454.CMB.1.raw
  modified_base (279)..(279): a, c, t, g, unknown or other
  misc_feature (279)..(279): n is a, c, g, or t
  modified_base (303)..(303): a, c, t, g, unknown or other
  misc_feature (303)..(303): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctcctgtctgcctctggtcggggtcagagtcaccatcacttgccggacaagtcacggacgttaaaacttattaaattggtatcagacaagaaacctaggaaaacncccagacctctgattctcgtggtncctacgtccctactctacggacggaacggttcgggaccgtccccagttccgggtaacggtttcgaacgggttcgggacgtaggttacgggtaactcggttacggggaacctaggttaactttttaccgaaaacgtttcctaaccctacccgtaacttaccctaacccgtaacctttccgtacgtacccgtaaccgttagggtaacggttacgtttacggttacgtacctaaacttttttccgtaaccttaccgttacgtaaccgtaaacgtaagttaaccggtttaacctacccggtttacccccgtcgttaccgttacccggtttttcgggaacccggtaaccggggtaaaccgtaaaggttaacggaacgtaaacgtaaccgtaaaccggtaacgttcgggttacggtaccgtccgtaaccacccgttacgttcgttcgttaccg

SEQ ID NO: 206830 - DNA, 525 bp, Homo sapiens
  misc_feature: GYAE6OF01BZFS5.17.25.C03.1.454.CMB.1.raw
  modified_base (517)..(517): a, c, t, g, unknown or other
  misc_feature (517)..(517): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacacgacctgagtggatgggatgggcaacctaacactggtgttacagtgtcttcacccatccctcggacagacttacatgaccacgaactcctaccaataaaccacagccctacagtggagttgaggagccctgacatctggacgacgaccggccgtctattactgtagcgagacgtcccagacgtccggtagcgcctacggcacggcggtccttgacttcgnggggaccg

SEQ ID NO: 206831 - DNA, 807 bp, Homo sapiens
  misc_feature: GYAE6OF01DT00A.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtcgcccactcccgaggtgcagcgtggtgcaggtcgtggggctggaggtgaagagccgtgggcctcgagtggaacggtcctcgtgacgaaggtcttcgtggtactttccgtaacgttttacctccttatacgttataccgtaacgtgggtcgcgcccgagggcccgtcgtacggaaccaacgaccgtggaggtggagtgggagtcgggaccgaaccgtaagacgtggtctacgtacgacgttcgtaccttaccgacccctacgttcccggtaccgggaactaacggtaacccttaaccgagttaaccggaacccctaaccggttaacccctaccgttaaacccaacgtaaaaccacccgaacgtaaccctaggtaatacggggtaagttacgggaacggtactacccgttagaaccgttagtaccggaacgtaaccgtacccgggtacccgttacccgttacgtttaacttacggttacggtacggtaaccgggtaaccgttacccgggtaacccccgtaacggtacccggggttcccgggtaaccggtaacccgggtaacccccggttaccgggaaccggttaccggggtttaccccggtttaccggttttacccgggtaccggtttacccgggggtacccgggggg

SEQ ID NO: 206832 - DNA, 641 bp, Homo sapiens
  misc_feature: GYAE6OF01C8TDE.17.25.C03.1.454.CMB.1.raw
  modified_base (255)..(255): a, c, t, g, unknown or other
  misc_feature (255)..(255): n is a, c, g, or t
  modified_base (282)..(282): a, c, t, g, unknown or other
  misc_feature (282)..(282): n is a, c, g, or t
  modified_base (293)..(293): a, c, t, g, unknown or other
  misc_feature (293)..(293): n is a, c, g, or t
  modified_base (341)..(341): a, c, t, g, unknown or other
  misc_feature (341)..(341): n is a, c, g, or t
  modified_base (419)..(419): a, c, t, g, unknown or other
  misc_feature (419)..(419): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcctggggactgaggtgaagaagccgtggggcctcagtgaacggtctcctgcaaggcttctggattcncgttacctctatagtatcaacgtgggncgcaggtccgngtagacacgacctgagtggatgggatcgggacaaccgtacacgtggtntcactagtcgtcttcaccgtactccgtcgggacacgtaccttacgatcgaacccacgtaactcctaccgaataaaccncgactacctaagagttagggtagttacgaacggtacgtccgttagactacgtcgtaaggaccgaaccgtaccggtaccgttacttaaacgttcgtgggtacggacggacggacccgttccccgaacggttaccgtcccggggttacgaaccgggttcccgtaaacgggccgtaaccggtccgggttacccttttacgggcccgttttacgggacccgggggg

SEQ ID NO: 206833 - DNA, 600 bp, Homo sapiens
  misc_feature: GYAE6OF01BHSZU.17.25.C03.1.454.CMB.1.raw
  modified_base (549)..(549): a, c, t, g, unknown or other
  misc_feature (549)..(549): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctccgtgcaaggcttcgtggtattctacgtttaccctcctatagtatcaacgtgggtgcgtccgacggccgcgtcggacaacggacctggagtggagtgggagtgggaccgaaccgtaacacgtggtcgtacacgtagtcgtctcaccctactcccgtccgggacacgacttaccactcgaccacgaacctcctaccaactaaaccacacgtacctactacgtgtaggttgaaggacgtcctaggaccagttcgacgaaccgacgtaccgggtccttactacttacgtgtcgaccgtagtaccgtacccgagtcgtccggngacgtcccgtagaccgacggtacccgttcgtttcgcgttcgggtaccgggg

SEQ ID NO: 206834 - DNA, 705 bp, Homo sapiens
  misc_feature: GYAE6OF01DD607.17.25.C03.1.454.CMB.1.raw
  modified_base (248)..(248): a, c, t, g, unknown or other
  misc_feature (248)..(248): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcgagtgaaggtctcctgcaaggcttcgnggattcacgtttacctccgtatagtatcaacgtgggtcgcgccaggccgcgtggaacaacgacctgagtggagtgggatcgggaccgaaaccctaacgacgtggtgtcacgagttgtcttaccacctacgtcccgtcccggggacacgacttaaccatacgacccaacgtaacctccgtaccaactaaaccacacgtacctaacgtagtaggtaggttacgaacgggacgtcccgtagtaaccacgtacttacggaaccgaacccgtacccggggtcccgtttaaccgtttactttacggttcggttacggtacccggtaaacgggacccgttcccccgaaccggttaacggttaccccggggttcgtaacccggtaccccgttaacccggggaccgtaccggggttaccccgggttacccggtttttacggccgttttcccggggacccggggggg

SEQ ID NO: 206835 - DNA, 732 bp, Homo sapiens
  misc_feature: GYAE6OF01BOK98.17.25.C03.1.454.CMB.1.raw
  modified_base (222)..(222): a, c, t, g, unknown or other
  misc_feature (222)..(222): n is a, c, g, or t
  modified_base (244)..(244): a, c, t, g, unknown or other
  misc_feature (244)..(244): n is a, c, g, or t
  modified_base (279)..(279): a, c, t, g, unknown or other
  misc_feature (279)..(279): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctgggaggatcctcttcttggtggcagcagctacaagtgcccactcccaggtgcagctggtgcaggtcgtgggctggaggtgaagagccgtggggcctnagtgaggtctctgcaggcttgnggacttcacgtttacctctatagtatcaagtggtnccgccgaggccgcgtaggaaccaacgtaccgtggaggtggaacgtggggacgtacgggaaccgtaaaaccccgtaacgtacgtgggttctaccgaactaaggttcgtaccttaccaaccccgtacgtccgttacccgggaaactaccgtaaccttaaccgacgttaccggaaccctaaccgtaacccttacccgaacctaaactaaaaccgaccgaaccgtaacctaacgaagttacggggtaacgtttacgggaacgggtacgtacccgtaagtaacgtaccgtaacgttaccggaacccggtaaccggtaccgggtacccgttaacgttacgtttaaccggtggttacgacgggtaagaccccgttaacccgacgtacgttccgggaagccggtaccgggtaccgcgttaccggccgggttacctttacggtacccgtttgggacccgggg

SEQ ID NO: 206836 - DNA, 603 bp, Homo sapiens
  misc_feature: GYAE6OF01A7GEL.17.25.C03.1.454.CMB.1.raw
  modified_base (247)..(247): a, c, t, g, unknown or other
  misc_feature (247)..(247): n is a, c, g, or t
  modified_base (282)..(282): a, c, t, g, unknown or other
  misc_feature (282)..(282): n is a, c, g, or t
  modified_base (477)..(477): a, c, t, g, unknown or other
  misc_feature (477)..(477): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcgagtgaaggtctcctgcaaggcttcgnggattcacgtttacctcctatagtatcaactggtncgcaggccgctggacaacgcctggagtggagtgggagtcgggaccgaaaccctaacgacgtggtagtaccacacgttgtccttccaaccctacgttcccgtaccggggaccaacgtacctttaaccagttaccgaccctaacgtaacctccctaccaactaaaccgacaacgacctaacagtggagttggagacnccgtagactactcgagaccgacgaccggtccgttactacttcgtcgtgcgtagtactacccgacgtacgtccggacgcgtacccgacggacgacggtccgtacctttcggtaccttcggtacgggg

SEQ ID NO: 206837 - DNA, 771 bp, Homo sapiens
  misc_feature: GYAE6OF01AIR6B.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcgagtgaaggtctcctgcaaggcttctggtattcacgtttacctcctatagtatcaactgggtgcgccaggccgctggacaacgacctgagtggatggggagtcgggaccgaaacccctaacgtacgtgggtcgtacacgtagttcgtcctttcccaacccctaacgttcccgtaccggggacctaacggtaaccctttaccaacgtaccggaaaccccaccgtaacccttcccctaacctaaactaaaacccacccgaacgtaccctaacagtacggggtaacggtttaggaacggacgtacccgtaggtacctacgttaccggttacgggaacccgtaccggtaacccggggtacccgtttacttaaacgttttaccgtacgggttaccggaccgggtaacggtaacccggtacccccgtaaccgggtacccgtttacccgggggtacggtaacccgggtacccccggttaacccggggacggtaacccggggttcccgggttaccccggttttttacggacccggttttccgggggtaccccggggggg

SEQ ID NO: 206838 - DNA, 647 bp, Homo sapiens
  misc_feature: GYAE6OF01ERVR9.17.25.C03.1.454.CMB.1.raw
  modified_base (217)..(217): a, c, t, g, unknown or other
  misc_feature (217)..(217): n is a, c, g, or t
  modified_base (455)..(455): a, c, t, g, unknown or other
  misc_feature (455)..(455): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagctggggcctnagtgaaggtctcctgcaaggcttctggacttcacgtttacctcctatagtactcaacgtgggtgccgccgaggccgctcggaccaacggacctggagtggagtgggagtggggaccaacccgtaacgacgttggtcgtacacgtagtcgttccttccacccctactcccgtaccggggaacacgtaaccttaccagtacgaccacgaaccttccctaccaataaaccacacgacctanacgtgggagttaggacgggacgcccgtagaaccataccgtacgaaccggaccgaccgggtcccgtttacgttacttacgtcggtacgacggtaacgtaccgtaccccgtaacggtccgttacccgggtacgacccggccccgacgggcccgacggtcccggttacctttcggtaccgttcggtaccgggggg

SEQ ID NO: 206839 - DNA, 699 bp, Homo sapiens
  misc_feature: GYAE6OF01AEFHO.17.25.C03.1.454.CMB.1.raw
  modified_base (515)..(515): a, c, t, g, unknown or other
  misc_feature (515)..(515): n is a, c, g, or t
tcagcgtagactagcacgaccggtgctcgatttagtagtgtagatttgggtttggggtacgtcaacaaccacatctgtcctctagagaaaaccctgtgagcacagctcctcaccatggactggacctggaggatcctcttcttggtggcagcagctacaagtgccactcccaggtgcagctggtgcagtcgtggggctggaggtgaagaagccgtggggcctcgagtggaacggtctctgcgaaggtcttacgtggaattctaccggtttacctcctattagtactctaacgtgggtacgccgcctagggcccgtacgtacggaaccaaccgtaccgtggaacggtgggaagtcggggagtcggggacctaaaaccccgtacgtacgtcgggtcgtacaccgtagtcggtcctttaccgacccgtacttccggaccggggtaacaacgtaccttaccgtattaccggaaccctacgaacctaccgtaaccaactaacactaccgaacctacgtanacgggtagttcgaacgtacgacctacgactacgtcgtagaccgtagaccgtccgttcgtactacgttacgacggtagtaccggaacgtcccgtaacggtcgtacccgggttaggaccgttacccgggtaccgaccggtacgggtccccgttacccggtttacgtcccgggttcggtaccggggg

SEQ ID NO: 206840 - DNA, 648 bp, Homo sapiens
  misc_feature: GYAE6OF01BQEPC.17.25.C03.1.454.CMB.1.raw
  modified_base (377)..(377): a, c, t, g, unknown or other
  misc_feature (377)..(377): n is a, c, g, or t
  modified_base (434)..(434): a, c, t, g, unknown or other
  misc_feature (434)..(434): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcgagtgaaggtctcctgcaaggcttctggattctacgtttacctcctatagtatcaacgtgggtcgcgccgaggccgcgtcggacaacgccgtggagtggagtgggatcgggaccgaaccctaacgcgtggtctcacgtagtcgtccttaccaacccncgtcccgccgggacacgtacttaccatcgacctacgaacctccctaccaataaaccncacgtaccctaacgtaagtgggtaagttcggaacggtacgtccctaggactactcgtagaaccggtacgaccggggtcccttattaacgttcgttaggcgaccggtagtacccgttcccgaacggtaccggttccgggtgaacccggtacccgtaacccgggcgtaaccgggtcccggttacccgttttggaccccgtttggggtacccggggg

SEQ ID NO: 206841 - DNA, 776 bp, Homo sapiens
  misc_feature: GYAE6OF01C956T.17.25.C03.1.454.CMB.1.raw
  modified_base (222)..(222): a, c, t, g, unknown or other
  misc_feature (222)..(222): n is a, c, g, or t
  modified_base (247)..(247): a, c, t, g, unknown or other
  misc_feature (247)..(247): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggactggaggatcctcttcttggtggcagcagctacaagtgcccactcccaggtgcagctggtgcagtcgtggggctgaggtgaagaacgccgtggggcctnagtgaaggtctcctgacaaggcttntggtattctacgtttacctcctatagtatacaacgtggtcgcgccgaggccgcgtacggacaacgaccgtggaggtggtaggtgggagtcgggaccgtaaccctaacgtacgtggtacgtcgaacgtacggttcgtaccttaccaccctacgtcccgtaccggacgtacgtaccttaaccgacgtaccgaccctaaccgaacccttcccgtaacctaacgtaaaaaccaaccgaaccgtaccttaaacgaggttagggtaacggtttacgggaacgggaccgtacccgtttacgaaccgttaacgttccgtaaccggaaccggtaacccggtacccgggttaccccgtttacgtttaactttaaccggtacggtaccggaaccgggtaaccggtaaccgttacccccggaacggttaaccggttccccggggttaacggacccggttaacccccggtaaccgggccccgtacggggttccccccgggtttagttttacccggtaaccggtttcccggggtacccggggg

SEQ ID NO: 206842 - DNA, 569 bp, Homo sapiens
  misc_feature: GYAE6OF01DR52Y.17.25.C03.1.454.CMB.1.raw
  modified_base (283)..(283): a, c, t, g, unknown or other
  misc_feature (283)..(283): n is a, c, g, or t
  modified_base (307)..(307): a, c, t, g, unknown or other
  misc_feature (307)..(307): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtcgcnccaggccgctggacaacgctgagngagtgggatgggaccgaaccctaacactggtgtcacgagtgtccgttcacccagtcccaccgggacagtacttacatacgaccaacgacctccctaccataaacacacacctaacacgtaggtagttagaaggacgcctagacatacgtgaccgacgaccggtccgttactattactggtcgacgacgaccgtcccacggtctaccggtgacgacccgtacggaccgtacgaccggttcctttacgacttcgggtaccgggg

SEQ ID NO: 206843 - DNA, 688 bp, Homo sapiens
  misc_feature: GYAE6OF01AZZEK.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctgggcctcagtgaaggtcctctgcaaggcttctggattcacgtttacctcctaatagtatcaacgtgggtgcgccaggccgctggaccaacgacctgagtggagtgggatggggaccaaacccgtaacacgtggtctacgacacgttcgtccttaccaaccccacgttcccgtaccgggaacagtaaccttaccctaagtaccgaaccacgtaacctccctaccaaactaaaccacaacgtacctaacgagtagggtacgttaggaacggacgtacccgtagaactacttacgtacggaaccgaaccgtacggttaccgggtacccgtttaacttaacgtttaaccgtcggttacggaccggtaacggtacccggtaccccgtaacggtacggttcccgggtaggaacccggtaccccggttacgggtaccgaccggggtacccggtttcccgtttacggtaacccggtttcccggggg

SEQ ID NO: 206844 - DNA, 771 bp, Homo sapiens
  misc_feature: GYAE6OF01B8Y8I.17.25.C03.1.454.CMB.1.raw
  modified_base (319)..(319): a, c, t, g, unknown or other
  misc_feature (319)..(319): n is a, c, g, or t
tcagcgtagactagcacgaccggtgctcgatttagtagtgtagatttgggtttgggagtcagtctcagtcaggacacagcatggacatgagggtccccgctcagctccgtggggctcctgctactctggctccgagctcgccagatgtagaaactccagactacgacccagtcctccactccctccctgtctgtccttcgtgggtcggggtcaggacgtccaacctactctacgttcgaccggacaacgtccgtaacggtaaccttaaaaaccttatttaaacgtggtatcagtacaacgtaaaccgtaacggaaaccncccaacgtacctctaggtactctacgttggtcactactccgtacttacgtacggtacgtaacggtcggtaccgttccgaacgttccggtagttcggtaacggtcggacgtaagggcgttacgtcggtaagggaacgtaacgttactttacgaaacttccctaacctaaccttacctaaccctaaccgtacgttaccgtaacgtaccctaaacgggttacggtaacgtaacgtttcggaacctaacttaacttcccgtaacgttacgtaaccgttaacgtaaacgtaacggttaccggttaacccgttacccggttacccgtaccttaccggtttaacgtttaccgggaacggtaaacgggtaaaccgtaagtaaccggaacgtaaacgtaccgtaaacggttaacgtcggtaccggtacgtcgtaccctacttcgtacgttccttacgtacc

SEQ ID NO: 206845 - DNA, 603 bp, Homo sapiens
  misc_feature: GYAE6OF01EH1UO.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcagtgaaggtctcctgcaaggcttctggattcacgtttacctcctatagtatcaactgggtgcgccaggccgctggacaacgacctggagtggagtgggagtcggggaccgaaaccctaacgacgtgggtcgtcacgtagtcgttccttccacccctattcccgtaccggggacacgtaccttaccatcgacccacgaacctccctaccaactaaaccacacgacctaacagtgggtagttggaggacgcctagactatctagaccgacgaccggtccttacttattacgtgtcgcgacgaccgtcccgacggtacgtccgggtagacggcccgtacgggccgtacggcccggttcctttcggtaccgttcgggtaccggggg

SEQ ID NO: 206846 - DNA, 598 bp, Homo sapiens
  misc_feature: GYAE6OF01A3BVH.17.25.C03.1.454.CMB.1.raw
  modified_base (280)..(280): a, c, t, g, unknown or other
  misc_feature (280)..(280): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacacgacctgagtggatgggatggggccgaaaccctaacacgtgggtgtacacagtgtccttccgaccctatcccgtccgggacagaccttaccatcgaccacgacctcctaccaataaaccacacgacctaacacgtgggagttgaggacgcctgactatcctaggaccgacgaccgggtccgttacttacgttacgtcggtaggccgaaggtaccgtacccccgaacggtacgtcccgggtagacggtcccgtaacgggccgtacgggtcccgggttccttttcggccgtttccggcggggg

SEQ ID NO: 206847 - DNA, 628 bp, Homo sapiens
  misc_feature: GYAE6OF01B1KSS.17.25.C03.1.454.CMB.1.raw
  modified_base (289)..(289): a, c, t, g, unknown or other
  misc_feature (289)..(289): n is a, c, g, or t
  modified_base (342)..(342): a, c, t, g, unknown or other
  misc_feature (342)..(342): n is a, c, g, or t
  modified_base (349)..(349): a, c, t, g, unknown or other
  misc_feature (349)..(349): n is a, c, g, or t
  modified_base (357)..(357): a, c, t, g, unknown or other
  misc_feature (357)..(357): n is a, c, g, or t
  modified_base (420)..(420): a, c, t, g, unknown or other
  misc_feature (420)..(420): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtcctcctgcaaggcttcgtggattcacgttttacctcctatagtatccaacgtgggtncgccaggccgctggaacaacgcctgagtggagtgggatgggacaacccgtacncgtggtntcacagtntctaccaccctatccgtacgggacagtacttaccatcgaccacgacctccctacaactaaacncacgcctacagtcgggtagttgacggtacgccgttagactactcgtacgaccggaccgtaccgggtccgttactttaacgttacgttcggtaggaccggaacggtaccgtacccccgaaggtaccgttcccggggtagtaccggacccggttaccgggacgtacggtcccgggtacccttttcgggtcccgtttccgggtaccggggg

SEQ ID NO: 206848 - DNA, 732 bp, Homo sapiens
  misc_feature: GYAE6OF01BGS8X.17.25.C03.1.454.CMB.1.raw
  modified_base (246)..(246): a, c, t, g, unknown or other
  misc_feature (246)..(246): n is a, c, g, or t
  modified_base (619)..(619): a, c, t, g, unknown or other
  misc_feature (619)..(619): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagccgtggggcctcgagtgaaggtctcctgacaaggcttcnggtacttctacgtttacctcctagtagtatcgaacgttgggcgccgccgaggcccgtcgtacggaaccaaccggccgtggaggtggagtgggagtcggggaacctaaacccgtaacgacgtgggtacgtacacgtagttcgtaccgttaccgacccctagtcccggtaccgggaactacggtaccttaccgacgttacgacccgtaaccggtaacccttccctaaccaaacgttaaaccaccgtaaccggtacctaacgttacggtacgggtaacggtttcgggaaacggtaccgtcccgtaacggtactaacgttaccggtaacggtaacccggaacccggtaccgggttaccgttaccttacgtttaccgngttaccggaccggtaacggtaccgtaccccgtaacggtccggttaccggacggtcggaccccgtaacggccgtacgggtcccggttactttcggacggtttcggtaccggggg

SEQ ID NO: 206849 - DNA, 782 bp, Homo sapiens
  misc_feature: GYAE6OF01D1UGR.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtgcagcagctacagtcgcccactccgaggtgcagcgtggtgcagtcgtgggctggaggtagaagacggccgtcggggcctacgaggtgaacggtcctccgtgacgacggtcttcgtaggtacttaccgtacgtttaccctacttaatagtactaccgtaacgtggggtcgaccggccgtaggcccgtgtacggaaccgaaccggtccgtaggtaggtacggtacgtaggggtacgtcgggaaccctaacccgtaacgcgtggtctacgtacgtacggtcttccgtacccaacccgtgtacccggccggtaaacgaccgtaaccttaccgacgttacccgaacctaacccgtacccttacccgtaacctaaactaaaaccctccgtaaccgtaacccgttaacggtaaggttacggtaacggttaacggacgggtaccgttcgtaacgtaccgttaacgtacgtaaccggaacccggtaccccggtaccgggtaccgtttaccttaacggtttaccgtacggtacggaaccggtccggtttacccaccgggtaaccgtaccgtaccggggacgtaccgtacccgggacgtaccgggtacggttcccggttacgttcccgtacggttccgggtaccgggg

SEQ ID NO: 206850 - DNA, 554 bp, Homo sapiens
  misc_feature: GYAE6OF01EYDZG.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggagtgggatggggacaaaccctaacacgtggtgtcacgagtgttcttcaccctatcccgtccgggacagacttaccatcgaccacgaacctccacaataaacacacgacctacatggagttgaggagcctgactatcgtagacgacgaccggtccgtactattacgtgtgcgaagacgtccccgaacggctccgggagacgcccgtacggcgacggtccggtacctttcgcgttcggaccggggg

SEQ ID NO: 206851 - DNA, 764 bp, Homo sapiens
  misc_feature: GYAE6OF01CFPHT.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctgggctcctgctactctggctccgagctgccagatgtgacatccagatgacccagtcctccactcctccctgtctcgcctcgtggtgggggtcagacgtcacatcacgttcgccggaacacgtacgacggtaacgttaaaaccttatttaaagttggtaactcaacgacaaaggaaacccgtaggaaaaccgcccccgaagtacccctctagacttccttacgtgggtcacctactcccacttcgtacggtaccgaaggttcggacccgtaccgagtcggtaggttctagggtcgcgtaggtacgggtaacttcggtaggaacgtacgttaacgtttacgtaacttccgttaccaacccgtactaccctaaccctaccttacgtaccgaacccctaaccggtaggttaacggtacgtttcggtacgtaacctaactttaccgttaaccgtaacgtacgtaacctaacgtaacggttaacgtttaccttaccccgtttacccgtaccgttaccgtttacggttttaccgggaccggtaaacggggtaaacccgttaaggttaacggaaccgtaaccggttaaaccgtaaaacccgggtaacgttcgggttacgacccgttcgtaaccctaccgttaccttcgtttccgttacccg

SEQ ID NO: 206852 - DNA, 592 bp, Homo sapiens
  misc_feature: GYAE6OF01A8KXG.17.25.C03.1.454.CMB.1.raw
  modified_base (452)..(452): a, c, t, g, unknown or other
  misc_feature (452)..(452): n is a, c, g, or t
  modified_base (465)..(465): a, c, t, g, unknown or other
  misc_feature (465)..(465): n is a, c, g, or t
  modified_base (498)..(498): a, c, t, g, unknown or other
  misc_feature (498)..(498): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggcctcgagtgaaggtctccgtgcaaggcttcgtggtattcaccgttttacctccttatagtatcaacgtgggtcgcgccgaggccgcgtcggacaacgacctggaggtggagtgggagtgggaccgaaaccctaacacgtggtgtacacgtagtgttccttaccaccctactcccgtcccgggacacgtaaccttaaccataccgaaccaacgtaacctccctaccaactaaaaccnccaacgccctaanagttggtaagttggaaggacgcctagacatcgngacgacgacggccgttactattacgtgtgcgagaccgtacccgacgtcgtccggagaccgccgacggcgcggtccgtctttgccgttcggcggg

SEQ ID NO: 206853 - DNA, 642 bp, Homo sapiens
  misc_feature: GYAE6OF01DVP3S.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccacctcccaggtgcagcgtggtgctagtcgtgggctggaggtagaagagccgtggggcctcgagtgaggtcctccgtgcgaggtcttcgtggtacttcgtaccgttttaccctcctatacgtatactaacggttgggtcgccggtccgacgggtcccgtcgtacgggaaccaaccggtaccgtggaggtggagtgggagtcgggaccaaaccctacgcgtggcgtacacgtagtcgttcctccacctactccgacggacacgtactacagtaccgaccaccgtacctccacctaacaacacacgtacctaacgagtggtagttaggacgtacgtcgtacgactacgtacgtaccggaacgtacccgacggtcccgttacttacgttacgtggtacgacgtacgccgtaccgacggtccgtacggacgtccggaccgtacggcgtacggtcgttccgtttcgtccgtcgggtaccgggg

SEQ ID NO: 206854 - DNA, 618 bp, Homo sapiens
  misc_feature: GYAE6OF01DBJ7M.17.25.C03.1.454.CMB.1.raw
  modified_base (461)..(461): a, c, t, g, unknown or other
  misc_feature (461)..(461): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttcgtggattcacgtttacctcctatagtatcaacgtgggtcgcgccaggccgcgtggaaccaacgaccgtgacggtggagtgggagtggggaccgaacccctaacgacgtggtgtccgacgtagttgtcctttccgaacccctagtcccgtacccggggactacgacctttaccagtacgacccaacgtaaccctcctaccaaataacactacgcctaacngtggagttagaacggcgacctggactagttcgacgtaaccgaccgaccgtcccgttattacgttacgtggtacgacgtagaccgtcccgaacggtcgtcccgggtagccggtcccgtacggctacggccgttccgtttgtacgttcggtaccggggg

SEQ ID NO: 206855 - DNA, 626 bp, Homo sapiens
  misc_feature: GYAE6OF01B564A.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagagccgtggggcctcagtgagtctcctgcaggcttctggattctacgtttacctcctatagtatcaacgtgggtgcgccaggccgctggaccaacgacctggagtggagtgggatcgggaccgaaccctaacgacgtggttcgcacgagtcgtccttcaccgactccgtccggacacgacttacactacgacctacgaacctcctaccaactaaacacaacgtacctacgagtacggtagttaggaggacgtcctaggtaccagtctacggaccgacgaccgggtccgtacttaacgttacgtcgttacggaccgacgtaccgtacccggaacgtaccgttccggtacggtaccggtcccgttaccggcgtacgggtccggttaccctttacgggtacccgtttcggtaacccgggggg

SEQ ID NO: 206856 - DNA, 745 bp, Homo sapiens
  misc_feature: GYAE6OF01EULXM.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcaggtgaaggtctcctgcaaggtcttcgtggtacttctacgttttacctcctatagtatcaacgtgggtcgcgccaggccgcgtggaacaaccgtcctggagtggagtgggatcggggacctaaaccctaacgacgtggtctacacgtagtcgttaccttaccaccctacgttcccgtacgggaacacggtaacctttaaccagtaccgaaccctaaccgtaaccttacccgtaactaaactaaaaccacgtaacgtaccctaacgagttacgggtacgtttacggaacggtaccgtccgtaagtaacctacgttaccgtaacggaacccgaaccgtaccggggtacccctttaacgttaacgtttaccggtacggttcggacgggtaaccgtacccgttaccccgtaacggtaccgttcccgggtaacggtaacccgtaccccgggttaaccgggacccgtaaaccgggttcccgggtttaacccgttttacggtaacccggttttccgggaacccggggggg

SEQ ID NO: 206857 - DNA, 766 bp, Homo sapiens
  misc_feature: GYAE6OF01CDI8M.17.25.C03.1.454.CMB.1.raw
  modified_base (481)..(481): a, c, t, g, unknown or other
  misc_feature (481)..(481): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctgagtgaaggtctccgtgcgaaggtcttcgtggtactttacgttacctcctagtagtatcaacgtggggtcgcgccgaggccgcgtaggaccaacgcctggagtggagtgggatcgggaccgaaccctaacacgttggtacgtaccacgtaggttcgttcttacccgaccccagttcccgtaccggggaactaccggtacctttaacccgagttaccgaaccctaaccggtaaaccttcccgtaaaccaacttaaaaaccncccgaaacggtaccccctttaaagaaggtttacggggtaaacgttttacggggaaaccgggtacggtaccccgtttagggaaaccctaacgtttcccggtaaccgaaccgggtaacccgtacccgggggttacccgttaacctttaacgttacggttacgggtacggtaccggaacggtaccgttacccccgaaggtaccggttcccgggtagacccggtcccggtaacggccgtaacggtcccggtttaccgtttaggacccgtttggggtcgggaaccccggg

SEQ ID NO: 206858 - DNA, 813 bp, Homo sapiens
  misc_feature: GYAE6OF01CRIEF.17.25.C03.1.454.CMB.1.raw
  modified_base (730)..(730): a, c, t, g, unknown or other
  misc_feature (730)..(730): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccgaggtgcagtctggtgctagtcgtggggctggaggtagaagacgccgtggggcctcgaggtagaaggtctccgtgacaacgggtcttcgtcggtaacttaccgttaccgttttacctaccgttattaacggtacttacgtaacggttggggacgtcccggacgtacgggcccgtacggttacggaaacctaaccgggtaccttagggtaaagggttgggtaaggtcgggggtaacgtaccgggggtaaccctaaaacccctaaggttaaccgttgggttaccgtaaccgacgtttaacgttcgttacccttacccggaacccttaaccgtccgggtacccgggtaaacctacggtaaaccctttaccgaacggtaccggtaaccctaaacccggaaacccctttcccgtaaacccgtaaaataaaaccccgacccgtaaaccggtacccttaacgaacgggttaagggtacggttacggaacggggtacctaccgtaagtaccgttacgtaccgaacggtaacccggtaaccgtaccgggtacttacgttagttaccgnggtacgagtaacggccttaccgacgtacgcgtacggacgacccgtcggacgttcggtaccggttatacgtccgtcggacgggg

SEQ ID NO: 206859 - DNA, 867 bp, Homo sapiens
  misc_feature: GYAE6OF01DN2HW.17.25.C03.1.454.CMB.1.raw
  modified_base (796)..(796): a, c, t, g, unknown or other
  misc_feature (796)..(796): n is a, c, g, or t
tcagcgtagactagcacgaccggtgctcgatttagtagtgtagatttgggtttggggactcaacaaccacatctgtcctctagagaaaaccctgtgagcacagctcctcaccatggactggaccgtggaggatccttcttcgttggtggcagcagctacaagtcgcccactcccaggtgcagcgtggtgcagtcgtgggctggaggtgaagagcgtgggcctgagtgagtctctgcaggctgtgtacttcgtaccgtttacctcttagtacgtactacgtagtggtcgccgccggacggcccgtacgtacggaaccgtaaccggtaccgtagggtacggttaggtacggtacgggggtaggttaccggggaaaccctaaaaccccggttaaacggaccggtttacggggttacgtacccgtaaacgtttccggtttacgttacccccgtttacccgaaacccccgttaccggtttaacccccggggtaacccgggtaacccgtaaaccggttaaccccgttaacccggtaaccgttacccggtaaaccccgtaaccccgtaaccccgttaacccttaaccccgtaaaacgtaaaacccctaacgtaaacccgtaccctaacgtaacggttcgggtaaacggtttacgggaacggtacccgttaccggtacgtaaccgttcgtaacccggtacgaaacccgggtaacccgtacccgggtacctttacgttaaccgtttacggtacgggtcgaaccggtacggtacccgtacccggacggttcccggtacgggtaccnccgggtacccgtaacggtccggtaaccggtccggttacccgtttcggtcccgggttcgggtaacccggggg

SEQ ID NO: 206860 - DNA, 666 bp, Homo sapiens
  misc_feature: GYAE6OF01A64T7.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtgggcctcagtgaggtctcgtgcaaggtcttcgtggtacttcgtaccgtttacctcctatagttactcaacgtgggtgccgccgtaggcccgcgttacggaaccgaacgaccgtggacggtggtaagtgggagtcggggaccgtaaacccgtaacgaaccggttgggtcgtaccgtaacgtagttcgttaccgttcccacccgtacgtcccggtaccgggaccaacgtacctaccacgtacgaacccaacgtaccctacctactaaactaaccacacgtacctacaggttaggtacgtaggacgacgtccgaacgactacggtctaacgaccggtaacgaccggtcccgttattaacgtcgttgaccgtgaacgtaccgtacccgaacgtggtaccggtacggccgtaccgacgggacgtccggtcggttccgttacgtcggtccggtaccgggg

SEQ ID NO: 206861 - DNA, 650 bp, Homo sapiens
  misc_feature: GYAE6OF01AGE5R.17.25.C03.1.454.CMB.1.raw
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtgcccactcccaggtgcagctggtgcagtctgggctgaggtgaagaagccgtggggcctcgagtgaaggtctcctgcaaggtcttcgtggtattcacgtttacctcctaatagtatcaacgtgggtgcgccgaggcccgcgtaggaaccaacgaccgtggaggtgggagtggggacgtcggggaccgtaaacccctaacgaccgtagggtcgtacaacgtaggttcgttaccgttcccaacccctacgttcccgtaccggggacctaacgtaaccttaaccgatacgaacccacgtaacccttcccgtacaactaaaccacacgtactaacagttgggtagttcgaaggacgcctagactatcgtacggaccgtacgaccgggtcctacgttattacgtggcggacgagtcccgtaccgtacgtcggttacccggtaggacgtcccgtacggcgccggtccggtacctttcggccgtttcggcccggggg

SEQ ID NO: 206862 - DNA, 885 bp, Homo sapiens
  misc_feature: GYAE6OF01D9BD8.17.25.C03.1.454.CMB.1.raw
tcagcgtagactagcacgaccggtgctcgatttagtagtgtagatttgggtttgggactcaacaaccacatctgtcctctagagaaaaccctgtgagcacagctcctcaccatggactggacctggaggatccgtcttcttggtggcagcagctacgaagtcgcccactccgaggtcgcagtcgtggtcgcagttcgtgggcttggaggtagaagacgtccgtcgggcctcgaggtgaacgtctaccgtgactagtcttcgtaggtacttcgtaccgtttacctcgttaagtacgtactaccgtaacgtcgggtcaccggtaccgacgggtccgtacgtacgggtaacctaaccggtaccgtaggtacggtaggtacggtacggtaccggttacgggaaccccttaaaacccgtacgtacggttcggttaccgtaccgaacggttacggttccgttacccgttaccgaaccccgttacgttccccggtaaaccggggtactaacccgttaccgttaaaccgtcgtaaacccggtaaccccgtaaccggttaacccgttaccccgtaaaccgtaaaccgttaaaacccgtaccggtaaccgtacccgttaacgtacgggttaacgggttacggtttaacggacggttaaccgtacccggttagtaaccgttacggttaccgtaaccggtaacccgttaccggtaccgggttcccgtttaaacgttacgttaaccggtcggttaccggtacggtaaccggttaccgtaccccgtaaagggttcccggtaacgggttaccggtaccggttaccccgtaacgggttaccgtaccgggttacccggtttaacccggtttacgtacccgggttttcgggtaaccccggggg

SEQ ID NO: 206863 - DNA, 757 bp, Homo sapiens
  misc_feature: GYAE6OF01BQ2KG.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggaccaacgacctgagtggagtgggatcgggaccgaacccgtaacacgtggtgtacacaggttcgtccttaccacccctaagttcccgtacccggggaacacggtaacctttaacccaagttaccgaaccccgtaaccggtaaacccttaccaacgttacccctaaaacgttaaaaccccaaccgtaacggtaccccttaaaccgaagtttacgggtaacggtttaggaacgggtacgtacccgttagaaccgtacgttaccgtacggaacccgtaccgtaacccggggttacccgttacgtttaaccgtttaccgttacgggtacgtaccggtaccggtaacccggttaccccggtaaacggtaccgggttacccggggtacgtaacccgggtaccccgttaaccgggtacccgtacggggtaccccggtttcccgttttcggtaccccggttttacccggggg

SEQ ID NO: 206864 - DNA, 679 bp, Homo sapiens
  misc_feature: GYAE6OF01C5O4S.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctcctgcaaggtcttctggattctaccgtttacctcctatagtatcaacgtgggtcgcgccgacggccgcgtcggaaccaacggaccgtggaggtggagtgggagtcggggaccgaaaccctaacacggtggtcgtacaacgtagttcgtccttaccacccctactcccgtaccgggactacgtaccttaccatcgaccctacgtaacctccctaaccaactaaaccaccacgaccctaacgagttagggtacggtttaggaacgggacgtcccgtaggacctaagttcgtacggaacccgtacgacccgggtacccgttacttaacgtttaccgtggtacgaccggtacggtaccgtaccccgacggtaccgttcccgggtagacccggtcccgtacggccgacgggtcccggttccgttttacggccggtttccgggtaccggggg

SEQ ID NO: 206865 - DNA, 650 bp, Homo sapiens
  misc_feature: GYAE6OF01B0IE4.17.25.C03.1.454.CMB.1.raw
  modified_base (278)..(278): a, c, t, g, unknown or other
  misc_feature (278)..(278): n is a, c, g, or t
  modified_base (301)..(301): a, c, t, g, unknown or other
  misc_feature (301)..(301): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatccctccctgtctgcctcgtggtgggggtcagacgtccaccatcacgttgccggacaagtcacggtacgttaaactatttaatggtatcagcaagaaacctggaaacncccagacctctgatctcgtggtncactccactctgcgtaagtcggccgtccagtcggaggttcaggtcgacgaggtggacttcgagggactagttactttacaacttcctacacctactaccaaccctacttacctcgtaccctaaccgtcggtaaggtacttagtacgtactaacttaccgttaacttacgttacgtaacctaacgtaacgttaacgttacctaccgtttcccctacgttaccgttacggttttaccgggaaccggtaacggggtaaaccttaaagggttacggtaacgtaacgttaacgaaaccggttaacgttcgggtacggtaccgttcggacctaccgtacttccgttcggttaccc

SEQ ID NO: 206866 - DNA, 791 bp, Homo sapiens
  misc_feature: GYAE6OF01EKMS6.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtcgcagcgtggtgcagtcgtgggctggaggtgaagagccgtgggcctcgagtcgaaggtcctccgtgaccgtaaggtctttcgtggtacttaccgtaccgtttacctctagtagtatacgtaacgtgggtcgccgccgaggcccgtacgtacgggaaccaaaccggtaccgtagggtacggtagggacgttcggggtacgtaccggggaaccctaaaacccgttaacgtacggttgggtcgtaacgaccgtaggttcgttaccttaccgacccgtacgttcccggacgggaaactacggtacctacacgtaccgaacccaacgtaaccccttcctaacctaaactaaacccgaaccgtaccgaaccccttaagtaacggttacgggtaacggtttaacggaacgggtacctacccgttaaggaaccccttagttaccggaaccggtaaacccgacccggtaacccgggttaccgtttacctttaacgtcccggttaggttaccggaaccgtacggtaccccgtacctaacgggttccgttaccgggaggtaccccgtacggtacccgggacgtaccggtccggttacgtttcggtaacccgttcgggggtacccggg

SEQ ID NO: 206867 - DNA, 658 bp, Homo sapiens
  misc_feature: GYAE6OF01DDXQV.17.25.C03.1.454.CMB.1.raw
  modified_base (318)..(318): a, c, t, g, unknown or other
  misc_feature (318)..(318): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggagggtagaaagaacggccgtcgggggccctacgtaggtaggaacggttcctccgtgacgaacggtcttcgtggtatttccgtaccgttttacctccgtaatagtatcaacgtgggtcncgccgaggccgtcgtacggaacaaccgcctggacgtggagtgggagtcgggaaccaaccctaacgacgttggtcgtacacgtagttcgtccttaccaccctacgtcccgtaccgggactacgtaaccttacagtaccgaccaacgtaaccctcctacaactaaacacacgtacctacagtacggtagttagagcgcgtagactagtcgacgacgaccgtaccggtaccttagttacttacgtggtacgaccggaagtaccgtacccgacggtacgtccggtaggacgtacccggtacggcgtacggtaccggttcctttacggccgttcgggtaccgggg

SEQ ID NO: 206868 - DNA, 659 bp, Homo sapiens
  misc_feature: GYAE6OF01BTUYP.17.25.C03.1.454.CMB.1.raw
  modified_base (273)..(273): a, c, t, g, unknown or other
  misc_feature (273)..(273): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctctttcgttggtggcagcagctaacaagtcgccccacctcccgaggtgcagcgtggtgcagtcgtggggctggaggtaggaagaacgccgtcggggcctcgagtagaaggtctcctgcgaaggttttttttttttttcncgtggtattcacgtttacctcctatagtatcaactggtgcgccaggccgcgtggacaacgacctgagtggatgggagtgggcgaaaccctaacaccgtaggtcgtcacgaggtcgtctcacccactccgtacccgggacacgaccttaaccatcgaaccctacgaacctcctaccaataaacactacgaccctaacagtagggaacgttggaacggtacgcccttaggaactatcgtagaaccggaccgaacgggtccccgtacttaacgttaacgtggttacggacgaagtaccggtccccgaaacggtcgtcccgggtagaacggtaccccgtacggccaacgggtcccggttaccgttttgaacccgtttcgggtaccggggg

SEQ ID NO: 206869 - DNA, 677 bp, Homo sapiens
  misc_feature: GYAE6OF01DE57U.17.25.C03.1.454.CMB.1.raw
  modified_base (572)..(572): a, c, t, g, unknown or other
  misc_feature (572)..(572): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctgggggatcctcttcttggtggcagcagctacaagtcgcccactcccaggtgcagctggtgcagtcgtgggcgtgaggtagaagaagccgtggggcctcgaaggtgaaggtcctcctgacgaaggtcttcgtggtacttcgtaccgttttaccctaccttattagtactactaacgtgggtcgccgccgagggcccgcgtaggaaccaacgaccgtggaggtcggagtgggagtcgggaccaaaccctactacgtggtcacacgtaggtcttaccttaccaaccctgtccccgtccgggaactcgtaaccttaccagtacgaaccctaacgtaaccctccctaccctaaataaacacgtacaccgtaacaggtcggtaagttcggaaggtacgccgtacgactactaccgtagaaaccgcgtaaccggtccgttaattacgtttaacncggtagaccggaagtaccgtacccgtaaggcggttccgtagggaccgtcccgtaacggccgacgggttccgttacccgtttagacccggttggcggggtacccgg

SEQ ID NO: 206870 - DNA, 600 bp, Homo sapiens
  misc_feature: GYAE6OF01C6IHY.17.25.C03.1.454.CMB.1.raw
  modified_base (101)..(101): a, c, t, g, unknown or other
  misc_feature (101)..(101): n is a, c, g, or t
  modified_base (151)..(151): a, c, t, g, unknown or other
  misc_feature (151)..(151): n is a, c, g, or t
  modified_base (209)..(209): a, c, t, g, unknown or other
  misc_feature (209)..(209): n is a, c, g, or t
  modified_base (277)..(277): a, c, t, g, unknown or other
  misc_feature (277)..(277): n is a, c, g, or t
  modified_base (307)..(307): a, c, t, g, unknown or other
  misc_feature (307)..(307): n is a, c, g, or t
  modified_base (320)..(320): a, c, t, g, unknown or other
  misc_feature (320)..(320): n is a, c, g, or t
tcagcgtagactagcacgaccggtgctcgatttagtagtgtagatttgggtttgggagtcagtctcagtcaggacacagcatggacatgacgggtccccgntcagctccgtggggctcctgctactctggctcgagctgccagatgtgacntccagatcgaccagtctccatccctcctgtctgcctctgggtggggtcaggactcacntcagtcgacggacacgtcgaacggtacttaaactatttaagtgtatcagtacaagtaactggaaaccncccgagacctctagactacgtcgtaggtcnctactccacttcngacgagtcggcctccgtagtcgtacgtgagtggacgacggtagcgtacggcggtactagttaactttcgaacttcctaccaacactaccctaacaccgttactacgaacctaccgtaggtaggtacgttagtcgtaactacttacaccttagtacgtacaacgttaacgtacgttaacccgtacgttcccctaggacctttacgttacggacgtaagggtaacctaggttacggaataactaacgtaaacgtcgtgtcgactcgacattctcgttatccg

SEQ ID NO: 206871 - DNA, 685 bp, Homo sapiens
  misc_feature: GYAE6OF01DA9QI.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcgagtgaaggtcctcctgcaaggcttgtggattcgtacgtttacctcctatagtatcaacgtggtgcgcgaggccgcgtggaacacgacctggaggtggagtgggagtcgggaccgaacccgtaacgacgtggtcgtcgacgtaggtcgttccttccaccctcgtcccggtacccgggacacgtaccttaccgactacgacccaacgtaccctaccctaccgaaacttaaaccaacctaacgaccctaacgtacggtagggtaaggttacgggaacgggtacgtacccgttacgaactacttaccgttacggaacccggtaaccggtaaccccgggtcccgtttaccttaagtttaccgtggttacggacggtacggaccgttaccccgacggtcgtcccgggtagcccgtaccgtaacggccgtaacgggtccggttcctttacggtccgttcgggtaccgggg

SEQ ID NO: 206872 - DNA, 851 bp, Homo sapiens
  misc_feature: GYAE6OF01D9XN4.17.25.C03.1.454.CMB.1.raw
  modified_base (176)..(176): a, c, t, g, unknown or other
  misc_feature (176)..(176): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtncagtctgggtgcgagtcgtggggctggaggtagaacggacgtccggtaggggtcctcgaggtaggaacggttcctccgtggacgaacgggtcttcggtaggtacttaccgttaccgttttacctccttaagttacgtactaccgtaacggtcgggtcgccggaccgacggcccgtgtaccggggaacctaaccggtaccggtggtaaacgggtggtaaacgggtcggggtaacggtaccgggaacccgtaaacccgtaaacgtcggttcgggtacgtaaccgtacgtagttcgttaccctacccgtacccgtacgttacccggtaccgggtaaactaccggttaaccttaaccgacgttaaccgtaacccggtaaccctaaccgttacccttaaccgaaacgttaaaccacgtaccgtaccgtaacgtaaggtcgggtaacggtcggaacggtaccgtactacgtaccgtacgtaccgtacgtaacccggtaccgtaccggttacccgttactttaacggttacgtacgggtacccggtaggtaaacccggtaccgtaccccggtaacgggtacccggttaccgggtaccgggtacccggtaccccggtaacggggacccggtacccggtttccggttaacccgttttacgggcccggtttcggggtacccgggg

SEQ ID NO: 206873 - DNA, 750 bp, Homo sapiens
  misc_feature: GYAE6OF01BX9HP.17.25.C03.1.454.CMB.1.raw
  modified_base (576)..(576): a, c, t, g, unknown or other
  misc_feature (576)..(576): n is a, c, g, or t
  modified_base (650)..(650): a, c, t, g, unknown or other
  misc_feature (650)..(650): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccgaggtgcagctggtgcagtcgtgggctggaggtagaagagccgtgggcctgagtgaacggtctctgcaaggtcttcgtaggtacttcgtacgtttacctctaatagtactacgaacgttgggtacgccgacccgtagggcccgtagtacgggaacctaaaccggtccgtagggtacggtagggaggtaggggacgttacggggaacccgtaaaaccccgtaagtaccggttgggttacgaccgtaacgtaggttcgttacccgtttacccgaaccctaccggtaccccgtaccgggtaacctaacggtaacccttaccaacggttaccgaaccctaaccgtacctaccctaaccgaaactaaccacgacctacctaacgacggttaggtaaggtacgaacggtcncctagaactcgtacgacggaacctaccggacccggttacttaccgtttaatacccggttagaccgaaccggtanccccggtaacccgaacggtccggtacccgttaggacccgtaccggtaacgccgtaaccgggtccgtttaccgtttacgaccgggttccgggtacccgggg

SEQ ID NO: 206874 - DNA, 563 bp, Homo sapiens
  misc_feature: GYAE6OF01CAZ2D.17.25.C03.1.454.CMB.1.raw
  modified_base (515)..(515): a, c, t, g, unknown or other
  misc_feature (515)..(515): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctcctgcaaggcttctggattcacgtttacctcctatagtatcaactgggtgcgccaggcccgctggacaacgacctgaggtggatgggatggggaccgaaaccctaacacgtggtgtcagagtgtcttcacccatccgtcgggacagacttaccatcgaccacgaacctcctaccaataaacacacgacctaacatggagttgaggacgcctgacatctagaaccgacgacggtccttactattaccgtgtacggacgagaccgtcccacgtacgttcccggngacgcccgtacggctacggccgtccgtttgaccgttcggtaccggggg

SEQ ID NO: 206875 - DNA, 651 bp, Homo sapiens
  misc_feature: GYAE6OF01C98YX.17.25.C03.1.454.CMB.1.raw
  modified_base (228)..(228): a, c, t, g, unknown or other
  misc_feature (228)..(228): n is a, c, g, or t
  modified_base (239)..(239): a, c, t, g, unknown or other
  misc_feature (239)..(239): n is a, c, g, or t
  modified_base (271)..(271): a, c, t, g, unknown or other
  misc_feature (271)..(271): n is a, c, g, or t
  modified_base (281)..(281): a, c, t, g, unknown or other
  misc_feature (281)..(281): n is a, c, g, or t
  modified_base (331)..(331): a, c, t, g, unknown or other
  misc_feature (331)..(331): n is a, c, g, or t
  modified_base (336)..(336): a, c, t, g, unknown or other
  misc_feature (336)..(336): n is a, c, g, or t
  modified_base (392)..(392): a, c, t, g, unknown or other
  misc_feature (392)..(392): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggagatcctcttcttggtgcagcagctacaagtcgcccactcccaggtgcagctggtgcagtctggggctggaggtgaagagccgtggggcctcagtgagtcnctgcaggcttngattctacgttacctctatagtatcatgggtncgcgaggccnctggacacgacgtgagtggagtgggatgggacctaacccaacgcgtggtncacgngtctctcaccactcccgtcgggactacgacttacatcgaccacacctcctaccaanaaaccgacactacctaacgagtaggtacggttagagggtacgaccgtcgaactacgtcgtacggaccgaaccggtaccgggtccgttaccttaagttttaccgtaggtaccgtaccggtaacggtacccgttaccccggtaaccggtaacggtcccggggttaacggaaccccggtaccccggttaaaccggggcccgtaacccgggtcccgggtttaccccggtttttacggaccggttttccggggtaccccggggg

SEQ ID NO: 206876 - DNA, 718 bp, Homo sapiens
  misc_feature: GYAE6OF01CGZW9.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcgagtgaacggtcctccgtgacaaggcttcgtggtattctacgtttacctctatagtatacaacgtgggtcgcgccgacggccgcgtggaaccaacggtaccgtggaggtgggagtggggtagtcggggaaccgtaaaccccgtaacgtacgttgggtacgtcgaacgtagttcgttaccttccaaccccgtacgttcccgtacccggggactaacgtacctttaaccagttacgaaccctaaccgtaacccttccctaacctaaactaaaccgaccgtaacgtaaccctaacgtacgtcgggtaaggttcggaacggtacgcctacgacctagttccgtacgaaccgaccgtaccgggtacccgttaccttaacgtttacgtcggtacggacggtacggtaccgtacccgaacggtaccggttccgggtacggaccgtccggtaaccgggcgtaccgggtccggttccgttttacggtccggtttcgggtccggggg

SEQ ID NO: 206877 - DNA, 699 bp, Homo sapiens
  misc_feature: GYAE6OF01DO1JE.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcaggtgaaggtcctccgtgcaaggtcttgtggtattctaccgtttacctctatagtatcaacgtgggtgccgcgaggccgcgtacggacaaccgacctggaggtggagtgggagtcgggaccgtaaaccctaacgacgtggtcgtacacgagttcgtccttccaaccctacgttcccgtaccggggaacctaacggtaaccctttaccgaacgttaccgaaacccgtaaccgtaacccttaccctaacccaaacttaaaacccacctaaaccgtccctaaacgagttacgggtagttacggaacggcgtaccctagaactgtaccgtacgaacccgaccgtaccgggtccctttagttaccgtttacgtcgtacgacggtacgtacccgtacccgaacggtacccgtccgggtacgaccggaccccgtacgggcctacgggtcccgttaccgtttcggtaccgttcgggtacccgggg

SEQ ID NO: 206878 - DNA, 749 bp, Homo sapiens
  misc_feature: GYAE6OF01DDL2T.17.25.C03.1.454.CMB.1.raw
  modified_base (243)..(243): a, c, t, g, unknown or other
  misc_feature (243)..(243): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcgttggtggcagcagctacaagtcgcccactcccgaggtgcagcgtggtgcagtcgtgggctggaggtgaagacgccgtggggcctgaggtagaaggtcctccngacgtaaggtccttcgtaggtacttctaccgtttacctctaatagtatcgaacgtgggtcgccgccgaggccgtgtacgaacaacgtaccgtgaggtaggagtcgggacgtcgggaccctaaaccgtaacgcgtggttacgacacgtacggttctaccttaccacccgtacgtcccggtacgggactacgtaccgttaaccagtaccggaacccaacgtacccttaccaaccaaataaacccgtaacgaccgtaaccctaagaccggttaggtaacggttaacggaacggtaccgtaccgtagtaacgtacgtacggtaacggaaaccggtaccgaacccggggtttcccttaacgtttaaagtttcccgagggttccggaaccggtaacgttaccccggaccccgtaaacggtcggttacccgggtaagccggtttaaccgacggggttaacgcccggaacgggtacccggttttcccgttttaagggcccggtttaccgggggg

SEQ ID NO: 206879 - DNA, 775 bp, Homo sapiens
  misc_feature: GYAE6OF01BCKJV.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtagaagaaggccgtggggcctcgagtggaaggtctcctgcgaaggtcttcgtggtattctaccgtttacctccttatagtatactaacggtgggtgccgccgacggccgcgtacggaaccgaaccggaccgtggtacggtgggtaacggtggggtacgtacggggacccgtaaaacccgtaacgtacggttcgggtacgtacgacgtacgttcgttaccttaccgtacccgtacgtccccggtaccgggactaaccggtacctttacccgaacgtaccgaacccgtaaccgtaacccttacccgtaaccaaacgttaaaaccaacgtaaccgtacccgtaacgtacgttacgggttaacgttacggaacgggtaccgtacttacgggtaacaacgttcgtaacggaaaccgttccggaacccggggttaccctttaacgtttaacgttaccgtaggtaccggaaccgtacggtacccgtacccggacgtaccggtccgggtacgacccggtacccggtacgaccggtacggtacccggtttcgtttaccggtcggttccgggtaaccggggg

SEQ ID NO: 206880 - DNA, 750 bp, Homo sapiens
  misc_feature: GYAE6OF01ET877.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagagccgtggggcctgagtggaaggtcctcctgcgaaggtcttgtggtacttctacgtttacctcctatagtatacaacgtgggtcgccgccgacgggtccgcgtacggaaccaaccggaccgtggaaggtggaggtaggggagtacggggaccctaaacccgtacgacgttggtcgtacacgtagtcgttcctaccaccctacgtcccgaccgggtactacgtaaccttaccacgtaccgaaccctaaccgtaacccttcccctaaccgtaactaaaacccaccgaaccgtaccctaagacggttagggtaacggttacggaacggtaccgtaccgtacgaacctacgttcgtacggtaaccggaacccggtaccgggtacccgtttacttaacgtttaccgtacggtccggaccggtacggtacccggtaccccgtaagggtacccgttaccggggtacggtcccgggtaacccggtacccgggaccgtaccggggtcccggtttaccgtttaccgggttaccggttcggggtaacccgggggg

SEQ ID NO: 206881 - DNA, 804 bp, Homo sapiens
  misc_feature: GYAE6OF01CADCX.17.25.C03.1.454.CMB.1.raw
tcagcgtagactagcacgaccggtgctcgatttagtagtgtagatttgggtttgggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagccgtggggcctcgaggtgaaggtcctcctgcaaggtcttacgtggtactttaccgtaccgttttaccctaccgttaattaacggtaacttccgaaaccgttggggtcgcccgaccgacggggaccccgtcggtacggaaccaaaccggtacccgtaggtaaggtacgggtaacgttgggggaacgttacgggggaccctaaaaccccgttaaacgaaccggttgggttacgttaccgaacgtaacggttcgtacccgtttaccgaaccccctacgtacccgttacccggggaactaacgaaccgtttaccaacgtaccgaacccgaaccgaaccctacccgtaaccaaacttaaacgaactaccgtacctaacgagtacggtagttagggacgtacgtccgtacgactactacggtacgaaccggaccgtacccgggtccgttaacttacgtttaccgtgtacgggtaaccgtacggtaccggtacccccgtaacggtcgttacccggggttacggaacccgtacccggtaccggggtaccttacggggtaccccggttaccgttttaacgggtccgtttccgggttaacccggggg

SEQ ID NO: 206882 - DNA, 665 bp, Homo sapiens
  misc_feature: GYAE6OF01AL9UA.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggagggtagaagaagccgtggggcctcgagtgaaggtctcctgcaaggtcttcgtggtacttctacgtttacctcctatagtatctaacgtgggtcgccgccgaggcctcgtacggaaccaacgaccgtggacggtgggagtggggagtcgggaccgtaaaccctaacgacgtggtacgtacacgtagttcgtccttaccaccctacgtacccgtccggggaacctaacggtaccttaccgagtacgaacccacgtaacctccctaccaactaacactacacctactagtaggtagttacggacggacgcctacgacactcgtacgaccgacgaccggtccgttacttacgttacgtcggtcgacggtacgtaccgtcccgaacggtaccggtcccggtaggcccgtaccggtaaccggcggtaccggtacccggttccgtttacggtcggttccgggtaccggggg

SEQ ID NO: 206883 - DNA, 940 bp, Homo sapiens
  misc_feature: GYAE6OF01DJERA.17.25.C03.1.454.CMB.1.raw
tcagcgtagactagcacgaccggtgctcgatttagtagtgtagatttgggtttgggagtcagtctcagtcaggacacagcatggacatggagggtcccccgctcagctccgtggggctcctgctactcgtggctccgagctgcagatgtagacatccagatcgacctagtctccactccctcctgtcctcgtcctcgtgggttggggactagacgtccaactacgtcctacgttggaccggaacgaagtaccgtaaccgggttaaacctttaaaaaacctttagttttaaaacgttcggttaacgactaacggtaacgaaaacggtaaaacccggttaacgggaaaaaccccgtacccccgaaacggtaccccctaccgttacggtaaccgtttccgttaccgttggggttacctaaccttaaccccttaccccggtaacgtttccgggtaaccggggaaccggggtttaaccgggtccgggtacccccggttaaccccgttaagggtttaccggggttaacggtttaccggaggggtacgggacggttacggggtaggttacggtacgggtacggggacttaacggttactttacgaacttcccaactacccgtaacacccgtacctaccgttacgaaccgtaacccgtaaccgttaagggtacgttacgttaccgtaagtaaccctaaactttaccgttaaccttaccgggttaataaccgttaaaaccggttagttaacccgttttaccccgtaccccggtttaccccgtaccggtttagttttaacccgggttacccgggaaacccggggtaaccgggttaaacttaacgggtaaggaaaccgtaaacctaaccgggtaaaccggttagggtacccggtttaggaacccttaaccctaacccggtcgttaaacctttcccgggttaaactttcccg

SEQ ID NO: 206884 - DNA, 685 bp, Homo sapiens
  misc_feature: GYAE6OF01DMR6G.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcagtgaaggtctcctgcaaggcttctggattcacgtttacctctatagtatccaagtgggtgcgccgaggccgcgtaggacaacgtctggagtggagtgggatcgggacgaaccctaacgacgtcggtcgtacacgtaggttccgttccttaccgaacccctaactccccgtaccggggacctacggtaacctttaaccaagttccgaaccctaaccggaacccttccccgtaacctaaactaaaaccacgtaaccgtacctaaacacgttagggtagttaggacggacgtacccgtagactacgttcgaacgaaccgaaccggtccggtaccgttagttaacttacggttcgtcggaccggtaaggtacccgtacccggaacggtacggttacccggtagtacccggacccgttacggacgtaccggtcccggttcctttacggtaccgtttcggtaacccggggg

SEQ ID NO: 206885 - DNA, 640 bp, Homo sapiens
  misc_feature: GYAE6OF01C6T8I.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcgagtgaaggtctcctgcaggcttctggattcacgtttacctcctatagtatcaacgtgggtacgcgccgacggcccgcgtacggacaaccgacctggagtggagtgggagtcgggacaaccctaacacgtggtctcacgtgtcgtcttaccaccctatcccgtaccgggacacgtacctaccagtcgaaccacgtaacctccctaccgaactaaaccacacgtaccctaagacgtcggtaggttacggaagacgtcccgtagaactagttccgtaaggacccgaccgtaccgggtacccgtttacgttaacgtttaccgtgtacggccgaacggtacccgtacccgacggtcgtccggtacggaccgtccgtaccggccgtacgggccgttaccgtttcggtccgttcgggtacccggggg

SEQ ID NO: 206886 - DNA, 609 bp, Homo sapiens
  misc_feature: GYAE6OF01AVHVO.17.25.C03.1.454.CMB.1.raw
  modified_base (290)..(290): a, c, t, g, unknown or other
  misc_feature (290)..(290): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaaggtcttctggattcacgtttacctctatagtatcaactgggtgcgccaggccgntggacaacgcctgagtggatgggatcgggaccaaaccctaacgacgtggtgtacaacgtagtcgtcttaccaccctatcccgtacgggacacgtaccttaccatcgaaccacgaacctcctaccaactaaaccacacgaccctaacagtagggtagttaggacggtacgacccgtagaccagtacgagaaccgaccgaccggtcccgttacttaattaccgtgtacggcgtacgtaccgtaccccgacggtacgtccgggtacgacgtacccgtaccggcgacgggtccggttaccctttggtccgttcgggtccgggg

SEQ ID NO: 206887 - DNA, 714 bp, Homo sapiens
  misc_feature: GYAE6OF01CDJT4.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatcgacccagtctaccatccctccctgtctcgcctcgtggtggggtcagtagtccacatcacttcgaccggacaagtacgacggtaacgttaaaaccttaattaaagttcggtatacgagtacaaagtaaaccgtaaggaaaccgcccaagtaccctaccgagcttcgtacgtggtcactactacctactcgtgaaccggtaaggtcgggtacctcccgtacgtcggtaacggtttcgaaggttcgggactaggtggtaatccgtagggaaccagttactttactaactccgtacctaactactacctaaacccgcgttactacggaccctaaaccgtaggtacggtaattggtaactctaaacctccttaacgttactacgtaacaactaaggtaactttaccgtaacccgtcccctacgttaccttttaccgggttgaacccgggaacgggttaaaccaaaggtttacgaaacgggaacttaaaccggaaaaacccttggttacggtccgtaacgtacgtaacccctaacggttaacttcgttcgtttaaacccg

SEQ ID NO: 206888 - DNA, 727 bp, Homo sapiens
  misc_feature: GYAE6OF01CCWF6.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagccgtgggcctcagtgaacggtctcctgcaaggtcttcgtggattctaccgtttacctcctatagtatacaacgtgggtcgccgccgagggcccgtcgtacggaaccaaccggaccgtaggtaggtgggagtggggacgtcggggaacctaaacccgtaacgtaccgttgggtcgtaccgacgtaggttcgtaccttaccaaccccgtacttccccggaccggggtaacaccgtaacctttaacccagtaccgaaccgtaacccgtaacttcccctaaccaaacgtaaaacccacgtaacgaccctaacagtagggtagttaggacggtactccgtaggactacgtcgacgtaaccggtccgaaccggttccgttaacttaacgttacgtggtcgtacggtacggtaccgtccccggaacggtaccggttaccgggtaggacccgttacccgggaaccggaccggtaccgggttacccgggttacccgttttacggccccggtttcgggtacccgggggg

SEQ ID NO: 206889 - DNA, 917 bp, Homo sapiens
  misc_feature: GYAE6OF01B0ZY4.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccacctcccaggtgcagctggtgcagtcgtggggctggaggtagaagaaggccgtcgggggcctcgaggtggtaacggtcctccgtgacgaaggtcttcgtggtacttccgttaccgtttaccttacctaattaacgtactaccgtaacgtggggtacgccggacccgtacgggcccgtaccgttacgggaaaccctaaaccggtacccgttaggacgggttacggggtaaggtttagggggaacggttaccgggggaaacccgtaaaacccccggttaaaaccgtacgggtttaccgggttacggttaccaaaccggttacggtttacgtttaccccgtttacccgtaaccccgttacccggttaccccggtaaccccggggtaaaccgtaaaccgtttaacccgtttaaaccccgtacggttaacccgaaccccgtaaacccgtaaaccccctttaaccccgtaaccctaaaaccgtaaaacccaacccgtaacccgtacccttaaaacgttcgggttaacgggtaacggtttaacggaacggggtaaacctccccgttaagaaccgtaccgttacgtaaccgggaacccgaacccggtaccggttacccgtttacgttacgtttaaccggttggaaccggtacggtaccgacccggttaaacccgcggtaaccggtccgggtaacgtaccggacccggttaacggcgtaccggtaccggtttcgtttccgacccggtttgggacccggggg

SEQ ID NO: 206890 - DNA, 580 bp, Homo sapiens
  misc_feature: GYAE6OF01CNNMV.17.25.C03.1.454.CMB.1.raw
  modified_base (343)..(343): a, c, t, g, unknown or other
  misc_feature (343)..(343): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgcgtggacaacgacctgagtggatgggatgggcgaacctaacgactggtgtcanagtgtcttcacccatcccgtccgggacagacttaccatcgaccacgaacctcctaccaataaaccacacgacctaacatggagtttaggaggagccgtagactacgtctacgacggaccgtaccgggccgttctaattacgtgtcgacgtagaccgttcccgacgtacgtccgggtagacggcccgttacggaccgtacgggaccggttccttttcgaccgtttcggtacccggggg

SEQ ID NO: 206891 - DNA, 566 bp, Homo sapiens
  misc_feature: GYAE6OF01EM1ZW.17.25.C03.1.454.CMB.1.raw
  modified_base (156)..(156): a, c, t, g, unknown or other
  misc_feature (156)..(156): n is a, c, g, or t
  modified_base (291)..(291): a, c, t, g, unknown or other
  misc_feature (291)..(291): n is a, c, g, or t
  modified_base (424)..(424): a, c, t, g, unknown or other
  misc_feature (424)..(424): n is a, c, g, or t
  modified_base (453)..(453): a, c, t, g, unknown or other
  misc_feature (453)..(453): n is a, c, g, or t
  modified_base (459)..(459): a, c, t, g, unknown or other
  misc_feature (459)..(459): n is a, c, g, or t
  modified_base (553)..(553): a, c, t, g, unknown or other
  misc_feature (553)..(553): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctanaagtgcccactcccaggtgcagctggtgcagtctggggctgaggtgaagagcctggggcctcagtgaaggtctcctgcaaggcttactggattcacgtttacctcctatacgtatcaactgggtgcgcaggccgntggacaacgacctgagtggagtgggatgggacaaacccgtaacacgttgggtcgttacacgtaggtgtccttcacccctatcccgtaccggggacagaccttacatcgaaccacgaacctcctccaataaacncaacgcctaacagtaggtagttgaggtanccgtanacatctagacgacgacggtccgtactacttactgtcgcgagtacgtaccccagaccgttcggtacggcgcccgtacggctacggcgtccgtttnaccgttgtcgggg

SEQ ID NO: 206892 - DNA, 603 bp, Homo sapiens
  misc_feature: GYAE6OF01BQFKD.17.25.C03.1.454.CMB.1.raw
  modified_base (467)..(467): a, c, t, g, unknown or other
  misc_feature (467)..(467): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcagtgaaggtctcctgcaaggcttctggtattcacgtttacctcctatagtatcaacgtgggtgcgccaggccgctggacaacgacctgagtggagtgggatgggaccgaaaccctacgacgtggtgtacacgacgttgtaccgttccaccctagtcccgtccggggaacagtaacctttaccagttacgaccctacgtaacctccgtaccaataaaccacacgtacctacagtggaggttagaggacnccgtagactattcgtagacgaccgaccggtccgttactagttaccgtgtacgacgtgaccgtcccgaacgtcgtcggtacgtcggacccgtacgggcgaacggtccggtacctttcggtaccgttcggtaccgggg

SEQ ID NO: 206893 - DNA, 659 bp, Homo sapiens
  misc_feature: GYAE6OF01A7PWC.17.25.C03.1.454.CMB.1.raw
  modified_base (288)..(288): a, c, t, g, unknown or other
  misc_feature (288)..(288): n is a, c, g, or t
  modified_base (300)..(300): a, c, t, g, unknown or other
  misc_feature (300)..(300): n is a, c, g, or t
  modified_base (343)..(343): a, c, t, g, unknown or other
  misc_feature (343)..(343): n is a, c, g, or t
tcagcgtagactagcacgaccggtgctcgatttagtagtgtagatttgggtttggggactcaacaaccacatctgtcctctagataaaaccctgtgagcacagctcctcaccatggactggacctggaggatcctcttcttggtggcagcagctacaagtgcccactcccaggtgcagctggtgcagtctgggctgaggtgaagaagccgtggggcctcagtgaaggtctccgtgcaaggccttcgtggtacttctacgttttacctcctatagtatcaacgtgggtnccgcacggccgntggacacgcctgagtggagtgggagtcgggaccaaaccctaancgtggtgtccacgtagtcgtccttaccacccctacgtcccgtcccggggaactacgtaccttaaccagtaccgaacccaaccgtaaccctccctacctaactaaaccaccgacgaccctaacacgtaggtagttacggaaggtacgccgtaggactacgttcgacggaaccgacccgaccgggtcccgttacttaacgttacgtacggtcgaccggtagaccgtaccccgacggtaccggttcccgggagtaccggtacccgtaccgggaccgtcggtacccggtccgttttaccggccgttcgggtacccggggg

SEQ ID NO: 206894 - DNA, 608 bp, Homo sapiens
  misc_feature: GYAE6OF01ATNLI.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggtattctacgtttacctcctatagtatcaacgtgggtgcgcaggccgcgtggacacgacctggagtggagtgggagtcgggaccgaaccctaagacgtggtgtacgacgagtcgtcttccaccctactccgtccggacacgacttaccatcgaccacgtaactccctacaactaaaccacacgacctactagtagggtagttggacggacgtcctagacattcgagaaccgaccgaccgggtccgttcttaagttcgtgtcggacgacggtaccgtaccccgacggtacgtcccgggttaggaccgacccggttaccggccgtacggccgggttcctttcggtaccgtttccgggtaccgggg

SEQ ID NO: 206895 - DNA, 683 bp, Homo sapiens
  misc_feature: GYAE6OF01DMXFJ.17.25.C03.1.454.CMB.1.raw
  modified_base (235)..(235): a, c, t, g, unknown or other
  misc_feature (235)..(235): n is a, c, g, or t
  modified_base (246)..(246): a, c, t, g, unknown or other
  misc_feature (246)..(246): n is a, c, g, or t
  modified_base (261)..(261): a, c, t, g, unknown or other
  misc_feature (261)..(261): n is a, c, g, or t
tcagcgtagactagcacgaccggtgctcgatttagtagtgtagatttgggtttggggactcaacaaccacatctgtcctctagagaaaaccctgtgagcacagcctcctcaccatggactggacctggaggatcctctttcttggtggcagcagctacaagtcgcccactcccaggtgcagcgtggtgctaggtcgtgggctggaggtagaagagccgtgggcctgagtgagtcnctgcagcttgngattctacgtttccnctatagtatcagtggtgccgaccgacggccgacgtacggaaccacgacctggagtggagtgggagcggaccaaccctagacgtggcgtacagtagtcgtacctaccgaccctacgtccgtaccggaactacgtaaccttaacgaaacgtacgaacccgaaccgtaacccttacccaaccaaacgttaaacccaactaacgtaaccctagtaacggtagggtacggttaggacggtactcccgagtaacacgttccgtaacgaaccggtaaccgtacccggtccttaccgtaacgtttacgtacgggtacggtaacgaccggtaccgtacccggacgtaccggtcgggtacgtacccggaccgttaacgggccgtaaccggttccccggttacggttttccgtccggttcgggtacccggggg

SEQ ID NO: 206896 - DNA, 964 bp, Homo sapiens
  misc_feature: GYAE6OF01C0YUN.17.25.C03.1.454.CMB.1.raw
tcagcgtagactagcacgaccggtgctcgatttagtagtgtagatttgggtttgggactcaacaaccacatctgtcctctagaagaaaaccctgtgagcacagctcctcaccagtggactggacctggaggactccttcttcgttggtggcagcagctacaagtcgcccactcccgaggtgcagcgtggtgcgacgtcgtgggctggaggtagaagacgccgtggggcctagagtagaacggtcctccgtgacgtacggtctttacgtaggtactttccgtaaccgttttacccttacctagttaacgtataccgtaacggttgggtacgccggaccgacggtcccgacgtacgaaccgaacgtaccgtggaaggtggtaacggtagggacgtccgggaaccgtaaaccccgtaacgtacgttcgggtcgtaaccgtacgtacggttacgttacccttcccgtaacccctaccgttaccggtacccggggtaaactaaccggttaaacccttacccgaattacccggaaacccgtaacccgtaaacccttacccttaacccaaaaacctttaaaacccgaaccgtaacccgtaacccgttaacgtaaacgggttacggggttaaaccgggtttacggaaaccgggtaccgtaccccggtttaaacggaaccgtaaccggtttaacccgtaacgggaaaccccggtaaccccgggttaaccccggggttaccccctttaagtttaaccgggttttaccggtaccgggtttaacggacccggtaaacgggttaaacccccggtaccccgtaaaccgggtaacccggggttttacccgggaacggaaacccccggggtttaccccggttaaccgggtaaccccgggtaacccggggtttaccccggggttttaccccgttttaaacggggtttccccgggttaacccggggggttaaccccgggggg

SEQ ID NO: 206897 - DNA, 745 bp, Homo sapiens
  misc_feature: GYAE6OF01CXPYO.17.25.C03.1.454.CMB.1.raw
  modified_base (288)..(288): a, c, t, g, unknown or other
  misc_feature (288)..(288): n is a, c, g, or t
  modified_base (355)..(355): a, c, t, g, unknown or other
  misc_feature (355)..(355): n is a, c, g, or t
  modified_base (634)..(634): a, c, t, g, unknown or other
  misc_feature (634)..(634): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctggaggtgaagaagccgtggggcctcgagtgaaggtctcctgcaaggtcttcgtggattcacgtttacctctatagtatctaacgtgggtcncgccgaggccgacgtcgaacaacgtacctggaggttggagtgggatacgggaccgtaaacccgtaanacgttgggtgtacctaacgagttcgtccttaccaaccctacgttacccgtacccggggaactaaccggtaacctttaaaccgaacgttaccgggaaccctaaccggtaaacccttcccgtaacccaaagttaaaacccaccgtaaacggaacccttaaacgacggttacggtaacgggtttacggaaacgggtaacgtacctaacgggtaactaacgttaccggtaacggtaaacccggaccgaaccccggggttcctttaaccgttatttaacccggnggtacgtacgggaaccgtaccggttacccgaaacgggttccgacccgggttaggtaccggtcctaacggggctacgggtcccgtaccgtttcgaccgtttcgggaccgggg

SEQ ID NO: 206898 - DNA, 684 bp, Homo sapiens
  misc_feature: GYAE6OF01D50FJ.17.25.C03.1.454.CMB.1.raw
  modified_base (304)..(304): a, c, t, g, unknown or other
  misc_feature (304)..(304): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaaggccgtggggcctcgagtgaaggtctccgtgcgaaggcttctggtacttctacgtttacctcctaatagtatcgaacgtgggtcgcgccaggccgngtcggacaaccgaccgtgaggtggagtgggagtcgggaccgaaacccgttaacgacgttaggtcgtacacgtacggttcgtccttacccaacccgtacgtcccgtaccgggaacacgtacgttaacccagtaccgaccctaacgtaccctacctacctaataaaccactacgacctacgtagtacgggtagttaggaacggtacgtacctagacgtagtccgtacgaaccgacgtaccgggtaccttacgttaacttcgtcgttcggacgtaacgtacccgttccgtaacccgacggttacccgggtggtaaccggtacccgtacgggaccgtaacgggtcccggttaccgttttggaacccgttcggggtacccggggg

SEQ ID NO: 206899 - DNA, 828 bp, Homo sapiens
  misc_feature: GYAE6OF01EMT8T.17.25.C03.1.454.CMB.1.raw
  modified_base (243)..(243): a, c, t, g, unknown or other
  misc_feature (243)..(243): n is a, c, g, or t
  modified_base (260)..(260): a, c, t, g, unknown or other
  misc_feature (260)..(260): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttcnggattcgacgtttaccnctatagtatcaacgtgggtgcgccaggcccgcgtggaaccaacggtacctggaggtcggagttggggaattggggaacctaaacccgttaacgacgttgggtcgtaccacgtaggttcgtcctttaccaaccccgtagttccccggtaccggggaacacgtaaccctttaaccgattaccggaaccctaaccgtaacccttccccgtacctaaacgttaaaacccaccgtaacgtaccccttaaacgtaacgttacgggggtaaacgttttacgggaaacgggtaccgtacccgtttacgggtaaaccctacgtttacccggtacggaaccggtaaaccccggtacccggggttcccggtttaacctttacggttttaaaccccgtggggttaacccgaccgggtaaacggtaacccccggttaccccggaaaccgggttaaccggtttccccggggtaggtaaccccgggtaccccggttaaacccggggacccggtaacggggttccccggggttaccccttttttacggggacccccgttttacggggtaacccccggggggggg

SEQ ID NO: 206900 - DNA, 587 bp, Homo sapiens
  misc_feature: GYAE6OF01E3J83.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgccccactcccaggtgcagctggtgcagtctggggctgaggtgaagaagcctggggcctcagtgaaggtctcctgcaggcttctggattcacgttttacctcctatagtatcaacgtgggtgccgccaggccgctggacaacgacctgagtggatgggatgggacaacccactacgtggtgtcacagtgtctacaccctatcctccgggacagacttaccatcgaccacgacctcctaccaataaaccacacgcctaacagtggacgttggacggtacgcctagactatctaggaaccaccgaccggtccgttacttattacgtggtcgacggagaccggtacccaacggtacgtccgggtagaccgggacccgtaccgggctacgggcccggttaccgtttacggtaccgttcgggtaccgggggg

SEQ ID NO: 206901 - DNA, 735 bp, Homo sapiens
  misc_feature: GYAE6OF01A4WBU.17.25.C03.1.454.CMB.1.raw
  modified_base (191)..(191): a, c, t, g, unknown or other
  misc_feature (191)..(191): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccactcctccctgtctcgcctntggtggggtcagagtccaccatcacgttgaccggacaagtccgacggtacgtttaaaaccttatttaaagttggtactacgagacaacggtaaaacccgtaggaaaacgcccccaagaccccttccgtagacttcgtcgtggtcgactactccactcgtacgacggtaacgtcggacctacccgagttcggtacggttcgaggtcggacgtaggtaggtacgttcggtagggtaactagttacttttacgaaactttccctaccgtaaccctacgttacccaacccgttaccgttaccgtacgaaccctaaaccggttaggtaacggttatttcgggtactaacgtaaactttaccgttaaccgttacgttacgtaaacctaacggtaacggttaacctttaaccccggtaccgtttccccgtacggttactttaccggtttaccgggaccggtaaacggggtaaccttaaaggtcggaactaacgtaaccgaaacgttcgtacggtcggacgtaccgaccgtaactcgtttccgtcgttaccc

SEQ ID NO: 206902 - DNA, 604 bp, Homo sapiens
  misc_feature: GYAE6OF01DL8QG.17.25.C03.1.454.CMB.1.raw
  modified_base (284)..(284): a, c, t, g, unknown or other
  misc_feature (284)..(284): n is a, c, g, or t
  modified_base (342)..(342): a, c, t, g, unknown or other
  misc_feature (342)..(342): n is a, c, g, or t
  modified_base (361)..(361): a, c, t, g, unknown or other
  misc_feature (361)..(361): n is a, c, g, or t
  modified_base (442)..(442): a, c, t, g, unknown or other
  misc_feature (442)..(442): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaaggtctccgtgcaaggcttcgtggattcacgtttacctcctatagtatcaactgggtncgccaggccgctggacacgacctgagtggatgggatcgggacaaccctagacgtggtntcacagtgtccttcacccntcccgtacggacagacttaccatcgaccacgtaacctcctaccaataaaccacacgacctacagtcggagttcgaggtacncctggaactatcgtaggaaccgaccgaccggtaccgttcttagtttacgtggtcgacggacgtaccgtcccgaacggtaccgttaccgggtaggacggtaccccgtacgggaccgaacgggtcccggttaccgttttcggacgtttccgggtacccgggggg

SEQ ID NO: 206903 - DNA, 619 bp, Homo sapiens
  misc_feature: GYAE6OF01C35TX.17.25.C03.1.454.CMB.1.raw
  modified_base (188)..(188): a, c, t, g, unknown or other
  misc_feature (188)..(188): n is a, c, g, or t
  modified_base (298)..(298): a, c, t, g, unknown or other
  misc_feature (298)..(298): n is a, c, g, or t
  modified_base (302)..(302): a, c, t, g, unknown or other
  misc_feature (302)..(302): n is a, c, g, or t
  modified_base (316)..(316): a, c, t, g, unknown or other
  misc_feature (316)..(316): n is a, c, g, or t
  modified_base (320)..(320): a, c, t, g, unknown or other
  misc_feature (320)..(320): n is a, c, g, or t
  modified_base (322)..(322): a, c, t, g, unknown or other
  misc_feature (322)..(322): n is a, c, g, or t
  modified_base (325)..(325): a, c, t, g, unknown or other
  misc_feature (325)..(325): n is a, c, g, or t
  modified_base (348)..(348): a, c, t, g, unknown or other
  misc_feature (348)..(348): n is a, c, g, or t
  modified_base (392)..(392): a, c, t, g, unknown or other
  misc_feature (392)..(392): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtgcagcagctaacgaagtcgccccactcccaggtgcagcgtggtncgagtcgtggggctggaggtagaacgagccgtggggcctgagtggacgtctcgtgacaggtctcgtgtattcctacgtttacctactatagtctacagttggcgcacggnggcncgtagacacgctgngtgngnggngtcggaccaccgagtcgtgtacncgatggtactctaccacctcgtcccgtcgactacgacctactanccgaccaaccgtcctaccgtaacaactaaacactacgacctaataggtacgtgttacgggacgtctacctaagctactacggtcgaaccgtaccgtccggtacctttatacgttacgtgacgcggtaaccgccgttaccacggtaccgtaccggtacggtaaaccgtccccgggtagaccgtcgggttaccgtttaccgttcgggtacccgttcggggaaccccggg

SEQ ID NO: 206904 - DNA, 815 bp, Homo sapiens
  misc_feature: GYAE6OF01BFK1Q.17.25.C03.1.454.CMB.1.raw
  modified_base (186)..(186): a, c, t, g, unknown or other
  misc_feature (186)..(186): n is a, c, g, or t
  modified_base (293)..(293): a, c, t, g, unknown or other
  misc_feature (293)..(293): n is a, c, g, or t
  modified_base (591)..(591): a, c, t, g, unknown or other
  misc_feature (591)..(591): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctgggtnctagtcgtggggctggaggtagaagagccgtggggcctcgagtgaaggtctccgtgcaggtcttgtggattcgtacgtttacctcctatagtatctaacgtgggtcnccgccgacggccgacgtcgggaaccaaccggacctaggaggtacggtggtagggggtacgtcgggggacccgaaaacccccgtaagtaccggttacgggtcggtaaccgtaacgtacggttcgttcccttaccgaccccgttaaccgtccccggtaccgggaaacctaacggttaacccttaacccgaagtaccgaccccgaacctaacccgtacccctaaccgaaacttaaaaccacccgaacctcccgtaaactacggtacgggttaaggttacggaacgggtacgtcccggtaanaccggtactcggtaaccggtaaccggaaacccgtacccggggtaccctttacgttaacccgtttacggtccgtaacggaccggttaacgggtccctaaccccggaacggttacccgggttacccggacgggtaacccgttacccgggtaacccgggtaccgaccggggtttccccggtaaccgggttttaccgtaacccgggtttcccgggaaacccggggggg

SEQ ID NO: 206905 - DNA, 692 bp, Homo sapiens
  misc_feature: GYAE6OF01BMRQF.17.25.C03.1.454.CMB.1.raw
  modified_base (350)..(350): a, c, t, g, unknown or other
  misc_feature (350)..(350): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagagccgtggggcctgagtgaaggtctcctgacaggtcttgtggattctacgtttacctactatagtatcaagtgggtgcgccgaggccgcgtaggaccaacggaccgtggaggtggagtgggagtcgggaaccgtaacccgtaanacgtggtcgtcacgtagttcgtaccttaccacccgtacgttcccgtaccgggactaacgtaccttaaccagtaccgaaccctaaccgtaacctccctaaccgaaactaaaccacaccgtaccctaagacggttacggtaacggttacggaacggtacgtaccgtagtaacctagtcccggttaacgaacccggtaaccgtacccgggtaccttacgtttaacttaccggtggtaccgtacggtaaccggtcccgtaacccgtaccggtcggttacccgggcgaaccggtccgtacgggaccgtaccggtccggttacttcgggtccgtcgggtaaccggggg

SEQ ID NO: 206906 - DNA, 1168 bp, Homo sapiens
  misc_feature: GYAE6OF01DXGZJ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttgggtgggcgagcgacgtactaacgtaaggtccgacccctaccctacccggtagggtcgaccgacgtccggttgggtcgaccgtacggttcgggtcgggggtcgttagggtaaggggtaaggaaaacggtaaccgggtccggggttaccgggggtcccttacggtaagggttaacgggttaaccggttccccgttaccggtacgggaaccggtaacgggtttcccgttttacgggttacggttaccttttacccggttttaaaccccgtttttaacccgttaacccgtttaaagttttaacggttaacgttaacccggttaaacggggtttcgggggtaccgccccggtaaccgggtaccccggggtacccgtaccgggttaaccgggaaaaccccggtaaacccggttaccggtaagggggtagggttacgggtaacggggtacgggggtaacggggtacccggggtaaaacccccgtaaaaaccccgttaacgggtaccgggtttacgggtaccgtaaccgtaaccgggttacgggttttaccccgttacccccttaaccccgtaaacccccgtacccggtttacccccggggtaacccgggtaaaccgtaaacccccgtttaaacccgttaaacccgttaaccggtaacccccggtaaaccccggtaaccccggttaacccccttaaccccgtaaaaccctaaaaaccggtaaaccccaaacccggtacccgtaaaccccgttaggttaaccggtaggggttaacgttaaccgggaacggtacccgttacgaagtaaccgtctacggaccggtaacgtaccggtaccccgggttactttacgttaccggtttagtaccgggtaacgtaccggtaaccggttaccccggtaacccgtaaacggggttccccggtaccgggaccgggttaccccgtaccccggggtaccgggtaccccgtaacggggttcccccggtttttaaccggttacccgggttacccgggtttcggggtaacccccggggg

SEQ ID NO: 206907 - DNA, 618 bp, Homo sapiens
  misc_feature: GYAE6OF01DEPSN.17.25.C03.1.454.CMB.1.raw
  modified_base (242)..(242): a, c, t, g, unknown or other
  misc_feature (242)..(242): n is a, c, g, or t
  modified_base (300)..(300): a, c, t, g, unknown or other
  misc_feature (300)..(300): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctggtggggtcagagtcaccatcacttgccggacaagtcacggacgttaaaacctnttaaattgtatcagcaagaaacctaggaaaacgcccagacctcctgattctctggtcncactccgactctggacgtaagtcggccgtacccagtcgtaaggtttccaaggtcggacaggtggattcggtgggaacagtactttcaacttcctacacctactaccaaccctaccttctacggacctaaccgtggtaacggtacttgtacgtactaactccttaacttacctacgtaccgaactaagtaacgttacctaccggttcccctcgtaccttacgttttcggaccgtaacggggaacctaaaggttcgaagtaactaacgaaacgtaacgttcggtacggtcgtacggacctacctacttccgttcgttacc

SEQ ID NO: 206908 - DNA, 907 bp, Homo sapiens
  misc_feature: GYAE6OF01CQJXK.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtgcagcagctacaagtcgcccacctcccaggtgcagctggtgcaggtcgtggggctggagggtagaaggaagccgtcggggcctcgaggtgaacggtcctccgtgacgaaggtcttcgtacggtatttaccgtaaccggttttacctccttaagtaagttactaccgtaacggttggggtcgccgtaccgacgggcccggtacgtacggaaccaaccggtaaccgtgggaggtcgggtacggtgggtaacggtacggggtaacccgtaaacccctaaacgtaccggttgggtacgtaccgtaaacgtacggtttcgttacccgtttacccgaaccccgtacgttaccccggtaacccggggaaacctaaacggttaacccgtttaacccgaacgtaaccggaaccccgtaaacccggttaaccctaccctaacccgtaaaactaaacccgaaccgtaccgtaacccgtaaacgtacggttacgggtaacggtttacggaacgggtaccggtaccgtaacgaaccgtacgtttaccggtaacgaaccggtaaccccggtaaccgggtcccgtttaacttaacgttttccgggtaggttaccggaccggtaaaccggtaccccggttaaccccggaaccgggttaaccggtccccgggggttaagttaaccccgggacccccgggtttaaacccgggccggtaacccgggttcccggttccccggtttttaacgggtaccccggttttcccgggggacccgggggg

SEQ ID NO: 206909 - DNA, 709 bp, Homo sapiens
  misc_feature: GYAE6OF01AZ5AE.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctcctgcaaggtcttcgtggtattctacgtttacctcctatagtatcaacgtgggtcgcgccgaggccgcgtcggacaaccgacctggagtgggagtgggagtcggggaccgaaccctaacgcgtggtcgtacgacgtagttcgtccttaccgaccctacgtcccgtccgggaacctacgtaccttaccgataccgaacccgaaccgtaacccttccctaccaaactaaacccaacgaaccgtaccctaacgtagttacgggtaggtttaggacgggtaccgtaccgtcggaacctacgtccgtaggaacccgtaccggtaacccgggttcccgttaactttacgttacccgttaggtcggaccggtacggtacccgttaccccgacgggtaccgttccgggtacggaccggacccggtacgggaccggtacggtcccgggtttacctttccgggtaccgtttccggggtaccggggg

SEQ ID NO: 206910 - DNA, 808 bp, Homo sapiens
  misc_feature: GYAE6OF01D7J20.17.25.C03.1.454.CMB.1.raw
  modified_base (128)..(128): a, c, t, g, unknown or other
  misc_feature (128)..(128): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggnggatcctcttcttggtggcagcagctacaagtcgcccactcccgaggtcgcagtcgtggtcgctagtcgtgggctggaggtagaagaacgccgtgggcctcgagtgacgtccgtccgtgcaaggtcttcgtacggtactttccgtaaccgttttacccgtcctttaacgtacgttacgttaccgtaaccgttggggttccgcccggaccgtaaccgggtccccggtccggttaacgggaacccgaaacccggtacccgttagggtaacggtacgggtacggttacggggtacgttaccggggaaccccgtaaacccgttaacgaccggttcgggttactaccgacgtaaggttccgtaccttacccgacccgtaccgttccgtaccgggaactacgtaccttaccgactacgaaccaccgtaacctcctaaccgaactaaaccaaccgtacgtaaccctacgaacggttcgggtaaggttacggaaggttaccgaccgtacgaacctcgtacgtaccgaaccggtaccgacccggttacgttaacgtttaacgttcgtacgtacgggacgtacggtaccctacccggtacggtacggtttcccggaggtacccgttaccccgggaggtacccgtacggccggttttaccccgttaggttacccggttcggggtaccgggg

SEQ ID NO: 206911 - DNA, 701 bp, Homo sapiens
  misc_feature: GYAE6OF01CJ2L7.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctccgtgcaaggcttctggtattctacgtttacctcctatagtatcaacgtgggtgccgccagggcccgcgtggaaccaaccggacctggacggtggatggggagtggggacctaaaccctaacgacgtggtcgtcaacgtaggttcgttccttaccaaccctacgttccccgtaccggggactaacggtaccttaaccagtacgaaccaccgtaacctcccgtaccaactaaaccacacgacctaacagtacggagtttacggaggacgtaccgtaggaacctacgttcgtacggaaccgacccggtaaccgggtcccgttacttaacgtttacggtgtacggtacggtaacgtacccggtacccaacgggtaccggttacccgggtacggaccggtacccgtaaccgggaccgtaacgggtcccgggttacccgttttcgggttacccgtttcgggtaccccgggggg

SEQ ID NO: 206912 - DNA, 698 bp, Homo sapiens
  misc_feature: GYAE6OF01A8LMD.17.25.C03.1.454.CMB.1.raw
tcagcgtagactagcacgaccggtgctcgatttagtagtgtagatttgggtttgggactcaacaaccacatctgtcctctagagaaaaccctgtgagcacagctcctcaccatggactggacctggaggatctcttcttggtggcagcagctacaagtgcccactcccaggtgcagctggtgcagtctgggctgaggtgaagaagccgtggggcctcgagtgaacggtctccgtgcaggcttcgtggacttcgacgtttacctcctatagtactcaacgtgggttacgccgccgaggcccgtcgttcggacctaacgccctaggacgtggagtcgggagttcgggaccgtaaacccctaacgacgtcgggttcgtccgaacgtacgtcgttccttccgaaccctcgtcccgtaccgggactaacgtacctttaccgactacggaccctaacggtaacctccctaacgaacttaaaccgacgtaccgtaccctaagacgttacgggacgtttacggacggtaacgtcccgtagactaacgtcgtacgaaccgaccgtaccggggtccttacgttagtttaaccctgggtacaccggtagtaacccgtacccgtaaggtaccgtcccgggtatacccggtaccggttacggacctacgggaccctttgggttacccgttttggtaccgtttaccgggggg

SEQ ID NO: 206913 - DNA, 764 bp, Homo sapiens
  misc_feature: GYAE6OF01CINDA.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatccttcttcgttggtggcagcagctacaagtgcccacctcccgaggtgcagcgtggtgcgagtcgtggggctggaggtagaagaagccgtggggcctcgagtggaacgtctccgtgcgaaggtcttgtggattcctaccgtttacctctatagtactcgtaacgtgggtcgccgccgacggcccgcgtacggaaccgaaccggcgtaggacggtaggaggtcgggaacgtcggggaaccgtaaacccgtaacgtacggttggtacgtacgaacgtacgttcggtacccttacccgaccctaccgttacccggtacccggggtactaaacggtacctttaacccgacgtaccgaacccctaaaccggttaaccccttacccctaaccctaaaaacgttaaaccccgaacgtaacccgaaccttaaaacgtcggttaacggggtaacgttacgggaacggaccgtaccttaagggaaccttacgtccgttacggaaccggtacccgaccgggttaccttacttacgttacgtggacgacggtacgacccgtacccgaaggtaccggttccggaggtaccgccggtaccggacggtacggttacccggttctttacgggacgttccggggacgggg

SEQ ID NO: 206914 - DNA, 558 bp, Homo sapiens
  misc_feature: GYAE6OF01D3EPN.17.25.C03.1.454.CMB.1.raw
  modified_base (282)..(282): a, c, t, g, unknown or other
  misc_feature (282)..(282): n is a, c, g, or t
  modified_base (345)..(345): a, c, t, g, unknown or other
  misc_feature (345)..(345): n is a, c, g, or t
  modified_base (411)..(411): a, c, t, g, unknown or other
  misc_feature (411)..(411): n is a, c, g, or t
  modified_base (419)..(419): a, c, t, g, unknown or other
  misc_feature (419)..(419): n is a, c, g, or t
  modified_base (436)..(436): a, c, t, g, unknown or other
  misc_feature (436)..(436): n is a, c, g, or t
  modified_base (440)..(440): a, c, t, g, unknown or other
  misc_feature (440)..(440): n is a, c, g, or t
  modified_base (470)..(470): a, c, t, g, unknown or other
  misc_feature (470)..(470): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgccccactcccaggtgcagctggtgcagtctggggctggaggtgaagaagcctggggcctcagtgaaggtcctcctgcaaggcttctggattcacgtttacctctatagtatcaactgggtncgccaggccgctggacaacgctgagtggagtgggatcgggacaaccctagactggtagtcacngtgtctcacccatcccgtccgggacacgtaccttaccatacgaccacgaacctcccacaataaacncagcctanacgtgtagtgagacgcngacntctacgacgacgccggtccgtctattacgngtcgacgaggtccgtacccacggtacgtccgggagacgcccgtaccggcgaccggtcgtacccgttttggccgttcggtacccggggg

SEQ ID NO: 206915 - DNA, 687 bp, Homo sapiens
  misc_feature: GYAE6OF01AGX1D.17.25.C03.1.454.CMB.1.raw
  modified_base (282)..(282): a, c, t, g, unknown or other
  misc_feature (282)..(282): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcgagtgaaggtctcctgcaaggcttctggattcacgtttacctcctatagtatcaacgtgggtnccgccgaggccgcgtggaaccaacgacctggagtggagtgggagtcgggaccgaaccctaacgacgtgggtcgtcgacgtagtcgtcttccaccctcgtccgtccgggacacgtacctaccagtacgaaccacgtaacctccctaccgaactaaaccacaacgtccctaacgagttacgggtagttcggaacggtacgtcccgttaggaaccttacgtaccgttaggaacccggtaacgttacccgggtcccgttacttaacgtttaccgtcggtaggtaccggaacggtacccgtaccccgaacggtccggttacccgggagacccggtaccccgttaaccgggcccgtaaccggggtcccggtttacccgttttacgggtaccgtttccggggtacccggggg

SEQ ID NO: 206916 - DNA, 797 bp, Homo sapiens
  misc_feature: GYAE6OF01DR7UO.17.25.C03.1.454.CMB.1.raw
tcagcgtagactagcacgaccggtgctcgatttagtagtgtagatttgggtttggggactcaacaaccacgatctgtcctctagagaaaaccctgtgagcacagctcctcaccatggactggacctggaggatcctcttcttggtggcagcagctacaagtcgcccactcccgaggtgcagctggtgcagtcgtggggctggaggtgaagaaggccgtggggcctcgagtagaacggttcctccgttggactaagggtcctttcgttgggtactttccgtaaccggtttttaccctaccgttaagttaacggttaacttaccgtaaacggttggggttacgccggaccgacgggtacccggcgtttacgggaacctaaaccggtaccgttggaacggttagggtaggtcggggagttacggggacccgtaaacccgtaacgacgtggtacgtacgacgtacggttcgtaccttaccaacccgtacgttcccgtaccgggaactacgtaacctttaaccgacgtaccgaacccgtaccgtaaccttcccgtaaccctaaacgttaaacccgaccgtaaccgtacccttaacgaacggttacgggtaagttaccggaaacgggtaccgtacccgttaaggaacctacgttaccggaacggtaaccggaccggttaacccggtcccgttaacgtttaacgttacgtacggtacggccgtaacgtaccgtacccgaacgtccgtccggtagccgtacccgtacggcgtacggtcccgttctttacgcgttcgggtaccggg

SEQ ID NO: 206917 - DNA, 764 bp, Homo sapiens
  misc_feature: GYAE6OF01B9PGC.17.25.C03.1.454.CMB.1.raw
tcagcgtagactagcacgaccggtgctcgatttagtagtgtagatttggggtttgggagtcagtctcagtcaggacacagcatgtacatggagggtccccgctcagctccgtggggctcctgctactctggctccgagctgccagatgtgacatccagatcgacccagtcctccactcctccctgtctcgcctcgtggtgggggtcagacgtcaccatctacttcgaccggacaacgtcacggtaacgttaaaccttatttaaagttggtatcacgacaacgaaaccgtaacggaaaaccgccccaacgtaccctcctagactctcgtaggtcgactacctccctactcgtaggaccgtaaggtccggtacccgtacccgtagttcggtacggttaccgtagggtacggtacgtacggtaggtactacgggacgggatagtactttaccaatccttacaccactacccacctacttcgacgtacctaacgtcggtaagtacgttcgtacgtaacctaactttacccgtaacttaacgtacgtaactaaaccggtacggttaaacccgttttaccgacccggttttaccccgacgttaacccgtttaccggtttaccggggaacccgggttaaacggggtaacccgttaaaggggttaaccgaaacggtttaaaccgtaaaccggttaaaaaccgggttcggttaccgggtaacggtcccgtaacggaacccttaaccgtacccgttccgttaacccggtttccc

SEQ ID NO: 206918 - DNA, 833 bp, Homo sapiens
  misc_feature: GYAE6OF01A79TP.17.25.C03.1.454.CMB.1.raw
  modified_base (248)..(248): a, c, t, g, unknown or other
  misc_feature (248)..(248): n is a, c, g, or t
  modified_base (289)..(289): a, c, t, g, unknown or other
  misc_feature (289)..(289): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcagtgaaggtcctccgtgcaaggcttcnggattctacgtttacctctagtagtatactaacgtgggtcncgccaggccgtgtggaccaacgacctggagtggatgggagtcgggaacctaacccgtaatacgtgggtacgtaccacgtaacggttcgtaccgtttaccgaaacccccgtagttccccggtaacccgggggtaacctaacggtaaccccttttaacccgaagttacccggaaccctaaccggtaaacccttacccctaacgaaacttaaaacccgaacaaccggtacccttaaacgtagtcgggtaacggtttggaaacgggtaccgtacccgtagggtaactaaccggtttaccgtacggaaaccgtacccggtaaacccggggtaccgttttaccgtttaaaccgtttaccggttacgggtccggtaaaccgggtaaacccgttacccggggttaaccccccgaaacgggttacccggttacccggggtttaccggaaacccgggttaccccgggttaacccgggacccgttaacggggtcccccgggtttaaccccggttttttacggtaacccccgggttttaggggtacccccgggggg

SEQ ID NO: 206919 - DNA, 674 bp, Homo sapiens
  misc_feature: GYAE6OF01BOH07.17.25.C03.1.454.CMB.1.raw
  modified_base (220)..(220): a, c, t, g, unknown or other
  misc_feature (220)..(220): n is a, c, g, or t
  modified_base (283)..(283): a, c, t, g, unknown or other
  misc_feature (283)..(283): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctnagtgaaggtctcctgcaaggcttcgtggattcacgtttacctcctatagtatcaactggggtncgccaggccgctggacaacgcctgagtggatgggatgggccgaaaccctaacaccgtggtcgtacacagttcgtccttaccacccgtatcccgtaccggggaacacggtaacttaccatacggacccacgaaccttccctaccgaataaaccaccgaacgtaccctaacgaagttagggtaacggttggaacgggtaacgcccgttaaggaccctacgttaccgtaacgggtaaccgacccgaaccgggtcccgttacttaacgtttacgtcggtggtacggtaacggaccgttaccccgaacggtacgtacccgggtacggacgtaccccggtagggacccgtaaggtccgggttaccctttcgggtaacccgtttcgggtacccggggg

SEQ ID NO: 206920 - DNA, 696 bp, Homo sapiens
  misc_feature: GYAE6OF01AJAXR.17.25.C03.1.454.CMB.1.raw
  modified_base (247)..(247): a, c, t, g, unknown or other
  misc_feature (247)..(247): n is a, c, g, or t
  modified_base (303)..(303): a, c, t, g, unknown or other
  misc_feature (303)..(303): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctggaggtgaagagccgtggggcctgagtgacgtctcctgcaaggtcttcgnggtacttctacgtttacctcctatagtactcaacgtgggtcgcgtccgaggcccgngtacggaacaacgacctggacgtggagtgggatcgggacctaaacccgtacgacgtggtcgtaccacgtaggttcgtccgttaccacccgtacgtcccggtacccgggaactaacggtaacccttaccgagtaccgaacccaaccgttaaccctacccgttaccaaactaaaccaccgtaacgtaccctaacgtaggtacgggtacgttacggaacggtactccgtagtaacgtacttacggtaacggaaccgtaccgaccggtaccgttacttaacgttacgtggtacggacgtacgtaccgtacccgaaggtccgttacgggtacgaccggtacccgtacgggtccgacgggttacccgttaccgtttcggtaccgtttcgggtaccgggg

SEQ ID NO: 206921 - DNA, 678 bp, Homo sapiens
  misc_feature: GYAE6OF01DDAY4.17.25.C03.1.454.CMB.1.raw
  modified_base (222)..(222): a, c, t, g, unknown or other
  misc_feature (222)..(222): n is a, c, g, or t
  modified_base (290)..(290): a, c, t, g, unknown or other
  misc_feature (290)..(290): n is a, c, g, or t
  modified_base (395)..(395): a, c, t, g, unknown or other
  misc_feature (395)..(395): n is a, c, g, or t
  modified_base (408)..(408): a, c, t, g, unknown or other
  misc_feature (408)..(408): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctnagtgaaggtctcctgcgaaggcttcgtggattctaccgtttacctcctatacgtatcaacgtgggtancgccaggccgacgtggacaacgaccgtgagtggagtgggatgggaccaaccctaacacgtggtgtcacagttgtacgttaccaacctacgtcccgtacccggganacgtaccttaacngtacgaaccacgaacctcctaccaactaaaccacacgacctaacgagttacggagttaggaaggtacgccgttagactattaccgtaacggacgaaccgtaccgggtccgttaccttacgtttaacctggttacgaccggtaacgtaccggtaccccgaacggtacggttacccggggacgtaaccggggtccccgttaacccggggccgtacggggttacccggttcccgttttaaacgggtccccggtttcggggtaaccccgggggg

SEQ ID NO: 206922 - DNA, 802 bp, Homo sapiens
  misc_feature: GYAE6OF01C3U8B.17.25.C03.1.454.CMB.1.raw
  modified_base (179)..(179): a, c, t, g, unknown or other
  misc_feature (179)..(179): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctgggaggactcctcttcttggtggcagcagctacaagtcgcccactcccgaggtncgagcgtggtgcgtagtcgtggggctggaggtagaaggacggccgtcggggccttagaggtacgacgtcctcgtgacgacggtcttgtcggtacttccgttaacgtttaccctaccgttaagttaacgtacttaccgtaaggttcgggggtacgacccggtaccggacgggccccgtacgttaacgggaacccgtaaaccgtccgtaggagggttacggaaggtcggggtaacggtccgggaaaccctaaaccccgtaacgtaccggttaggtaccggtaaccacggtaaggttcgttaccccttaaccgaacccctacggtacccggtaacgggaacctaccgggttaaaccctttacgaaccgtacccggtaacccgtaacctaacccctttccgaaccaaactaaacccacgtacctaccttaaacgaggttaccggggtaagtacggaacggttacgacccgtaagcctaacgtccggtaacgtaaccggcccgaccgggttccttaacgttcgtaacgtcggtaccggtacgacggtacccgaccgttaacgggtccgttacgaggccccggtacggccgacgccgggtacttccggttaggccgttccgggacgggg

SEQ ID NO: 206923 - DNA, 678 bp, Homo sapiens
  misc_feature: GYAE6OF01B98ZQ.17.25.C03.1.454.CMB.1.raw
  modified_base (334)..(334): a, c, t, g, unknown or other
  misc_feature (334)..(334): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctccgtgcaaggcttctggattcacgtttacctctatagtatcaacgtgggtgcgccaggccgctggacaacgactgagtggatgggatgggaccgaaccctaacncgtggtcgtcgacgtaggttcgtcttccaacccgtactcccgtaccggggaactacggtaccttaacccgagtaccgaaccctaaccggaaccttacccgtacccaataaaacccacctaacgcccttaacgacgtagggtacgtttaggacgggacgtcccgtaaggtaactacgtccgacggaaccgaaccgtaccggggtcccgttacgttacgttacgtcggtacggtaacggtacggtaccgtaccccgtaaggtaccgttaccgggtagaccggtaccccgttacgggaccctaacgggcccggttaccgttttccggtacgtttcgggtaccggggg

SEQ ID NO: 206924 - DNA, 598 bp, Homo sapiens
  misc_feature: GYAE6OF01C29MX.17.25.C03.1.454.CMB.1.raw
  modified_base (246)..(246): a, c, t, g, unknown or other
  misc_feature (246)..(246): n is a, c, g, or t
  modified_base (262)..(262): a, c, t, g, unknown or other
  misc_feature (262)..(262): n is a, c, g, or t
  modified_base (281)..(281): a, c, t, g, unknown or other
  misc_feature (281)..(281): n is a, c, g, or t
  modified_base (478)..(478): a, c, t, g, unknown or other
  misc_feature (478)..(478): n is a, c, g, or t
  modified_base (520)..(520): a, c, t, g, unknown or other
  misc_feature (520)..(520): n is a, c, g, or t
  modified_base (552)..(552): a, c, t, g, unknown or other
  misc_feature (552)..(552): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagagccgtggggcctcgagtgaaggtctccgtgcaggcttcnggattcacgtttaccnctatagtatcaactgggtncgcgaggccgcgtaggacacgacctaggacgtggagtgggacgtcgggaccgaaaccctacgacgtaggtgtaccgacagttgtccttaccgacccctacgtcccgtaccgggactacgaccttacgactcgaacccacgtaacctcccgtaccaactaaaccaccacgtaccctacgaagtcggagttgaggtacncttagacatcgtcgaacgaccgacgtaccgtatacgttacgngtcggactaggaccgttccacggcgttccggngacgtccgtaacggctacggccggtcttacgtcgttcggaccgggg

SEQ ID NO: 206925 - DNA, 792 bp, Homo sapiens
  misc_feature: GYAE6OF01A2HGH.17.25.C03.1.454.CMB.1.raw
  modified_base (282)..(282): a, c, t, g, unknown or other
  misc_feature (282)..(282): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtgcccactcccaggtgcagctggtgcagtctgggctgaggtgaagaagccgtggggcctcagtgaaggtctcctgcaaggcttctggattcacgtttacctcctatagtatcaacgtgggtnccgccaggccgcgtcggacacggcctggagtcggagtgggagttcgggacgaaccccgtaagacgttgggtacgtacgacgtacggtcgttcctttaccgacccctaagtccccggttacccggggaacctacggtaacctttacccgaacgttacggaacccctaacggaacccttacccgtaccaaactaaaacccgaccgtaacgtaccctaaactaacggttcgggtaaggtttacgggaacgggtaccgtacccttacggtaactaacgttccgttaaggaacccggtaacccggaccccggggttaccgttaacccgttttaagtttacccggtacggtaccggtaccgggaaaccggtttacccggtaccccggtaaaccggttaacggtttccccggggttaacggaacccggttcccccggttaaaccggggcccgtaacggggtacccccggttacccgtttttacggggaacccgttttccgggggtaaccccgggggg

SEQ ID NO: 206926 - DNA, 685 bp, Homo sapiens
  misc_feature: GYAE6OF01C0HBU.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaaggtctcctgcaaggcttctggattcacgtttacctcctatagtatcaacgtgggtgcgccaggccgcgtggacaacgacctggagtggagtgggatcggggaccgaaccctaacgacgttgggtcgtacaacgtacggttgtccttaccaccctacgtcccggtacccgggactaacggtaacctttaccaagtacgacccaaccgtaaccctccgtacctaactaaaaccactaaccgacctaacagtaggtaggttggaacggacgtccctaggaacctagttcgtaacggaaccggaaccgtaccgggtcccgttacttaacgttaccgttcggtacggacggtaacggaccgttaccccgaacggtaccgttacccgggtacggaccgtccccggttaacggccgtacgggtacccggttacccttttacggtccgtttccgggtacccggggg

SEQ ID NO: 206927 - DNA, 730 bp, Homo sapiens
  misc_feature: GYAE6OF01DZQX9.17.25.C03.1.454.CMB.1.raw
  modified_base (292)..(292): a, c, t, g, unknown or other
  misc_feature (292)..(292): n is a, c, g, or t
  modified_base (663)..(663): a, c, t, g, unknown or other
  misc_feature (663)..(663): n is a, c, g, or t
tcagcgtagactagcacgaccggtgctcgatttagtagtgtagatttgggtttgggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcagtgaaggtcctcgtgacgaggtcttgtggtattccgtacgtttacctactagtagtactcaacgtgggtcnccgccgacggccgtcgtacggaacgaaccgtaccgtggtaggtacggaggtacggtagtacgggaacctaaccgtaacgtcgtggtactacgaagtcgtcgttacctaccgaccctacgttcccggtaccgggactacgtaaccttacacgtacctaacccgaccgtaacccttcccctaaacgaaactaaaccgtaccgaccgtaacctaagtaacggttagggttacgtaggaaccgggacttccgtaacgactagtaccggttaaccgaaccggtacccgtaccgggttacccttaacgtttaattaaccggtcggtaacgaccggtaacgacccgtaaccccggtaaggttaccgtcccggggttanaccggttcccggtaacggccgtaccgggtccgtttaccgtttacggtacccgttccggggaccgggg

SEQ ID NO: 206928 - DNA, 786 bp, Homo sapiens
  misc_feature: GYAE6OF01D5WJL.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctggaggtagaagacgcgtggcctgagtgacgtcctcgtgacaggtctcgtggtacttaccttaccgttacctactattacgtactcgtacgtgggtcgacccgcgaccggccgtagtacggaaccaacgtccgtaggacggtaggacggttgggacggtaccgggaaccctaaaccccgtacgtacggttcggtacgtaccgagttacgttccgttacctacccgaccctaccggtccccggtaaccgggaacctaacggttacctaacccgtacgtacccgaaacccgtaccgtaacccttacccctaaacctaacgtaaaccacccggtaacctaccgtaacgttaagggtacgggttaggtaaccggtacgtaaccggtaccgtaacggtaaccttacgtaccggtacggaaaccccgtacgggtacccgttaccctttaaacgttcgttacgttaccggacggtaccgtaaccgggttaccgaccccggtaacggtcggttccgggaaccggtcggttaccccgggaacgccggttaccggtacccggttttcggttaacgttcccgggttccgggacccgggggg

SEQ ID NO: 206929 - DNA, 784 bp, Homo sapiens
  misc_feature: GYAE6OF01D8S1T.17.25.C03.1.454.CMB.1.raw
  modified_base (299)..(299): a, c, t, g, unknown or other
  misc_feature (299)..(299): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtagaagaacgccgtggggcctcagtgaaggtcctccgtgcgaacggtcttcgtggtactttcgaccgtttacctcctatagtatcaacgtgggtcncgccaggcccgcgtacggaccacgtacctggaggtggagtggggagtcgggaaccctaaacccctaagaccgttggtacgtcaacgtacgttcgttaccttaccgaacccctacgttccccgtacgggaaacctagtaaacccgttacccgaagttacccggtaacccgaaccgttaacccttaccctaaccctaaactaaaacccgaaccgtaacccgttaaccgtaacgtacggttaacgggtacgggtttaacggaacgggtacgtacccgtacgtaaccgtaccgttcgtaaccgggaacccgtaccggacccggttacccgttacgttaacgttaccgttaggtacggtacccggaacggtaccccggtaccccgaaacggttcccggtaaccgggtcggtaaccgggtacccgtaccgggacgtacccgggtacccggttaccggtttccggtaacccgtttccggggtaacccggggg

SEQ ID NO: 206930 - DNA, 659 bp, Homo sapiens
  misc_feature: GYAE6OF01CSZGS.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagagccgtggggcctcgaggtgaaggtctccgtgacaaggtcttcgtggtattctaccgtttacctctaatagtatccaacggtgggtacgccgcgagggccgcgtacggaacaccgccgtgacggtggacgtgggagtcgggaccgtaacctaacgacgtggtgtacacgagttcgtaccttccacctacgtccgtaccggacacgtaacttacatacgaccacgtaactacctaccaataaaccacacgtacctacgagtaggtagttacggacggactcgtacgactacgtacgtaaccggaccgtaccgtaccggggtacctacttacggtttacctcgggttacgaacggtactaccggtaccccacgggtacggtcccgggtagacccggtccgtaacggccgtacggacccggtttacgttaccggtcggttcggggtacccgggg

SEQ ID NO: 206931 - DNA, 731 bp, Homo sapiens
  misc_feature: GYAE6OF01BX6BI.17.25.C03.1.454.CMB.1.raw
  modified_base (248)..(248): a, c, t, g, unknown or other
  misc_feature (248)..(248): n is a, c, g, or t
  modified_base (251)..(251): a, c, t, g, unknown or other
  misc_feature (251)..(251): n is a, c, g, or t
  modified_base (264)..(264): a, c, t, g, unknown or other
  misc_feature (264)..(264): n is a, c, g, or t
  modified_base (474)..(474): a, c, t, g, unknown or other
  misc_feature (474)..(474): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctgggaggactcctcttcgttggtggcagcagctacagtcgcccactcccaggtgcagcgtggtgcagtcgtggggctggaggtagagacgcgtgggcctgagtgacggtctctgcagtcttcgnggnttcacgtttaccnctatagttacacaacggttggtgccgcgaggcccgacgtaggaaccaacgccgtaggagtacggagtcgggagtcggggaaccgtaaccctaagcgttagggtcctacgacgtacgttgttacctccgacccgtagtcccgtacgggactaacgtaccttacagtccgaactaaccgacctccgtaccaacgtaacaactacgacctaanacggtaggtagttaggacgtacgtccgtaggtactacgtacgtaacggaaccgtaaccggaccgggttaccgttaaccgtttaacttaccggttacggtaacggtacccgggttaaacggtacccggttaaccccgtacggttaacccggtaccggggtacggtaacccgggtaaaccccgttaccggggtaccggtacccgggtaccggtttaaccggttttccggttaccggttttccgggggaaacccgggggg

SEQ ID NO: 206932 - DNA, 838 bp, Homo sapiens
  misc_feature: GYAE6OF01CHB9R.17.25.C03.1.454.CMB.1.raw
  modified_base (340)..(340): a, c, t, g, unknown or other
  misc_feature (340)..(340): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatctcttcttggtggcagcagctacaagtcgcccactcccaggtgcagctggtgcagtcgtggggctggaggtagaagaagccgtggggcctcgagtagaaggtctcctgcgaaggtcttcgtggattcgtacgtttacctcctagttagtactacaacgtgggtcgccgccgaggccgacgtcggaacaacgacctgagtggagtgggngtacgggacgtaaaccctaagacgtgggtacgtacgaacgtaggttcgtaccttacgacccctaagtccccggttaccgggaactaacggtaacctttaaccgagttacccggaaccctaaccgtaaacccttccccgtaaacctaaaccgtaaaaccgaaaccgtaaccgtaaccgtaaaccgtaacggttacgggtaacgggtttaacggaacgggtaaccgtaccccgttaagggtaacccttaaccgttaccggttaaaccgggaaccccggtaaacccgggtaaccccgggttaccccggtttaaccgttttaaccgtttaaccggtggttaccggtaaccgggtaaccgtaacccgggttaccccgaaacccgggttaacggtaccccgggggtacggtaaacccggtacccggtaaccccgggtacggtaacccgggtaccccggggttacccgttttacgggtacccggttttcggggtaacccgggggg

SEQ ID NO: 206933 - DNA, 836 bp, Homo sapiens
  misc_feature: GYAE6OF01DMONS.17.25.C03.1.454.CMB.1.raw
  modified_base (352)..(352): a, c, t, g, unknown or other
  misc_feature (352)..(352): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtgcccactcccaggtgcagctggtgcagtcgtggggctggaggtgaagaagccgtggggcctcgagtgaaggtctcctgcaggcttctggattcacgtttacctcctatagtatcaacgtggtgcgccaggccgtcgtcggaaccaaccgacctggaggtggagtgggagtcggggacccaaacccgtaaancgtgggtcgtacgaacgtagttcgttaccttaccgaacccctacgtcccgttaccgggacctaacgtaaccttacccgattaccggaaccctaacgtaacctacccgtaaccaaattaaaacccaaccgtacggtaaccccttaagaacggttacggggtaacggttttacggaacggggtaaccgtacccgtttagaaacccgttacgtaacccgttacgggaacccggtaaacccggtaaccccggggttaccccgtttaaccgtttaaccggtttaaccgtttcgggtaaccggtacccgggtaacggtaaccccggtttaacccccggaacccgggttaacccgggttaccccggggttaacggtaaacccgggttacccccggtaaccggggaccccggttaaccgggttacccccgggggtttaccttttttacccggggaaacccggttttttcccgggggaaacccccgggggggg

SEQ ID NO: 206934 - DNA, 751 bp, Homo sapiens
  misc_feature: GYAE6OF01C0SXU.17.25.C03.1.454.CMB.1.raw
  modified_base (305)..(305): a, c, t, g, unknown or other
  misc_feature (305)..(305): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagccgtggggcctcgagtgaaggtctccgtgcgaaggtcttcgtggtactttcctaaccgttttacctccttaagtagtacttccgaacgttgggtacnccgccgagggcccgtcgtacggaaccaaccggaccgttaggaggtaggtacgtaggggaacgttcggggaaccgaaacccttaacgacgttgggtacctacgaacgtaggttcgttccttaccacccgtacttcccggtaccgggtaactacggtacctttaacccgagttacccgaacccgtaaccgtaacctcccgtaaccaaactaaacccacgtaaccgtacctaacgtagttacgggtaacggttacggaacgggtaccgtaccgtacgaacctacgttaccgtacgaaccggtacccgtaccggtccgttactacgttttaacgcgtacggaccgttaacgacccgttacccgaacgggtcgtacccgggtggtaccggccccggttaacggccggtacgtcccggtttacctttcggtacccgttgggtaccccggggg

SEQ ID NO: 206935 - DNA, 674 bp, Homo sapiens
  misc_feature: GYAE6OF01CXSOV.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagcctggggcctcagtgaaggtctcctgcaggcttcgtggattcacgtttacctcctatagtatcaactgggtgcgccgacggccgcgtggaacaaccgacctgagtggagtgggatcgggaccgaaacccctaagacgttgggtcttccaacgtaggtttcgttaccctttacccaacccccgtagttaccccggttacccggggaactaacggtaaccctttaccacgtaccgacccaacgtaaccctcccgtaccaactaaaccgacacgtaccctaacacgttagggagtttaggaacggtacgtcccgtagacctacgttacgtaccggaaccgaccgtccgggtacccgttacttaacgtttacgtgtcgacggtacgaccgtcccgaacggtacgttccggtagccgtacccgtacggcgtacggtcccggttccttttacggccgtttcggtaccggggg

SEQ ID NO: 206936 - DNA, 621 bp, Homo sapiens
  misc_feature: GYAE6OF01A07TK.17.25.C03.1.454.CMB.1.raw
  modified_base (533)..(533): a, c, t, g, unknown or other
  misc_feature (533)..(533): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcagtgaaggtctcctgcaaggtcttcgtggtattcacgtttacctcctatagtatcaacgtgggtgccgccgaggccgcgtaggacaaccgacctggagtggagtgggagtcgggaccgaacccgtaacgccgtggtcgtacacgtagttcgtccttaccaccctacgtcccgtaccgggactacgtaccttaccatacgaccaccgtaacctccctacaactaaacacgacgaccctaacgagtgggtagttcggaggtacgccgtagactagtacgtcggaaccgaccgaccgggtccttacttacgttacgnggtcgccggtagtaccgtacccgacggtcgttccgggacgcggccgtacggcgtcggccggttctttcggaccgtttcgggaccgggg

SEQ ID NO: 206937 - DNA, 565 bp, Homo sapiens
  misc_feature: GYAE6OF01EPVO6.17.25.C03.1.454.CMB.1.raw
  modified_base (244)..(244): a, c, t, g, unknown or other
  misc_feature (244)..(244): n is a, c, g, or t
  modified_base (281)..(281): a, c, t, g, unknown or other
  misc_feature (281)..(281): n is a, c, g, or t
  modified_base (331)..(331): a, c, t, g, unknown or other
  misc_feature (331)..(331): n is a, c, g, or t
  modified_base (400)..(400): a, c, t, g, unknown or other
  misc_feature (400)..(400): n is a, c, g, or t
  modified_base (419)..(419): a, c, t, g, unknown or other
  misc_feature (419)..(419): n is a, c, g, or t
  modified_base (434)..(434): a, c, t, g, unknown or other
  misc_feature (434)..(434): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcnggattcacgtttacctcctaatagtatcaactgggtncgccaggcccgctggacaacgcctgagtggatgggatggggcaaccctanacgtggtgtcactagtgtacttcacccctagtcctcgggacagtacttaccatcgaccacgaactcccnccaataaacacacgcctanactggagttgaggancctagacatctgaaccgacaccggtccgtcttaattacgtgtcgcgaagtacgtaccccaacgtacctaccggtacggcgtacccgtacggcgtacggccggtaccgttttcgaccgtttcggtaccgggg

SEQ ID NO: 206938 - DNA, 544 bp, Homo sapiens
  misc_feature: GYAE6OF01DSLJN.17.25.C03.1.454.CMB.1.raw
  modified_base (340)..(340): a, c, t, g, unknown or other
  misc_feature (340)..(340): n is a, c, g, or t
  modified_base (345)..(345): a, c, t, g, unknown or other
  misc_feature (345)..(345): n is a, c, g, or t
  modified_base (363)..(363): a, c, t, g, unknown or other
  misc_feature (363)..(363): n is a, c, g, or t
  modified_base (444)..(444): a, c, t, g, unknown or other
  misc_feature (444)..(444): n is a, c, g, or t
  modified_base (454)..(454): a, c, t, g, unknown or other
  misc_feature (454)..(454): n is a, c, g, or t
  modified_base (476)..(476): a, c, t, g, unknown or other
  misc_feature (476)..(476): n is a, c, g, or t
tcagcgtagactagcacgaccggtgctcgatttagtagtgtagatttgggtttggggactcaacaaccacatctgtcctctagagaaaaccctgtgagcacagctcctcaccatggacttggacctggaggatcctcttcttggtggcagcagctacaagtgcccactccaggtgcagctggtgcagtctggggctgaggtgaagaagcctggggcctcagtgaaggtctcctgcaaggcttctggattcacgtttactccttatagtatacaacgtgggtgcgccaggccgatcggacaacgacctgaacggtggaatggggatgggactaaccctaanctggntcactagtgtctcaccgntcccgtacgggacacggtacttaacgatacgaccacgtaactcctaccaataaacacacgacctaatcgtaggagttgagngaccttgacntcagacacacggctactattangtgacgagacgtcccacgtacgtccggtagacgcccgtaggcacggtcgcctttgacgttgtacgggg

SEQ ID NO: 206939 - DNA, 645 bp, Homo sapiens
  misc_feature: GYAE6OF01BB031.17.25.C03.1.454.CMB.1.raw
  modified_base (384)..(384): a, c, t, g, unknown or other
  misc_feature (384)..(384): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcaggtgaacggttctccgtgcaaggcttcgtggattcacgtttacctctatagtatacaacgtgggtgcgccgaggccgcgtcggacaacgacctgacggtggagtaggggagtcggggaccgtaaacccgtaacgacgtggtacgtcacgagttcgtcttacncccactccgtacgggaccagtaccttacatcgaaccgtacgaacctcctaccaagtaaaccactacgacctacgacgtcgggtaacgtttgggaggacgtccgtacgaacgtcgtaccgtagggaacccgtacgaccgggttcccgtacttactttacggtcgtacggcgtacggtaccgtacccggaacgtacggtccggttacggcgtacccgacggccgtacggtccggttaccgtttggtcccgtgggtaccggggg

SEQ ID NO: 206940 - DNA, 567 bp, Homo sapiens
  misc_feature: GYAE6OF01BHGWP.17.25.C03.1.454.CMB.1.raw
  modified_base (243)..(243): a, c, t, g, unknown or other
  misc_feature (243)..(243): n is a, c, g, or t
  modified_base (280)..(280): a, c, t, g, unknown or other
  misc_feature (280)..(280): n is a, c, g, or t
  modified_base (333)..(333): a, c, t, g, unknown or other
  misc_feature (333)..(333): n is a, c, g, or t
  modified_base (480)..(480): a, c, t, g, unknown or other
  misc_feature (480)..(480): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttcnggattcaccgtttacctctatagtatcaacgtgggtncgccaggccgctggacaacgctgagtggactgggatgggaccgaaccctaacncgtggtcgtacacgagtgtccttaccacccgtactcccgtccggggacagtaccttaccatcgaaccctacgaactccctaccaactaaaccacacgcctaacagtggagttgaggcgccgtagacatcacggacgacgcggtcctnttacttagtcgtgacgacggtactcccgacgtcgttccggagccgccgtacggctacggccggtacctttggccgttcggaccgggg

SEQ ID NO: 206941 - DNA, 857 bp, Homo sapiens
  misc_feature: GYAE6OF01CGVI5.17.25.C03.1.454.CMB.1.raw
  modified_base (454)..(454): a, c, t, g, unknown or other
  misc_feature (454)..(454): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtgcagcagctacaagtcgcccactcccgaggtgcagctggtgcgagtcgtggggctggaggtagaagaacgccgtggggcctcgtaggtagaacggtcctccgtgacgtaagggtcttacgtggtaactttccgtaaccgttttacctaccttaataacgttactccgtaaacggttggggtcgccggcgaacgggtcccgtcgtacggaaccaaaccgtaccgttaggaacgggtgggtacgtgggggtaacgttccggggaaccccgtaaaacccgttaacgtaacggttgggttaccgcgtaaacgnggtttacggtcccttaccgtaccccgtaacgttcccggtaacccgggtactaacgttaaccgttaccacgttaccgaacccgttaaccgaaccttcccgtaaacctaaacgaaaccctacgaaccgtaacccgtaaactcggttagggtaacgtttaggaacgggaacttcccgaaggtactaacgtccggtaacgtaaacccggtacccggtaaccgggttcccgtttaaccgttaacgtttaccgttcggtacggtaccgtaaccggtaaccccgtaaccccgaacgggttacccgttacccggggtataaacccccggttcccgggaaccgggttccggtaaacccggtccccgggtttaccgttttcggttaacccgggttcccggggtaacccggggg

SEQ ID NO: 206942 - DNA, 839 bp, Homo sapiens
  misc_feature: GYAE6OF01ETFRH.17.25.C03.1.454.CMB.1.raw
tcagcgtagactagcacgaccggtgctcgatttagtagtgtagatttgggtttgggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagccgtggggcctcgagtgaaggtctccgtgcgaaggtcttcgtggtacttcgtaccgttttacctcctaatagtatccaacgtgggtcgccgccgacggtccgcgtacggaaccaaaccgccgtggacggtggagtgggacgtcgggaccgaaacccctaacgacgtggtgtaccacgtaggtcgttacccttaccgaacccgtcgttcccgtacccgggtaacacgtaccttaaccgtagtaccgaacctaaccgtaacctcccgtaccaactaaaccacgtacgtaccctaagacgtagggtacgttaggacggtaacgtccgtaacgtaccgtacgttacgtaacggtaaccccgtacccggtacccggggttaccccgtttaccttttaaacggtttaacccggtttggggttaacccggtaaccggggttaaacccggtaccccggtttaaaccccccgggtaaacgggttaccccgggtttaaccccgggggtaccggtaaaccccggggtaccccccgggtttaaacccggggacccggttaaacccggggtcccccggggtttttaacccgtttttacccggggttaaacccgggttttccccggggggttaacccccggggggg

SEQ ID NO: 206943 - DNA, 823 bp, Homo sapiens
  misc_feature: GYAE6OF01EH9M1.17.25.C03.1.454.CMB.1.raw
  modified_base (176)..(176): a, c, t, g, unknown or other
  misc_feature (176)..(176): n is a, c, g, or t
  modified_base (188)..(188): a, c, t, g, unknown or other
  misc_feature (188)..(188): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtncagcgtggtgcngtcgtgggctggaggtagaagagcgtgggcctgagtgaggtctctgcgagtcttgtggtactttacgtaccgtttacctcttaatacgtactacgtaacggtgggtcgccgaccgacggtcccgtcgtacgggaacctaaccggtaccgtaggaacgggtggtaacgggttacggggtacggttaccggggaacccgtaaaaccccgttaaacgtaccggtttcggggtactaccgtaacgtacggtttccgttacctacccgtaacccctaccggttcccggttaccggggaaacctacggttaaccctttaaccgacgttaacccggtaaacccgtaaccgtaacccctttacccctaaacctaaaccgtaaaaccctaacccgtaaccgtaacccgttaaacgtacggttacgggtaacggttacggaaccgggtacctaccggtataccgtacgtaccggtaccgaaccggtacccggtacccggttacctttacgttacgttccgtcggtacggaccggtaacggtaccccgaacccgttaacggtaccggttacgggaccgtaccggtcccggaacggcggtacccggtcggtttacccgttcggtacccggttggggtaaccccgggg

SEQ ID NO: 206944 - DNA, 524 bp, Homo sapiens
  misc_feature: GYAE6OF01B6LN7.17.25.C03.1.454.CMB.1.raw
  modified_base (284)..(284): a, c, t, g, unknown or other
  misc_feature (284)..(284): n is a, c, g, or t
  modified_base (338)..(338): a, c, t, g, unknown or other
  misc_feature (338)..(338): n is a, c, g, or t
  modified_base (348)..(348): a, c, t, g, unknown or other
  misc_feature (348)..(348): n is a, c, g, or t
  modified_base (462)..(462): a, c, t, g, unknown or other
  misc_feature (462)..(462): n is a, c, g, or t
  modified_base (488)..(488): a, c, t, g, unknown or other
  misc_feature (488)..(488): n is a, c, g, or t
  modified_base (490)..(490): a, c, t, g, unknown or other
  misc_feature (490)..(490): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgcaaggcttctggattcacgttttacctcctaatagtatcaactggggtncgccaggccgctggacaacgacctgagtggatggggatcgggcgaaaccctaanactggtgcanagtgtcttcaccccatctccgggacagacttaccatgacacgaatcctcataaacacaagtcctacgatgggagttgaggtagcctgacatctgacgacacggctcgtattacngtgcgagtacgtcccacgattccggngngccctacggcagcggaccttttgacttctcgggg

SEQ ID NO: 206945 - DNA, 763 bp, Homo sapiens
  misc_feature: GYAE6OF01DHU45.17.25.C03.1.454.CMB.1.raw
  modified_base (297)..(297): a, c, t, g, unknown or other
  misc_feature (297)..(297): n is a, c, g, or t
tcagcgtagactagcacgaccggtgctcgatttagtagtgtagatttgggtttgggggggagtcagtctcagtcaggacacagcatggacatgagggtccccgctcagctccgtggggctcctgctactctggctccgagctgccagatgtgacatccagatcgacccagtctccatcctccctgtctgcctcgtggtggggtcagagtcacctatcacttcgccggacaagtcgacggtacgttaaaaccttattttaaattggtatacagacaaaggtaaaccgtaggaaaaccnccccaacgtacccttctagtacttccgttcgtagggtcacctacttcccgacttcgtcggacgtaaggtcgggtccctaccgtacgttacggaaggtttcgaaggttcgggaccgtaggtaggtacgttccggtaggggtaacctagttactttacaactttcctaccaacctaacttcccaaccctaccgttactacgtacccgtaaaccgttagggtaacggtagttacgtacgtaactaaccttacgtttaaccttacgttaacgtaacgtaaccgtaaacggttaaccgtttaacccgtacccgtttaccccgtaccggttctttaaccggttttcgggaacccgggttaaccgggtaacgtaaacgggtttacgaacggtttaaacgtaaccgtaaaaccggttacgttggtaccgttacccgtacgtaacctaacccttagttacccgttcggtttaccc

SEQ ID NO: 206946 - DNA, 681 bp, Homo sapiens
  misc_feature: GYAE6OF01A0VTG.17.25.C03.1.454.CMB.1.raw
  modified_base (613)..(613): a, c, t, g, unknown or other
  misc_feature (613)..(613): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccgaggtgcagctggtgcagtcgtggggctggaggtgaagagccgtggggcctcagtgaaggtctcctgcaggtcttctggtattcgacgtttacctacctatagtatccaacgtgggtagccgaccacggcccgcgtgggaaccaacgaccgttggaggtgggagtggggagtcgggacccgtaaacccgtaacgtaccgtggttcgtacgacgtaggttcgttccgttacccaccccgacgttcccgtacccggggtaacgaacgtacctacctagtacgaaccctacgaacctccctacaactaaacacgacgtacctacgagtcgtaggttagacgggatccgtagacctacgtcgtacgaaccggtaccgaccgggtccgtacttaacgttcaggtcggacgtaccgtaccgtccctaaacggtcccgtaccggggttanaccggttcccgtaaccggtcgaaccggttacccggttccgtttcggtaccggttccggtaccgggggg

SEQ ID NO: 206947 - DNA, 683 bp, Homo sapiens
  misc_feature: GYAE6OF01BWX1L.17.25.C03.1.454.CMB.1.raw
  modified_base (296)..(296): a, c, t, g, unknown or other
  misc_feature (296)..(296): n is a, c, g, or t
  modified_base (435)..(435): a, c, t, g, unknown or other
  misc_feature (435)..(435): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtgcagcagctacaagtcgcccactcccgaggtgcagctggtgcagtcgtggggctggaggtagaagagccgtggggcctgagtagaaggtctcctgcaaggtcttcgtggacttcgaccgttttacctctaatagtatacaacggtggggtcnccggccgacgggcccgtcgtagggaaccaacggtacctggaggtggacgtggggacgtacgggaccggtaaacccctaaacgacgttaggtcgtcgaacgtagttcgttacccttcaacccgtactccgacccgggganacgtaccttacagtcgaaccacgacttaccacctaataaacacacgaccaatagtaggtagttagacggactaccgtagactaccgcgtacggaaccgtacccgaccggtccttacgttaacgttcgtgacggtacggaacgtcccgtaacccggaaccgtccggggtaccgtacgggtcccgtaaccgggtaccggacggacccgggttacgttacccctttacgggtccgtttccgggacccgggg

SEQ ID NO: 206948 - DNA, 535 bp, Homo sapiens
  misc_feature: GYAE6OF01C4C4E.17.25.C03.1.454.CMB.1.raw
  modified_base (280)..(280): a, c, t, g, unknown or other
  misc_feature (280)..(280): n is a, c, g, or t
  modified_base (332)..(332): a, c, t, g, unknown or other
  misc_feature (332)..(332): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatggggacaaccctaanactggtgtcacagtgtcttcacccatccgtccgggacagacctttaccatcgaccacgaacctccctaccaataaacacacgacctaacatggagttgaggagcctgacatctgacgacacggccgtctacttactgtcgcgagcgtcccacgtagtccggtgacgcccgtacggcacggcggtcctttcgcgttcgtcgggg

SEQ ID NO: 206949 - DNA, 747 bp, Homo sapiens
  misc_feature: GYAE6OF01ARGA6.17.25.C03.1.454.CMB.1.raw
  modified_base (394)..(394): a, c, t, g, unknown or other
  misc_feature (394)..(394): n is a, c, g, or t
  modified_base (463)..(463): a, c, t, g, unknown or other
  misc_feature (463)..(463): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtgcccactcccaggtgcagctggtgcagtcgtggggctggaggtgaagaagccgtggggcctcgagtgaaggtctccgtgacaggcttcgtggtattctaccgtttaccctcgtatagtatcaacgtgggtgcgccgacggccgcgtcggaccaacgccgtggaggtcggagtgggagtcggggaccgaaaccctacgacgtgggtctacgacgtagtcgttccttccaccctntccccggtaccgggacggtaccttaccagttaccgaccctaaccgaccctccctaccaacgttaaaccnctaaccgtacctacgtaacgttagggtaggtttacggaacggacgtacccgttacggaaccttacgttaccgtacggaaccggtaacccggtacccgggtacccgttaacgtttacgttttaacccggtcgttacggaccgggtaacgtaccggttaccccgaccgggttacgttaccccggggtagtacccgggtcccgttaacccggggcggtaaccgggttccccggggtacccgtttttaccgggtcccggttttccggggtcccggggtacccgggggg

SEQ ID NO: 206950 - DNA, 627 bp, Homo sapiens
  misc_feature: GYAE6OF01DUCHT.17.25.C03.1.454.CMB.1.raw
  modified_base (349)..(349): a, c, t, g, unknown or other
  misc_feature (349)..(349): n is a, c, g, or t
  modified_base (443)..(443): a, c, t, g, unknown or other
  misc_feature (443)..(443): n is a, c, g, or t
  modified_base (478)..(478): a, c, t, g, unknown or other
  misc_feature (478)..(478): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcgagtgaaggtctcctgcaaggcttctggattcacgtttacctcctatagtatcaactgggtgcgccgaggccgcgtggacaacggacctggacgtgggagtggggagtcggggacgtaaacccctaaacncgttggtcgtacacgtacgttgttcttccacccctatcccgtaccggggacacgtaccttaccatacgaccacgtaactccctacaataaaccncacgcctaacgatcggagttgaggagtcctgaacngttctgaccgtacgaccgggtctacttaacgttacttggcggtaacgtagaccgttaccccgacggtaccgtcccgggtggaccgaccccgttaacggggcctaacgggtcccggttacccttttcggccgttttccgggaaccggggg

SEQ ID NO: 206951 - DNA, 673 bp, Homo sapiens
  misc_feature: GYAE6OF01BRFZ9.17.25.C03.1.454.CMB.1.raw
  modified_base (299)..(299): a, c, t, g, unknown or other
  misc_feature (299)..(299): n is a, c, g, or t
  modified_base (491)..(491): a, c, t, g, unknown or other
  misc_feature (491)..(491): n is a, c, g, or t
  modified_base (578)..(578): a, c, t, g, unknown or other
  misc_feature (578)..(578): n is a, c, g, or t
  modified_base (616)..(616): a, c, t, g, unknown or other
  misc_feature (616)..(616): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctggaggtgaagacgccgtggggcctcgaggtggaacggtcctccgtgcgaaggtcttcgtggtattccgtacgtttacctctagtagtatcaacgttgggtcnccggtccacggcccgcgtcggaacacggtacctggacggtgggagtggggtactccggggaccgtaaaccccttaacgacgttcgggtacgtcgtaacgtacggttcgtccttccgaacccgtacttacccgaccgggaactacgtacctaaccgataccgacctaccgacccttccaccgtaactaaaccnctaaccgtacctatacggtggtaagttcggaacggtacgccgtagactacgtacgagacccgacgaccggtccttacgttaacgttncggttcacggcgtacccgtaccgaacgttcctacgggngaccgaccccgtagggcctacggggcccttaccgtttagcccggttcggtaccgggg

SEQ ID NO: 206952 - DNA, 765 bp, Homo sapiens
  misc_feature: GYAE6OF01CVPS8.17.25.C03.1.454.CMB.1.raw
  modified_base (175)..(175): a, c, t, g, unknown or other
  misc_feature (175)..(175): n is a, c, g, or t
  modified_base (298)..(298): a, c, t, g, unknown or other
  misc_feature (298)..(298): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtncagctggtgctagtcgtggggctggaggtgaagagccgtggggcctcgagtgaggtctccgtgcaggcttgtggtattctacgtttacctctatagtatcgaacgtgggtgccgcgtaggccncgtacgaacaaccgaccgtggacggtggagtgggatcgggacctaacctaacgtacgtggtacgtcgaacgtagttcgtaccttaccaaccccgtacgtcccggtaccgggactacgtaaccgttaccagtaccggaaccctaacgtaacctccgtaaccaaacgtaaaccacgtaacgtaccctaagtacggtacgggtacggttacggaacgggtaccgtacccgttacggaacctacttacccggtaacggaaacccggtaacccggtacccggggttaccccttaacgtttaaccgtttaccggtacgttaccgggaaaccgttaaccggacccggttaccccgaaaccgggttacggttaccccgggtaggtaaccccggtaccccggtaacgggtccgtaacccggggttacccggttaccctttttaaccgggacccgtttcccgggggttaaccggggg

SEQ ID NO: 206953 - DNA, 647 bp, Homo sapiens
  misc_feature: GYAE6OF01A1GUS.17.25.C03.1.454.CMB.1.raw
  modified_base (219)..(219): a, c, t, g, unknown or other
  misc_feature (219)..(219): n is a, c, g, or t
  modified_base (291)..(291): a, c, t, g, unknown or other
  misc_feature (291)..(291): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctnagtgaggtctcctgcaggcttctggattcacgttttacctcctatagtatcaacgtgggtcgcgccaggccncgtggacaacgacctggagtggatgggagtcgggaccgaaaccctaagtacgtggttcgtacacgtaggttcgttccttccaccctactcccggtaccgggacacggtaccttaaccgatacggaaccacgtaaccttcccgtacaactaaacgacacggtaccctaagagtagggtacgttaggaacggtacgccttaggaactacgttacgaacgaccgaaccgtccggtccgttacttattcgtggtacgccggtagtacccgtcccaacggtccgttacgggtacgtacggtccccgtacgggtacccagggttccccggaccttttcgggacgtttcccgggtaccggggg

SEQ ID NO: 206954 - DNA, 617 bp, Homo sapiens
  misc_feature: GYAE6OF01AN4F1.17.25.C03.1.454.CMB.1.raw
  modified_base (283)..(283): a, c, t, g, unknown or other
  misc_feature (283)..(283): n is a, c, g, or t
  modified_base (337)..(337): a, c, t, g, unknown or other
  misc_feature (337)..(337): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtgcccactcccaggtgcagctggtgcagtctggggctggaggtgaagaagcctggggcctcgagtgaaggtctcctgcaaggcttctggattcacgtttacctcctatagtatcaactgggtncgccaggccgctggacaacgacctggagtggatgggatgggaccgaaaccctanacgtggtgtcacagtgtcttcacccactccgccgggacagtacttaccatcgaccacgacctccacactaaacacacgcctacagtacggagttacggaggtacgccgtagactagttcgagaccggacgaccgggtccgttacttacgttacgtggtaccggcggtacggtaccggtaccccgaacggtccgttcccgggtacgtacccggtacccgttaccgggccgtaccgggtcccggttaccgttttcgggaccgttttccgggtacccgggggg

SEQ ID NO: 206955 - DNA, 751 bp, Homo sapiens
  misc_feature: GYAE6OF01AMAVE.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtctcctgcaggcttctggtattcacgtttacctcctatagtatcgtaacgtgggtgccgccgaggcccgcgtacggaaccaaccgaccgtgaggtagggagtggggagtcggggaccgaaaccctaacgacgtggtcgtaccgacgaggttcgtacctttccaacccctacgttcccgtacccggggaactaacggtaccttaaccgagtacccgaacccgtaaccgtaacccttcccctaaccctaaactaaaacccacccgaacgtacccctaacgtagtacggggttaacggttacggaacgggtaccgtaccgttacggaacctacgttaccggtacggaacccgacccggtaacccgggtcccgtttaaccttacgtttaacggtcggtacggacggacggtacccgtaccccgaaccggtccggtacccggggttacgacccggttacccggtaaccgggccgtaccgggtcccggttacccgttttcgggacccgtttcggggtacccggggg

SEQ ID NO: 206956 - DNA, 837 bp, Homo sapiens
  misc_feature: GYAE6OF01C7X7B.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtgcagcagctacaagtcgcccactcccaggtgcagctggtgcagtcgtggggctggaggtgaagagccgtggggcctcgaggtgaacggtcctccgtgcgtaaggcttcgtggtattcctacgtttacctcctattagtactcgaacgtgggtcgaccgccgagggcccgtctacgggaaccaaccggcctggaaggttgggagtgggagtcggggaacctaacccctaaacgcgtagggtctacaccgtaggttcgttccttaccgaaccccgtacgtcccggtacccggggaactaacggacccttttaaccgactccgggaacccctaaccgtaacccttcccctaacccaaacgttaaaacccaccgtacgaccccgttaaacaggttacgggtaaggtttacgggaaacgggtccgtacccgtttagggaacccttaacggttcccttaacgggaaccccgggtaaaccccggtacccggggtttaacccgttaccgtttaacgtttaacccgggtgttaaccgggtacccgtaaacggggttaccccgtacccccggtaaacggtacccgggtttaacccggggacgggttaaccggtacccccggttaacgggtacccggtacccgggttacccggggtttccttttttacccggggacccggttttccgggggtaccccggggggg

SEQ ID NO: 206957 - DNA, 582 bp, Homo sapiens
  misc_feature: GYAE6OF01AXPU5.17.25.C03.1.454.CMB.1.raw
  modified_base (465)..(465): a, c, t, g, unknown or other
  misc_feature (465)..(465): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggaccaacgacctgagtggatggggatcggggacgaaacccctaacgacgtgggtgtcaacgaggttcgtcctttccaacccctagtcccgtaccggggaccacgtaccttacccagtcgaacccacgaacctccctaccaataaaccacacgcctacatggagttgaggacncctgacagtctgacgacacggtccgtactattactgtcgcgagacgtaccccagacgttcccgggtgacgcccgtacgggccacggtccggtcccttttcggccgtttcggtcgggg

SEQ ID NO: 206958 - DNA, 712 bp, Homo sapiens
  misc_feature: GYAE6OF01B6C6D.17.25.C03.1.454.CMB.1.raw
  modified_base (212)..(212): a, c, t, g, unknown or other
  misc_feature (212)..(212): n is a, c, g, or t
  modified_base (243)..(243): a, c, t, g, unknown or other
  misc_feature (243)..(243): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccnggggcctcagtgaaggtctcctgcaggcttntggattcacgtttcctctatagtatcaactgggtcgcgccaggccgctggacaacgacctggaggtggagtgggagtcggggaccgaaccctaacgacgttgggtcgtacgacgtaggttcgtaccgttaccaccctacgttcccggtaccgggaacacggtaaccttaccaacgttacgaaccctaaccgtaacccgtaccctaaccgtaaacttaaaacccacgtaaccggtaccctaactaggtacgggtaaggttacggaacgggtacgacccgtaaggaacccgtagttaccgtcggaaacccggtacccggtaacccggggttcccgttacttaacgtttaacggtcggttaaccgggccggtaacggacccgttacccgaaccgggtacgttaccgggtacgaccggtcccgtaacgggacgacggtccggttactttcgggtaccgttccgggtacggggg

SEQ ID NO: 206959 - DNA, 646 bp, Homo sapiens
  misc_feature: GYAE6OF01DCSHB.17.25.C03.1.454.CMB.1.raw
  modified_base (218)..(218): a, c, t, g, unknown or other
  misc_feature (218)..(218): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagctggggcctnagtgagtctcctgcaggcttcgtggattcacgtttacctcctaatagtatcaacgtgggtgcgcgaggccgcgtaggacaaccgactgagtggatggggatgggacaaccctaagacgtggtgtacagtagttcgtccttacacccctacgtcccgtcccgggactaacgtacctttaacgactaccgaccaaccgtaacctcccgtaacctaataaaaccaccgtacgacccttaacgaggttagggtacgttacggaggacgtcccgtaagaccgtatcgtacgtaaccgaccgtaccgggtacccgttacgttaacttaccgtggtacggcggtacgaccggtcccgaacggtccgtaccgggtcggacggacccgttacgggcgtacggtccggtcttttacgggccgtttcgggtaccggggg

SEQ ID NO: 206960 - DNA, 678 bp, Homo sapiens
  misc_feature: GYAE6OF01DXH4Z.17.25.C03.1.454.CMB.1.raw
  modified_base (487)..(487): a, c, t, g, unknown or other
  misc_feature (487)..(487): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagcctggggcctcgagtgaaggtctcctgcaaggcttctggattcacgtttacctctatagtatcaacgtgggtcgcgccaggtcctgtacggaacaacgacctggagtggagtggggagtcggggacctaaacccctaacgacgttggtcgtcacgtagtcgttccttaccaccctagtccccgtaccgggactacggtaacctttaccagttaccgaaccctaaccggtaaacccttcccgtaaccaaacttaaaacccaccgtacgaacccctaanacgttagggtagtttacggaaggtacgtccctagtacctagtccaggaaccgaaccgtaccgggtcccttacttacttaccgtgtacgacggtacgtaccgtacccgacggtaccgttacccgggtagacccggtacccgtacgggacgtacggtacccggttccttttacggccgtttcgggaccggggg

SEQ ID NO: 206961 - DNA, 654 bp, Homo sapiens
  misc_feature: GYAE6OF01EO4P2.17.25.C03.1.454.CMB.1.raw
  modified_base (243)..(243): a, c, t, g, unknown or other
  misc_feature (243)..(243): n is a, c, g, or t
  modified_base (483)..(483): a, c, t, g, unknown or other
  misc_feature (483)..(483): n is a, c, g, or t
  modified_base (516)..(516): a, c, t, g, unknown or other
  misc_feature (516)..(516): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagccgtggggcctgagtgaaggtctcctgcaaggcttntggtattcgtacgtttacctccttatagtatcaacgtgggtgccgccgtacgggcccgtcgtacgggaaccaaccggacccgttggaggtgggagttggggacgttcggggaccctaaacccgtaacgtacggtggtgtaccacgtagttcgttccttccaccctactcccgtaccgggacacgtaccttaccagtacgaacccacgaacctcctaccaataaaccacaacgtacctaanacgtaggtacgttagacggtacgtcctgaactntacgtacgaccgtaacccgcgggtacctacgttagttaccgtggttaccggcggtaacgtacccgtacccacggtacgttccggtaggaccgtccgtacggcgtacggtccgttccctttgccgttcgggtaccgggg

SEQ ID NO: 206962 - DNA, 747 bp, Homo sapiens
  misc_feature: GYAE6OF01CMLWF.17.25.C03.1.454.CMB.1.raw
  modified_base (216)..(216): a, c, t, g, unknown or other
  misc_feature (216)..(216): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtgcagcagctacaagtgcccactcccaggtgcagctggtgcagtcgtgggctgaggtgaagagcctgggcctnagtgaagtctcctgacaggcttcgtggtattcacgtttactcctatagtatacgaacttggtcgcgtccaggcccgtcgtacggaccaacggaccgtggaaggtggagtcggggagttacggggaccgtaaacccctaaagccgttgggtacgttaccacgtacggttcgttacccgtttacccaacccgtacgttccccgtaacccggggtaccaaacgttacccgttaacccgtagtaccgacctaaaccgtaaccctttaccccgtacctaaaactaaacccgaaccgtaacgtaaccccttaagaacggttgggtaaccggtttagggaacgggtaaccgcccgttaagaaccgtacgttcggtacggaaccgtaccgtaaccgggtccctttactaacgtttccgaggttaccgacgtacggtaacccgttccgaaaccggtccggttaccgggtagtaccggtacccgtaacgggtacccgacggtcccgggttacctttacggtccgtttcggggaacccgggg

SEQ ID NO: 206963 - DNA, 875 bp, Homo sapiens
  misc_feature: GYAE6OF01D9SCM.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtggaaggtctcctgacgaaggtcttcgtggtactttccgtaaccgttttaccccttacccgttaagttaacggttaacttacctaaacggttgggggtcgcccggcccgaagggggtccccgcggtacgggaaacccgaaaacccggtacccgttaggaaggggttgggaacggtttgggggaacgttcgggggaaccccgtaaaaacccccttaagtacccggtgggttaccgtaccgtaaccgtaggtttcgttacctttacccgaaccccgtaaccgttccccggtacccgggggaacctaaccggttaaaccctttaacccgaacgttaccggaaccccgtaaaccgtaacccttacccccctaacctaaaacttaaaaccccgaaccgtaaccgaacccttaacgtaggttaccgggttaaggtttacgggaacggtaccgtacccgtaggaaccctagttcccgtaacggaaccccggtacgaccccggggttccgtttaaccttaacgtttaccgtaggtccggaacggtaaccggtaccgttaccccgaagggtaccgttcccgggtaggacccgtaccccgggtacgggaccgtacgggggtaccctttaccggttttacggtcccggtttcgggtacccgggggg

SEQ ID NO: 206964 - DNA, 658 bp, Homo sapiens
  misc_feature: GYAE6OF01C3NRN.17.25.C03.1.454.CMB.1.raw
  modified_base (220)..(220): a, c, t, g, unknown or other
  misc_feature (220)..(220): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggcctnagtgaaggtctccgtgacaaggcttcgtggattctacgtttacctccgtatagtatacaacgtgggtcgcgccaggccgcgtcggaacacgaccgtggagtggagtggggatcgggaccgaaccctaacgacgtgggtacgtcgtaacgtagttcgttacccttccgaaccctacgttccccgtacccggggaactacgtaaccttacccacgtacgaaccctaaccgtaaccgtcccctactaactaaaccacaccgacctaactacggtggtaacgttggaacggcgaccgtcgactatcgtaggaaccgacgtccggtccttacgttagttaccgtgtcgacggacgtaccgtacccgaacggtacgtcccgggtacgtacgtccccgttaggcccgtacggtcccgttcgtttaccgccgttggtacccggggg

SEQ ID NO: 206965 - DNA, 915 bp, Homo sapiens
  misc_feature: GYAE6OF01CYMEM.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcgagtcgtggggctggaggtagaagaacgccgtggggcctcgaggtgaaggtctcctgacgtaggtcttcgtggtactttaccgtaaccggtttttaccctaccttaagttacgttaacgttccgtaaacggttcggggttcggaccggtcccgaacggggtccccggtacggtaccgggaaacccgtaaaccggtacccgttgggtaacgggttagggaggttacgggggacgttaccgggggaacccgtaaaaccccgtaaacgtaccgttacggggttaccgttacgaaaccggttcggtttaccggttacccctttaacccgaaccccgttaccgttacccccgggtacccgggggaacctaaaccggttaaccccgttaacctaacgtccggtaaacccctaacccggtaaccccttaccccgtaacctaaacgttaaacccaaccgtaaccgtacccttaacgacgttacgggtacgtttacgggacgtaccgtccgtaacgacctaacgttcgttaaccggaaccggtaacccgtaccggggttacccgtttacgtaacgtttacggtacggttaccggaaccggtaaccggtacccggttaccccgaacgggttaccgtacccggggtacggaaacccgggttaccccgtaacggggtacccgtaccgggttaccccggttaccggttttaaccggccgggttttccggggtaaccccggggg

SEQ ID NO: 206966 - DNA, 942 bp, Homo sapiens
  misc_feature: GYAE6OF01A6SMI.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaacgccgtggggcctcgagtgaacggtcctcctgcgaaggcttcgtggacttctacgtttacctcctatagtactcgaactgggtcgcgccgtacggcccgtcgtacggaaccaaccggaccgttaggaggttcgggaaggttacgggggacgtacggggtacccgtaaaaccccgttaacgacggttacgggttacgtaccgtaaccgtaagggttccgttaccgtttacccaaacccccgtacgttaccccggttaccccgggggtaaactaccggttaaaccgtttaacccccgtaaagttacccgggaaaccccctaaccggtaaaccccgtttaacccccttaaccaaaacgttaaaacccaacccgttaacgtaaccccttaaacggtaacggtttacggggttaacgggttacgggaaaaccgggggtaccttacccccgggttaagaacccgttaaccgtttcccgggaaaccggtaaaccccgggtaaaccccgggttaccccggggtaaccccgttttaaccggtttaaacgttttcccggttacggggttaaccgggtaaccccgggtaaacggttacccccgtaacccccggtaaacgggttacccggttaccccgggggtagggtaaaccccggacccgggtaaaccggggtccggtaaaccccggggttccgggtttaccccttttaccggggttacccgttttcggggggaaccccggggg

SEQ ID NO: 206967 - DNA, 718 bp, Homo sapiens
  misc_feature: GYAE6OF01B8I06.17.25.C03.1.454.CMB.1.raw
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
  modified_base (338)..(338): a, c, t, g, unknown or other
  misc_feature (338)..(338): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctacctgcaaggtcttcgtggattcacgtttacctctatagtatacaacgtgggtncgcaggtccngtcgacaacgactgagtggagtggagtcggggacaaacccgtaanacgtggtagtcacgtagtcgtcttccgaacccatcccgtaccgggacacgtacttaaccgatcggacctacgaactcctaccaagtaaacacacgtaccctaacgtagtacgggtacgttaggaacgggacgtacccgtacggaactaacgttacgtaccggaaccggtaacccgaaccccggggtacccgtttaaccttaaacggttttaacccgtacgggttaaccgaccgggtaaacggtaacccggttacccccgaaccgggtaacccggttaccccggggtacggtacccggtaccccgggttaccggtacccggtaccgggtccccggggtttaaccgttttaccggtccgtttcccggggttaacccgggggg

SEQ ID NO: 206968 - DNA, 627 bp, Homo sapiens
  misc_feature: GYAE6OF01DQQBD.17.25.C03.1.454.CMB.1.raw
  modified_base (283)..(283): a, c, t, g, unknown or other
  misc_feature (283)..(283): n is a, c, g, or t
  modified_base (343)..(343): a, c, t, g, unknown or other
  misc_feature (343)..(343): n is a, c, g, or t
  modified_base (492)..(492): a, c, t, g, unknown or other
  misc_feature (492)..(492): n is a, c, g, or t
tcagcgtagactagcacgaccggtgctcgatttagtagtgtagatttgggtttggggactcaaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggcctcgagtgaaggtctcctgcaggcttctggattcacgtttacctctatagtatcaacgtgggtcncgccaggccgcgtaggacaacgaccgtggacgtggatgggatcgggacctaaaccctaanacgtggtacgtcaacgtagttcgtccttccaacccgtacttcccgtaccggggactacgtaacctttaccgattacgaacccacgaaccttcctaccaaagtaaaccaacgacttttcccaatagtaggtagttagaggacgtccgtanactatctaggaccgacgccggtctacttagttaccgtgtacgcgtagaccgtcccacggtacgtccggtagacggtaccccgtagggacccgtacgggtacccggttctttacggtccgttcgggtacccggggg

SEQ ID NO: 206969 - DNA, 715 bp, Homo sapiens
  misc_feature: GYAE6OF01BDL4P.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaggtctcctgcaaggcttcgtggtacttctaccgtttacctcctatagtatcaacgtgggtgccgccaggcccgcgtggacaacgacctggaggtggagtgggagtcggggaccgaaaccctaacgtacgtgggtcgtacacgtagtggttccttaccaccccgtatccccgtaccggggacctacggtaaccttaaccagtaccgaacccgaaccgtaaaccctccctacctaaactaaaaccctaacaacgtacctaaccgtagtacgggtaacggtttacggaagggtacgacccgtagaccgtaacttccgttacggtaaccggaaccgtacccgggtaccccgttacgtttaacgtttaaccgttgggtacggaccggtaacggtaccgtaccccgaacggtaccgttaccggggtacggtcggtaccccgtaacgggcggtacgggtcccgggttccgtttacggtccggtttccggtaccggggg

SEQ ID NO: 206970 - DNA, 708 bp, Homo sapiens
  misc_feature: GYAE6OF01CA7JW.17.25.C03.1.454.CMB.1.raw
  modified_base (286)..(286): a, c, t, g, unknown or other
  misc_feature (286)..(286): n is a, c, g, or t
  modified_base (297)..(297): a, c, t, g, unknown or other
  misc_feature (297)..(297): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtagaagagccgtggggcctcagtgaacggtctcctgcgaggcttcgtggattcctacgtttacctcctatagtatcacgtggtnccgcacggccngtggaaccacgcgtgaggtaggagtgggagtcgggacctaaccctagacgtggtctacgacgtagttcgtccttaccgaaccctcgtcccggtaccgggaactacgtaaccttaccgacgtaccgacccaaccgtaccttacccctaaccaaactaaacccacaaccgtcccttaaacgaggttacgggtacggttacggaacgggtacgtaccgtaggtaaccaggttacgacggtacccggtaaaccgtcccgggtaaccgttaccgttaactttaccgttagcgggtacccgaagtaccccggttaccggaccggttaccggtccgggtacggaacccggacccggttcgggacggtaccggtccgggtttaacccgtttcggtcccggttccggggtacccgggggg

SEQ ID NO: 206971 - DNA, 654 bp, Homo sapiens
  misc_feature: GYAE6OF01DVTKB.17.25.C03.1.454.CMB.1.raw
  modified_base (467)..(467): a, c, t, g, unknown or other
  misc_feature (467)..(467): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtgcccactcccaggtgcagctggtgcagtctggggctgaggtgaagaagccgtggggcctcagtgaggtctcctgcaaggcttctggattcacgtttacctcctatagtatcaactgggtgcgcacggccgctggacaacgcctgaggtggagtgggatgggaccgaaaccctagactggtgtacacgaggtgtaccgttccaacccctacgttccccgtaccggggaactacggtaaccttaaccgagtacgaacccaaccgtaaacccttcccgtaacccaactaaaaccaccaacgtaccctanacgttgggtagttggaacggtcgccgtacgactattcgtacggaaccggaccgacggtccgttacttacttacgtggtcggacggacgaaccggtcccgaacggtacgtcccgggttaggaccgtacccggttacgggcgtaacgggtcccggttaccgttttcgccggttttcggtacccgggggg

SEQ ID NO: 206972 - DNA, 686 bp, Homo sapiens
  misc_feature: GYAE6OF01DQA0M.17.25.C03.1.454.CMB.1.raw
  modified_base (489)..(489): a, c, t, g, unknown or other
  misc_feature (489)..(489): n is a, c, g, or t
  modified_base (612)..(612): a, c, t, g, unknown or other
  misc_feature (612)..(612): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggcctcgagtgaaggtctcctgcaaggcttctggattctacgtttacctcctatagtatcaacgtggtcgcgccaggccgtcgtacggacaacgtacctggaggtggagtgggagtcggggaccgtaacccctaacgtaccgtggtcgtacacgtagttcgtaccttccaacccctagtaccccgtacccggggactaacggtaccctttaaccgacgttaccgaaccctaaccgtaaccctcccgtaaccaactaaaccacacgtacctaaacngttgggtagttcgaacggacgtccgtagactattcgacgaaccgaccgaaccgggtcccgttacttagttaccgtggtacggaccggtagcccgttaccccgaacgggtaccgttcccggggngtaccgaccccggttacgggccgtacgggttcccggttaccgttttcggtacccgtttcgggtaaccccggggg

SEQ ID NO: 206973 - DNA, 675 bp, Homo sapiens
  misc_feature: GYAE6OF01BXAV3.17.25.C03.1.454.CMB.1.raw
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggcctgagtgaaggtctcctgacaaggtcttcgtggattcacgttttacctctatagtatcaactgggtncgccaggtccntggacaacgacctggagtcggagtggagtcgggacctaaaccctaacacgtggtactcgaacgtagttcggttaccttaccgaccctacgttcccgacccggggactacggaacctttaaccgactacggtaacccaacgtaaccctccctaaccgtaaacttaaaaccaactacggacccctaataacggttcgggtaaggttacggaacggtacgaccttacggaacctacgtacgtgaaacccgtaccggaccgtacttaccgttaagttaccgtgtacgccggaaggtcccgtacccgtaaccggtccgttaccgggtcgaccgtaccggtaccgtcgaccgggcgttccgtttacggacgttcgggtaccggggg

SEQ ID NO: 206974 - DNA, 713 bp, Homo sapiens
  misc_feature: GYAE6OF01BQ6GT.17.25.C03.1.454.CMB.1.raw
  modified_base (224)..(224): a, c, t, g, unknown or other
  misc_feature (224)..(224): n is a, c, g, or t
  modified_base (662)..(662): a, c, t, g, unknown or other
  misc_feature (662)..(662): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtagaagacgccgtggggcctnagtgaacggtcctccgtgacgaaggtcttcgtggtacttcctaaccgtttaccctccgttaatagtactacgaacgttgggtcgccgccgacggccgcgtacggaaccacgctggagtggagtgggtacgcgggaccgaaaccctacgacggttggtctaccgtacgtacggttcttcccttacccacccctacgttcccggtacccgggtactaacggtaaccttacccgagtacccgaaccctaaccgtaacccttccctaaccgaaacgttaaacccaccgtaaccgaccctaagtacggttacgggttacgtacggacggtaccgtccgtaacgaccttacgtaccgtacggaaccgtaccggtaccggttccgtttaattaaccgttcgtcggacggtaccgaacgtcccgtaccgaacggtccggtaccggngaccgccggtacgccggtcggtcccgttacttcggccgttcgggtaccggg

SEQ ID NO: 206975 - DNA, 572 bp, Homo sapiens
  misc_feature: GYAE6OF01E2345.17.25.C03.1.454.CMB.1.raw
  modified_base (258)..(258): a, c, t, g, unknown or other
  misc_feature (258)..(258): n is a, c, g, or t
  modified_base (278)..(278): a, c, t, g, unknown or other
  misc_feature (278)..(278): n is a, c, g, or t
  modified_base (352)..(352): a, c, t, g, unknown or other
  misc_feature (352)..(352): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaggcttctggattcacgtttaccnctatagtatcaacgtgggtncgccaggccgctggacaacgcctgagtggatgggatgggacgaaccctagacgtggtgacacagtgtctcaccntccgtcggacagtactacagtcaccaacgaactcccacaataaaccacgacgacctaagtagtgggtaagttgaacggatcctaggactatcgtagaaccgacgtaccgcccgttataacgttcgtgtcgacgtacgtacgtccccaaggtccgtaccgggtgaccgacccgttacggacgtacgggtccggtccttttcgacccggttcggtccggggg

SEQ ID NO: 206976 - DNA, 578 bp, Homo sapiens
  misc_feature: GYAE6OF01B8XVC.17.25.C03.1.454.CMB.1.raw
  modified_base (279)..(279): a, c, t, g, unknown or other
  misc_feature (279)..(279): n is a, c, g, or t
  modified_base (289)..(289): a, c, t, g, unknown or other
  misc_feature (289)..(289): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgagtgaagaagcctggggcctcagtgaaggtctcctgcaaggcttctggattcacgtttacctcctatagtatcaactgggtncgccaggccnctggacaacgcctgagtggatgggatgggaccaacctaacactgggtgtcacagtgtcttcaaccctatccgtccgggacagtaaccttaccgatcgacccaacgaacctcctaccaataaacacaacgccctacactgagttgaggagcctagacattcgtaggacgacgaccgtccggttactagttacctggtactcggaagtaccgtccccacggtacgttcccgggagacggtacccgtacgggcacggtcccggtccttttaggacccgtttggtaccggggg

SEQ ID NO: 206977 - DNA, 802 bp, Homo sapiens
  misc_feature: GYAE6OF01DKZQL.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggactccttctttcgttggtggcagcagctacgaagtcgcccactcccgaggtgcgagcgtggtcgcgtaggtcggtggggcgtggagggtaggaagaacggccggtcggggcctcgaggtaggtaacggtcctcgtggacgtaacggtctttcgtaggtactttccgttaccggttttacctcgttaagttacgttatacgtaacgttggggtcgccggtaccggacgggcccgtcgtacggaaccgaaccgtaccgtaggaggtaggaggtagggacgtcggggaccgtaaaacccgtacgtacggtacggttcgtactaacgttaggttccttacccgttacccgaacccgtacggttacccggtacggtaacctaccgttaacttacccgaagttaccggaacccgtacgtaacccgtacctaacccgtaaactaacccgaacgtaccggtaaccctaagtacggttacgggtaaggttacggacggtacgtacccgtagtactccgtaacgtacgaaccgaccggtacccgggtaccttaacctttacgttacgtcggaccggtacgtaccgtaacccgacccggtacgtcccggtaccgggtacgtccggacccggtacgaccggtacggttccgttccggttacgtccggttcccggggtaccgggg

SEQ ID NO: 206978 - DNA, 820 bp, Homo sapiens
  misc_feature: GYAE6OF01BMG45.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaggtctcctgcaaggcttctggattcacgtttacctcctatagtatcaacgtgggtgcgccaggccgctggacaacgcctggagtggatgggatcgggaccgaaaccctaacgacgtgggtcgtacacgtagttcgttaccgttcccaccctacgttccccggtacccggggaactaacggtaccctttaacccaacgttaccggaaccccgtaaccgtaaaccccttccccgttaacccctaaaccgtttaaaaacccaaccccgtaaaccggtacccccgttaaaccgaacgtttacggggtaacggttttacgggaacggggtaaccgtaccccggtttaaggaacccgtaacgttcccgtaacgggaaccccggtaacccggtaacccgggggtaccccggttttaacctttaacgttttaacccggtacggttaccgggaccggtaacgggttaaccggttaccccccgtaacgggtaaccgttaccccggggttaggtaaccccggtaccccggtaaccgggtacccgtaaccggggttaccccgggtttacccgttttcggtacccggtttccgggtaccccgggggggg

SEQ ID NO: 206979 - DNA, 787 bp, Homo sapiens
  misc_feature: GYAE6OF01CF9RC.17.25.C03.1.454.CMB.1.raw
  modified_base (278)..(278): a, c, t, g, unknown or other
  misc_feature (278)..(278): n is a, c, g, or t
  modified_base (299)..(299): a, c, t, g, unknown or other
  misc_feature (299)..(299): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtcgcccactcccaggtgcagctggtgcaggtcgtggggctggaggtgaagtaacgccgtgggggcctcgagtggaaggtctccgtgacaggtcttcgtggattccgaccgttttaccncttatagtatcaacgtgggtnccggaccgagggcccgtcgtacgggaaaccaaccggaccggttaggacgggtagggtagtcgggggaacttcgggggaacccgtaaacccctaaacgacggttgggtcgttaccaacgttaggtcgttacttcccgaaccctccgttcccggtacccgggataaccggtaaccttaacccgaagtccgtaaccgaacccggtaaacccttccctaaccctaaacgttaaaacccgaactaaccggtaccctaaatacggttagggaacggtttaacggacgggtacgtcccttacggaaccgtacgttccggtacggaaccgacccggtaaccgggttacccgttacttaaacgttaccggtggttacccggacggtaacgtcccgggtaccccaacggtccgttacccggggtacgacccggtaccggttccgggaacctacgggttccccggttagttttccggtccgggtttacgggcccggggg

SEQ ID NO: 206980 - DNA, 656 bp, Homo sapiens
  misc_feature: GYAE6OF01C3IJV.17.25.C03.1.454.CMB.1.raw
  modified_base (462)..(462): a, c, t, g, unknown or other
  misc_feature (462)..(462): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagcctggggcctcagtgaaggtctccgtgcgaaggtcttcgtgggtaacttccgtacgttttaccctcctaatagtatacaacgtgggtcgcgccgaggcccgctggaccaacgccgtgaggtggagtgggatggggacaaaccctaagacgtggtcgtacacgtaggtcgtcttacaccctatcccgtacgggacacgtaaccttaccagtacgaaccacgtaacctccacctaactaaacacgacgacctanacgtaggagttgaacggacgtacctaggactaagttcgacgaaccgaccgtaccggtaccgttacttaacgttacgtggtacgacggtaacggtacccgttaccgaacggtacgtacccgggtaggcccgaacccggttaccggccgtacgggtcccggtcccgttttacggaccggttccggttaccgggggg

SEQ ID NO: 206981 - DNA, 653 bp, Homo sapiens
  misc_feature: GYAE6OF01BIV2W.17.25.C03.1.454.CMB.1.raw
  modified_base (290)..(290): a, c, t, g, unknown or other
  misc_feature (290)..(290): n is a, c, g, or t
  modified_base (302)..(302): a, c, t, g, unknown or other
  misc_feature (302)..(302): n is a, c, g, or t
  modified_base (584)..(584): a, c, t, g, unknown or other
  misc_feature (584)..(584): n is a, c, g, or t
  modified_base (614)..(614): a, c, t, g, unknown or other
  misc_feature (614)..(614): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagccgtggggcctcgaggtgaaggtctccgtgcaaggtcttcgtggtattctaccgtttacctcctatacgtatcaacgtgggtnccgcgaggccgngtacggaccaacgccgtggaggtcggagtgggacgtcgggaacctaaaccctaagacgtggtcgtacgaacgtagttcgtccttaccacctacgtcccgtaccgggaactacggtaacctttaaccgagtacccgaaccctaacgtaacccttacccgtaacctaaacgtaaacctaaccgaaccggtaccctaaacgtaacggttacgggtaaggtttacggaacggtacgtccctaaggactacgtcgtacgaacgaccgaccggtacctcttacgttcngtacgcgactccgacccgaggcgtcggacncgtcgacggcgtcggcgttacctcgtacgtcggaccggg

SEQ ID NO: 206982 - DNA, 839 bp, Homo sapiens
  misc_feature: GYAE6OF01A9OC0.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagcgtggtgcagtcgtgggctggaggtgaagacgtccgtggggcctcaggtaggaacggtctccgtgccaaggtccttgtaggtactttactaccggttttaaccctcttagtaattactaccgaacggtcgggtcgccggaccgacgggtccgtcgtaacggaccaaccggtaccttggaggtaggagtcggggaggtaccgggaaccgaaccccgtaacgtaccggtggtttacgaccgtagttaacgggttacgttcccttaaccctaccccgtaaaggtttcccccggtaaccggggaactaaccggtaacccgtttaaccgaacgtaaccggtaaacccttaacccggaaacccttaccccctaacgtaaaacccggttaaaaccaacgttaacccgaccgtttaaaccgacgggtttaacggggtaaccggtttagggaaccgggtaacgtccgttacgaagttaccccttaggtacccgaaccggtaacccggaccgggtttccggtaaacttagttaacccgtggacggtaccggttaacgacccgttaacccgaccggttacggtacccggttaacggaccgtaacccggtaccgggaccgttaaccgggccctttaacccgggtttctaacccgggttcggtaacccgggggg

SEQ ID NO: 206983 - DNA, 631 bp, Homo sapiens
  misc_feature: GYAE6OF01CEMNC.17.25.C03.1.454.CMB.1.raw
  modified_base (521)..(521): a, c, t, g, unknown or other
  misc_feature (521)..(521): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaaggtctcctgcaggctctggattcacgtttacctcctatagtatcaacgtgggtgcgccaggccgcgtggaccaacgaccgtgaggtggagtgggatcggggacctaaacccgtaacgacgtgggtacgtcgacagttcgtccttaccaccccgtatcccgtaccgggactacgtaacctttaccgaactcgaacccaaccgtaacctccctaccaaactaaaccacacgacctaacagtgggtagtttaggaacggacgcctagaccatcgtacgaccgaccgacggtcccttnttaacgttcgtgtacgacgtagtaccgtacccacggtaccgtcgggtacgcggtacccgtaccgggcgtaccggtccggttacccgtttcgtcgttcccggtaccggggg

SEQ ID NO: 206984 - DNA, 748 bp, Homo sapiens
  misc_feature: GYAE6OF01A1WAJ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggtagcagctacaagtcgcccactcccaggtgcagctggtgcagtcgtggggctggaggtgaagagccgtggggcctcgagtgaaggtctccgtgacaggtcttcgtggtacttccgtacgtttacctccttaatagtatcgtaacgttggggtcgccgccgacgggcccgtcgtaggaaccaaccggtaccgtggacggtgggaagtggggacgttacgggacccgaaaccctacgtacgtcgggtctacacgtagtcgttcctaccaccctacgtcccggtaccgggactaacgtaccttaccagtccgaacccaacgtaacctccctaccaaataaaccaccacgtaccctagaagttacgggtacgttaggacggtacgccgtaggacctaggttcctacggaaccgtaacccggacccggttacccgttacgttaacgtttacggtcggtacggtaccggtaacgggtaacccgtaccccgtaaaccggtacggttaccccggggtacgacccgggccccggttaacggacccggttacgggtacccgggtttacccgtttaccgggtccgtttaccggggccggggggtaaccccggg

SEQ ID NO: 206985 - DNA, 619 bp, Homo sapiens
  misc_feature: GYAE6OF01C3UCU.17.25.C03.1.454.CMB.1.raw
  modified_base (243)..(243): a, c, t, g, unknown or other
  misc_feature (243)..(243): n is a, c, g, or t
  modified_base (280)..(280): a, c, t, g, unknown or other
  misc_feature (280)..(280): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtgggcctcgagtgaggtctcctgcaggcttntggattctacgtttacctctatagtatcaactgggtncgccgacggccgcgtcggacaacgaccgtggagtggagtgggacgtgggaccaaccctaacgacgtggtctcacgtagttcgtcctccacccctatcccgtaccgggactacgtaccttaccgatcgacccaacgtaacctcccgtacaataaccacacgacctaagagtaggagttcggaacggacgtaccgtagaacctacgtcgtaacgaccgacgaaccgggtcctacttaacttacgtcggtacgaccggtaggtacccgtacccgacggtacgttccggtacgaccgtccgtaccggctacggtccggtcctttcggacgttcccgggacggg

SEQ ID NO: 206986 - DNA, 849 bp, Homo sapiens
  misc_feature: GYAE6OF01BLDKW.17.25.C03.1.454.CMB.1.raw
  modified_base (325)..(325): a, c, t, g, unknown or other
  misc_feature (325)..(325): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagacgtccgtcggggcctcgaggtgtaacggtcctacccgtggccaaggtcctttcgtagggtactttccgtaaccggttttaccctaccgttatacgttactaccgtaacgtggggtacncccggtaccgaggtcccgccgttacggaacgaaccgacccgttagggacgtcgggtaaggtacggggtacgtcgggggaaccctaaaaccccgtaacggtacgtcgggtactaccgtaacgtacggtttcgtacccttaccgacccgtaccggtacccggttacccgggaacgtaacccgtaccgttaacaccgttacgaacccgtacctaaccgtcccttaaccaacgttaaacccacgtaacgtcccttaacgtacggtacggtaggttacgggaacgtaccgtaccggtaacgtaccgtacgttcggtaacggtaacctaaccgggttaaccccgtccgggttttaaccttaaccgtttcggttacggtaacggtcccggtaacgggtcccgttaaccccggtaggttaccccggttaacggtcccggggaaaacccttcccccgggtaacgggaccccgtacggggttacccccggtttaagttccggggttaacccgttttacgggggcccccgggggg

SEQ ID NO: 206987 - DNA, 682 bp, Homo sapiens
  misc_feature: GYAE6OF01DVFUP.17.25.C03.1.454.CMB.1.raw
  modified_base (294)..(294): a, c, t, g, unknown or other
  misc_feature (294)..(294): n is a, c, g, or t
  modified_base (307)..(307): a, c, t, g, unknown or other
  misc_feature (307)..(307): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatccttcttcttggtggcagcagctacaagtgcccactcccaggtgcagtcgtggtgcaggtcctggggctggaggtagaagagccgtggggcctcgagtgaggtctccgtgctaggcttgtggacttctaccgtttacctctatacgtatcgaacgtgggtcncgtccgaggccgnggtacgacaacgaccgtgagtggagtgggagtacgggacctaaccgtaacaccgtggtcgtacacgtgtcgtccttcgaaccctcgtacccgcgggtaactaccgtaactaccgagtaccgaacctacgaaccttacccaacgtaactaaacccgactaccgtactaacgtacgtagggtagttacggagtcgtaccgtgtaacagttacgtacggaaccgtaacggccggttaccttaagttaactttacgcggtacgccggtaaagtcccggtacccgaaggtacccggttaggacgggtacccgacccgggtaaccggcgggtaacgttcccgggttaaccgtttcgggtacgtttccgggaacccgggggg

SEQ ID NO: 206988 - DNA, 572 bp, Homo sapiens
  misc_feature: GYAE6OF01A37RU.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcaatcgtggggctggaggtgaagacgcctgggtcctcgggtgagggtctccgtgcaggcttcgtggagcaccttcagcgactatagtttcaattgggtgcgacgggcctctggacaaggcctgagtggagtgggaagatcgtcctatcgttgacacaaccaaactacgacacgagaacttccgaggcagactccacataaccgacggaacaaacgttaacgaacacgaagttaatactgggatcgtagtaacgagcctgtacatcgagaggacgacgggtcttacttctcgttgtgcgaggtataacgttataataacgtctagttcctttacccttttaccaccctttcccttcgtacgttcggcgggtacctcggttaaccccggg

SEQ ID NO: 206989 - DNA, 594 bp, Homo sapiens
  misc_feature: GYAE6OF01CV9RD.17.25.C03.1.454.CMB.1.raw
  modified_base (281)..(281): a, c, t, g, unknown or other
  misc_feature (281)..(281): n is a, c, g, or t
  modified_base (291)..(291): a, c, t, g, unknown or other
  misc_feature (291)..(291): n is a, c, g, or t
  modified_base (368)..(368): a, c, t, g, unknown or other
  misc_feature (368)..(368): n is a, c, g, or t
  modified_base (433)..(433): a, c, t, g, unknown or other
  misc_feature (433)..(433): n is a, c, g, or t
  modified_base (450)..(450): a, c, t, g, unknown or other
  misc_feature (450)..(450): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcgagtgaggtctcctgcaaggtcttctggattcacgtttacctctatagtatcaactgggtncgccaggccncgtaggacaacgcctgagtggatgggatgggaccaaccctaacgacgtggtcgtcacagttcgtccttcaacccctntcccgtccgggacagaccttaccatcgaccaacgtaactcctaccaataaacacacgacctaacnttgggagttagaggacncctagactatctagaaccgacgaccgggtcctacttacttacgtgtacggacgacgaccgtcccgaacggtacgttcccggtggaacccgtcccgtaccgggactacgggtccgttcccgtttacgcccgtttcggtacggggg

SEQ ID NO: 206990 - DNA, 659 bp, Homo sapiens
  misc_feature: GYAE6OF01E283P.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcagtgaaggtctcctgcaaggcttctggattcacgtttacctcctatagtatcaactggtgcgcaggccgctcggacaacgcctggagtggagtgggatacgggacaacccctaagacgtggtgcacgacgtgtcttccaccctacgtcccgtacgggaccacggtaaccttaccatcgaacccgacgaaccctccctaccaattaaacccacaacgtacctaacagttacgggagttacggacggtacgaccgttggaaccttagacctaggaacccggacgtaccgggtccgttacttaacggtttcctgggtacgtaccgagggtacccgttaccccgaacgggtccttaccggggttacgacccggttacccggtaccgggacccggtaacggtccccggttacttttacggaccgtttcgggtaacccgggggg

SEQ ID NO: 206991 - DNA, 756 bp, Homo sapiens
  misc_feature: GYAE6OF01B7H5Z.17.25.C03.1.454.CMB.1.raw
  modified_base (677)..(677): a, c, t, g, unknown or other
  misc_feature (677)..(677): n is a, c, g, or t
  modified_base (682)..(682): a, c, t, g, unknown or other
  misc_feature (682)..(682): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtagaagagccgtgggcctcgagtgaacggtcctccgtgcgaaggtcttcgtaggtactttcctaaccggtttaccctccttaagtagtactacgaacgttggggtcgtccggcccgacgggtcccgtacggttacggaaaccgtaaaccggtacccgttaggacggttacgggaaggttacgggggtaagttaccgggggaaaccccttaaaacccccgttaaacgtaccggttacgggtacgtaccgtaacgttaacggtttccggttaccctttacccgaaccccctacgttccccggtaacccggggactaaccggtacccgtttaccgaacgttaccgaaccccgtaaccgtacccttacccgtaccaaacgtaacctaccaaccgtaccctaacgtacggtagggtacgttacggacgtaccgtacgtacgacagtccgtaagaccgacgacgtcccttagtacttacgngtacncggtacgaccgtaccgagtaccgtcgaggaccgccgtacgcgtaccggtccgtacgtttcgcgttcggtacggg

SEQ ID NO: 206992 - DNA, 606 bp, Homo sapiens
  misc_feature: GYAE6OF01BL1IS.17.25.C03.1.454.CMB.1.raw
  modified_base (280)..(280): a, c, t, g, unknown or other
  misc_feature (280)..(280): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtncgccaggccgctggacaacgacctgagtggatgggatgggcgaaaccctagactggtcgtcacgagtagtccttcgacccctacgtcccgttacccggggaacacggtacctttaaccaagtcgaacccacgtaacctccctaccaataaaccacaacgcctaacagtaggtagttgaggagccctagacatcgtagaaccgaccgacggtcccgtacttagttaacctggtacgcgagtaccgtacccacggacgttcccgggagtcgtaccctaccgggcctaagggtcccggttacctttcggacccgtttcggtaccggggg

SEQ ID NO: 206993 - DNA, 549 bp, Homo sapiens
  misc_feature: GYAE6OF01E0NI5.17.25.C03.1.454.CMB.1.raw
  modified_base (280)..(280): a, c, t, g, unknown or other
  misc_feature (280)..(280): n is a, c, g, or t
  modified_base (414)..(414): a, c, t, g, unknown or other
  misc_feature (414)..(414): n is a, c, g, or t
  modified_base (501)..(501): a, c, t, g, unknown or other
  misc_feature (501)..(501): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgttttacctctatagtatcaactgggtncgccaggccgctggacaacggcctgagtggatgggatggggcaaaccctaacacgtggtgtcactagtgtcttcaccctatcccgtcgggacagacttaccatcgaccacgaactcctcataaacacagcctanatgattgaggacgcctgacatcgtagacgacacgggtccgttactacttacgtgtcgcgagtaccgtcccaagacgtccgggtacgngaccctacggcgacggtccggtacctttcggacttcgggtaccggggg

SEQ ID NO: 206994 - DNA, 739 bp, Homo sapiens
  misc_feature: GYAE6OF01AC3SN.17.25.C03.1.454.CMB.1.raw
  modified_base (257)..(257): a, c, t, g, unknown or other
  misc_feature (257)..(257): n is a, c, g, or t
  modified_base (716)..(716): a, c, t, g, unknown or other
  misc_feature (716)..(716): n is a, c, g, or t
  modified_base (723)..(723): a, c, t, g, unknown or other
  misc_feature (723)..(723): n is a, c, g, or t
tcagcgtagactagcacgaccggtgctcgatttagtagtgtagattgggtttgggacgtcaacaaccacatctgtcctctagagaaaccctgtgagcacagctcctcaccatggacctggacctggaggactcctcttcgttggtggacagtcgagctacagtcgccccacgtcccgaggtgccagctgggtagctaggtccgtgggcctggaggtgaagacgccgtcggggcttcgaagtcgtaaggtccttccgngactacggacctggtggaatatactaccgttacaactaaaagttgtacgtagtggttaagtgggtacgccgaccgaaccgggcccccggaagtaacggggttctgggtacgggttgggggtcggggttacggtaccgtaaggtcgggttaccgttttagggaccggggtaaacggtcgaaacggttggtacgtacgtccgtaagttacgggaaacgttacggacgggttaacggggccttaaacgggtacggtaaccgtacggtaaacccgttcccgggtaaaccggtaccccaacccccggtaaggtacccgtaaactacggttacccgtaacgtagtacccgtacgtaacgtacgaacggtcgacgtgtacgggactcggaactaccgcggtaccgtaggttccttagtacggtgtacgagtacgtacgttgttcagtactggtacccaagtttacngttaacncggtatcttgggtacg

SEQ ID NO: 206995 - DNA, 642 bp, Homo sapiens
  misc_feature: GYAE6OF01DPCB1.17.25.C03.1.454.CMB.1.raw
  modified_base (297)..(297): a, c, t, g, unknown or other
  misc_feature (297)..(297): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctcctgcaaggcttcgtggattctacgtttacctcctatagtatcaactgggtgcgccgaggccgntggacaacgaccgtggagtggagtgggagtggggacctaacccgtaagacgtggtacgtcaacgtaggttcgtctttaccgaccgtacgtcccggtccgggaactacggtaccttaccgatccgaccacgtaacctcctacctaactaaacactacgacctaagacgtacggtagttacgggacgtacgtccgtagacctatcgtaacgacccggaaccgtaccggtccgttacttaagttcgtcggtcgacgtaccggaccgtcccgaacggtaccgtccgggtagccgacccgtacggaccgtacggtccggtttaccgttacgtccgttcgggacccggggg

SEQ ID NO: 206996 - DNA, 771 bp, Homo sapiens
  misc_feature: GYAE6OF01EN48H.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcacatgactggacctggaggatcctcttcttggtggtcagcagctacagtcgcccactccgaggtgcacgcgtggtcgactagtcgtgggctggaggtagaagagcgtcgggctcgagtaggagtcctactgacgaaggtcttacgtaggtacttactaaccgtttacctaccttaagtaacgttactaccgtaacggttgggtacgccgacgacgggtccgcgttaacggaaccaaaccggtaccgtggtaagggtaggtaaggtcggggtacgtacggggaaaccgtaaaaccccgtaaacgtacggtggtttaaccggtacaaaccggttagggttccggttacccgttaaccctaaccccgtaccgttacccggtacccggggaaacctaaacgtaaccctttaacgaacttaaccggaaccctaaccggtaacccttaccctaaccgtaaaactaaacctaacgtaactaaccgtaacgtagtacgggtagttagaagtacgtacctagactagaccgtaggaaccgtaccgtaccgggttactacccttaagttaccgtagtacggaccgtacggtacccgtacccgtaacgtaccggtcggacggaccgtcggtaaccgcgaacggtcccgttagtaacgtcgtacgggtaccggg

SEQ ID NO: 206997 - DNA, 722 bp, Homo sapiens
  misc_feature: GYAE6OF01DJ5QK.17.25.C03.1.454.CMB.1.raw
  modified_base (223)..(223): a, c, t, g, unknown or other
  misc_feature (223)..(223): n is a, c, g, or t
  modified_base (288)..(288): a, c, t, g, unknown or other
  misc_feature (288)..(288): n is a, c, g, or t
tcagcgtagactagcacgaccggtgctcgatttagtagtgtagatttgggtttggggactcaaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagagccgtggggcctnagtgaggtctcctgcgaggcttcgtggtattctacgtttacctcctatagtatcgaacgtgggtnccgccgacgggccgcgtggaacaacgaccgtggaggtggagtgggagtcgggaacctaaccccgtaagtcgtagggtctcgaacgtagttcgtccttacccacccctacgttcccggtacccggggaactaaccggaacctttaccagtaccgaaccctaaccgtaaccctccctaacctaactaaaccgacacgtaccctaacgtacgtagggtacggttaggacggacgtacctggaactagtccgtaggtaaccgaaccgtacccggttccgttacttaacgttacgttggtacgaaccggtaacggaccggttaccccgaaacgggttacccgttaccgggtacggtaacccggtacccggttaccgggacgttacggggtacccggttccggttttaacggtcccgggtttccggggtaacccgggggg

SEQ ID NO: 206998 - DNA, 740 bp, Homo sapiens
  misc_feature: GYAE6OF01CH0CT.17.25.C03.1.454.CMB.1.raw
  modified_base (189)..(189): a, c, t, g, unknown or other
  misc_feature (189)..(189): n is a, c, g, or t
  modified_base (306)..(306): a, c, t, g, unknown or other
  misc_feature (306)..(306): n is a, c, g, or t
  modified_base (318)..(318): a, c, t, g, unknown or other
  misc_feature (318)..(318): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccgaggtcgcagcgtgggtncgtaggtcgtgggctggaggtgaagacgccgtcggggcctgaggtagaaggtcctccgtgacgtaaggtcttcgtaggtacttcgtacgtttacctctatagtatacacgtgggtcncgccgaggccgngtacggaaccacgcgtgaggtggagtgggacgtacgggaccctaaaccgtaacgtacggtgggtactaccgaacgtaggttccgttacccttacccgaacccgttaccgtcccggtacccgggaactaaccggttaacccttacgaacgtaccgaaccccgaaccgttaaccctacccgtaaccaaactaaaccacgtaaccgacctaacgtagtacgggtaggtttacggaacggtacgtaccgtaacgactacgtacgtacggaacccgaccggtacccggttaccgttaacgttaacttaccggtggaccggtacgtaacggtcccgtacccggaacgtccggtaccgggtagacccgtacccgtacgggacccgacggttcccggttactttccgggtaccgtccgggtacccggggg

SEQ ID NO: 206999 - DNA, 565 bp, Homo sapiens
  misc_feature: GYAE6OF01DND99.17.25.C03.1.454.CMB.1.raw
  modified_base (280)..(280): a, c, t, g, unknown or other
  misc_feature (280)..(280): n is a, c, g, or t
  modified_base (465)..(465): a, c, t, g, unknown or other
  misc_feature (465)..(465): n is a, c, g, or t
  modified_base (489)..(489): a, c, t, g, unknown or other
  misc_feature (489)..(489): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggacgaaccctaacacgtggtgtccaacgtaggttgtcctttccaacccctagttccccgtaccgggggacacggtacctttaaccattcggaacccacgtaacctcctaccaataaaccacacgcctaacagtggagttgaggacncctgacatctgacgacacggcctnttatactgtcgcgagacgtcccagtactccggtgcgaccgtacggactacggccgtctttcggacttcggacgggg

SEQ ID NO: 207000 - DNA, 926 bp, Homo sapiens
  misc_feature: GYAE6OF01BXUIW.17.25.C03.1.454.CMB.1.raw
  modified_base (311)..(311): a, c, t, g, unknown or other
  misc_feature (311)..(311): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagaacgccgtggggcctcgaggtgaacggtcctccgtgcaaggtcttcgtggtactttccgtaccgttttaccctaccttattagtacttacgaacgtggggtcnccgtccgacgggcccgcgtacggaaccaaccggaccgtggaggtacgggaggtggggacgtacggggaccgtaaaaccccgtaacgtacggttggtacggtcacgtaagttcgttacccgtaccctaccccgtaacgttccccggtacccggggtaacctaaccggttacccgtttaaaccctagtacccggaaaccccgtaacccggtaaacccttccccctaaacccggtaaacttaaaaacccgaaccccgtaaccggtaaccccttaaacgtacggttaacgggttaaccgggtttacggaaaaccggggtaccgtacccgtaaacggtacccgttaaccgtttcccggtaaacggaaccccggggtaacccggaacccggggtttaccccccgtttaaccgttttaaacgtttaaccgggttccgggttaaccgggacccgggtaaaaccggttcccgggtaaacccccggtaacggttaccccggggttacccgggttacggaaccccggggttacccggtaaacccgggtcccgggtaaccgggttacccccgggtttacccggtttttaacccgggtacccggtttcccgggggttaccccgggggg

SEQ ID NO: 207001 - DNA, 598 bp, Homo sapiens
  misc_feature: GYAE6OF01CZ2UU.17.25.C03.1.454.CMB.1.raw
  modified_base (282)..(282): a, c, t, g, unknown or other
  misc_feature (282)..(282): n is a, c, g, or t
  modified_base (426)..(426): a, c, t, g, unknown or other
  misc_feature (426)..(426): n is a, c, g, or t
  modified_base (464)..(464): a, c, t, g, unknown or other
  misc_feature (464)..(464): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcctggggcctcgagtgaaggtctcctgcaggcttctggattcacgtttacctcctatacgtatcaactgggtncgccaggccgcgtacggacaccgtacctgacgtggatgggatgggaccaaccctaacgactgggtctcaacgtaggttcgtccttacgacccctagtcccgtaccggactacgacttaccactcgaccacgtactcctaccaanaaccacacgctacatagggtattggaacgacgccgtanacatctcgaacgacgaccggtcgtacttgttaactgtacgcgacgtcggtaccccaggtaccgtccgggtagaccggacccgttaccggacgtaccgggccggttacccgttcgtcccgtttcggtaccggggg

SEQ ID NO: 207002 - DNA, 694 bp, Homo sapiens
  misc_feature: GYAE6OF01BL2LP.17.25.C03.1.454.CMB.1.raw
  modified_base (219)..(219): a, c, t, g, unknown or other
  misc_feature (219)..(219): n is a, c, g, or t
  modified_base (281)..(281): a, c, t, g, unknown or other
  misc_feature (281)..(281): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctnagtgaaggtctcctgcaggcttcgtggattctacgtttacctctatagtatcaaagtgggtncgcacggcgctggacaacgctggagtggagtgggatcgggaccgtaaccctaacgacgtcgggtactccaacgagttcgtccttaccaccccgtacgttcccggtaccggggaactaacggtaaccttacccgacgtacgaaccctaaccgtaaccttacccttaaccaaacttaaaccgaacctaccgtaccctaacgtacggtacgggtagttacgggaacggaccgtacccgttagaaccgtacttaccgaacggaaccgacccggtaccggtcccgtttacttacgttaaccggtgtaccggaggtaccggtaccgtacccgacggtacgttcccgggtaggaccgtacccggtacggacgtacgggtcccggttacccgtttacggtccgtttccgggaaccgggggg

SEQ ID NO: 207003 - DNA, 707 bp, Homo sapiens
  misc_feature: GYAE6OF01CPHQD.17.25.C03.1.454.CMB.1.raw
  modified_base (176)..(176): a, c, t, g, unknown or other
  misc_feature (176)..(176): n is a, c, g, or t
  modified_base (539)..(539): a, c, t, g, unknown or other
  misc_feature (539)..(539): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttggtggcagcagctacaagtcgcccactccaggtncagctggtgctagtcgtggggctaggaggtagaagaacgtccgtcggggccctcgaaggttggaacggttcctccgtcggacgtaaacgggtcctttcgtagggtaactttacctaaccggttttacctaccttaagttaagttactactaaacggtggggtacgccgaccgacgggccggttcgtacgggaaacctacggtaacccgttggtaaggttgggaagtacggggtaacgtacggggaaacccgtaaacccctaaacgtacggttacgggtacgtacgtaacgagtttccgtaccttccaaccctacgtcccggtacgggacctacgtaccttacactacgaaccaacgttaaccncccttaaccaataaaccacgacgaactaacagtacgggtataggaacgcgcctagactagtcaagacgcgaaccggtctactatacaggtccacgactcggacctacgtaacgtccggtaagccggctaccgggactacgggtacgttcctcggtcgtcgggtacggg

SEQ ID NO: 207004 - DNA, 725 bp, Homo sapiens
  misc_feature: GYAE6OF01EOQ4C.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggagactcctcttcttggtggcagcagctacaagtcgcccactcccaggtgcagcgtggtgcagtcgtggggctggaggtgaagaacgccgtggggcctacgaggtagaacggtcctcgtgacgtaggtcttcgtggtattcctaaccgtttacctcttaatagtatactaacgtggtcgccgaccgacggccgtcgtacggaacctaacgtccgtaggtacggtggaacgtgggtacgtcgggtaccgaaaacccgtagaaccggttggtacgtacgaacgtgtcgttaccgtaccctacccgtaaccgtcccggttaccgggaacctaccgttaaccgttaccgtaatacccgaaccctaaaccgtaccttacccaacccgtaaattaaaccacccgtaacgaccctagtaacgtggtaacggttgaccggaagtcccgtagtaactaacgtaccgtacgggtaacgacccgttaccgggtaccctttaacgaccttttaagcggtaccgtaaggaccggttacccgaaccgtcgtacggtacccggcgaccgtaccggcggactcggtccggttactcggtccggtcggtaaccggg

SEQ ID NO: 207005 - DNA, 931 bp, Homo sapiens
  misc_feature: GYAE6OF01C18ZW.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggggctggaggtagaagaacgccgtcgggggccctcgaggtaggaacggttcctccgtgacgaagggcctttcgtgggtactttacctaaccggttttaaccctccgttaagttaacggttacttaccgtaaaccggttggggttacgaccgacccggacgggcccgtcgttacgggaaaccaaccggaccgtaggaagggttgggaaggtggggaacggttccgggggaaaccctaaacccccgtaaacgtccggttagggttaccgtaccgtaaccgtaggttccggttaccctttacccgaaccccgttaaccgtacccccgggtacccggggtaacctaaccggttaacctttaaaccccgaagttacccggaaaccccgtaaacccggttaaccccgttccccttaaacctaaacctaaaaacccgtaacccctaacccgggtaacccttaaaccgtacgggtttaacgggtaaacggttttacggggaacggaaccgttcccgtaacggaaccctacgttacccggtaacggaaacccggtaaccggtacccggggtacctttaaccgtttaaccgtttacggtcggttacgtaaaccggtacgggtacccggttacccgaacccgggttccggttacccggggtacgtacccggtaccccggttacggggacctacggggttacccccgttggttttaaaccccggtcgtttcccgggggtaacccggggg

SEQ ID NO: 207006 - DNA, 591 bp, Homo sapiens
  misc_feature: GYAE6OF01AWZOI.17.25.C03.1.454.CMB.1.raw
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
  modified_base (312)..(312): a, c, t, g, unknown or other
  misc_feature (312)..(312): n is a, c, g, or t
  modified_base (332)..(332): a, c, t, g, unknown or other
  misc_feature (332)..(332): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctccgtgcaaggcttctggattcacgttttacctccgtatagtatcaactgggtncgcaggccgntggacacgacctgagtggangggatgggccaaacccctanaccgtgggctacacaggtcgtcttcacccattccgtaccggggactagaccttaccattacgaccgaaccgtaactccctaccgaaactaaaccactacgacctaacagtacggtagttgaacgggctccgtagacgtacttcgacgacgacgtaccggtccgtacttagtcgtgtcgcgtagtaccgtccacgtcgtccgggcgacgtccgtaacgggcaacgggccgtacgttttcggcctttcgggtacccggggg

SEQ ID NO: 207007 - DNA, 782 bp, Homo sapiens
  misc_feature: GYAE6OF01EQIGP.17.25.C03.1.454.CMB.1.raw
  modified_base (305)..(305): a, c, t, g, unknown or other
  misc_feature (305)..(305): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtcgacccacctcccgaggtgcagcgtggtgcagtcgtgggctggaggtagaacgagccgtggggcctcgaggtgagtcctcgtgacgtaggtcttcgtaggtacttcctaccgtttaccttctatagtactcgtaacgtgggtcnccggtccgacggtccgacgtacgggaccaaccggtaccgtaggtacggtagggtaggtagggtacgtcggggaacctaaacccgtaagtcggtaggtctacacgtagttcgtcttacacctcgtccgacggataccgtaccttacacgtccgaacctaccgtaaccctccgtaaccaacgtaaaccacgtaaccgtactaaggagttaccgggtagttaccgggaggtaccctaccggtacgtaactagtcccggtaaaccgggtccgtaaacccggtccccgggttaaacgtttccgttaaacgtttaccgggttacgggaacgtaccggtaaacccggttccccggtaaacccccgtacgggttaaccgtcccggggaaccggttaaccgggtacccccggtacggtacccggtaccgggttaccccccggtttgtttttacccgggacccggtttacgggggtaaccccggggg

SEQ ID NO: 207008 - DNA, 776 bp, Homo sapiens
  misc_feature: GYAE6OF01CT4OF.17.25.C03.1.454.CMB.1.raw
  modified_base (251)..(251): a, c, t, g, unknown or other
  misc_feature (251)..(251): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttggtggcagcagctacaagtcgcccactcccaggtgcagcgtggtgcagtcgtggggtctggaggtgaagaacgccgtggggcctcgagtgacgtctcgtgctaggctcnggtacttctaccgtttacctcgtatagtactacgtaacgtgggtcgaccggccgacgggtcccgtacgtacgggaaccgtaacccggaccgttaggtacggtacgggtacgtacggggtaacgtacgggggtaccccgaaaacccgttaaccgaccggttagggtaccgttacccgaagtaccgggtttacggttaccctttaccccgaaccccgtaaccggtttaccccggtacccggggtaaacctaacccgggttaacccttaaacccgtacgttacccggtaaaccccgtaacccggtaaaccctttaccccgtaacccgttaaaccgtaaaacccgacccgtaaaccgtacccctaaaccggtaggtacgggtaagttaacggacgggtaccgtccgtacgtacaacgtcgtacggaaccgacgtacccgtccgttacgttactacgtgcgagtacgcccgtaacgacgtcgtcgcgacgtccgtacggcgtacggtacctcgttacgcgttggaccggg

SEQ ID NO: 207009 - DNA, 712 bp, Homo sapiens
  misc_feature: GYAE6OF01BBNOI.17.25.C03.1.454.CMB.1.raw
  modified_base (601)..(601): a, c, t, g, unknown or other
  misc_feature (601)..(601): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctgaggtgaagaagccgtggggcctcgagtgaaggtcctccgtgacaaggtcttcgtggtattcgtaccgtttacctccttatagttactacgaacgtgggtacgccgccgaggtcccgcgtacggaactaagtcgaccgtggaggtcggagtcgggagttcgggaccgaaacccgtaacgacgttaggtcgtacgaacgtacggtcggtacctaccacccgtaccgtcccgtacccgggacaacgtaccgtaccgagttaccgaaccgtaccgtaacctccctaccaaacgtaaaccaccgaaccgaccttaacgagttacggaaggttacggacggacgtacctagaacctacgtcgaacggtacccgaaccggtacccgtacccgttacgtaccgtttacgnggtaccgaccggacgtaacccggtaccccgtacggtcccgtaccgggtacgtaccggccggtaccggaccggtaccgggtaaccggttcccgttcggtacccgttccgggg

SEQ ID NO: 207010 - DNA, 726 bp, Homo sapiens
  misc_feature: GYAE6OF01EVPSG.17.25.C03.1.454.CMB.1.raw
  modified_base (565)..(565): a, c, t, g, unknown or other
  misc_feature (565)..(565): n is a, c, g, or t
  modified_base (615)..(615): a, c, t, g, unknown or other
  misc_feature (615)..(615): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggactcctcttcttgggtggcagcagctacaagtcgcccactcccgaggtgcagcgtggtgcagtcgtgggctggaggtgaagacgccgtgggcctgagtagtacggtcctccgtgacgacggtcttcgtggtacttccgtaccgtttaccctactatacgtactacgacgtgggtcaccggcgacggcccgacgtacggaaccaccgccgtagaggtggaggtagggacgtacgggaacccctaaaccctaacgcgttggtccgtacgtaacgtggttccgtccttacccaaccccgtacgttccccggtacgggaactaaccgtaacccttaaccacgtaccgaacccgtaccctaaccccttacccgtaaccaaactaaaccaccgtaaactcccgtaagacggtggtaagttcggacggtactcccggtaanacctagtacctaccggaaccgtacccgaccgtcgttacttacgttaccgngtaccggacggaacgtccccggaacctacggtacgtcccgggactacccgggtcccgacggtacccgtcgggttccgttaccgtttccggtaaccgttcggggaaccgggg

SEQ ID NO: 207011 - DNA, 696 bp, Homo sapiens
  misc_feature: GYAE6OF01B2B35.17.25.C03.1.454.CMB.1.raw
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggtagcagctacaagtgcccactcccaggtgcagctggtgcagtcgtgggctggaggtagaagaagccgtggggcctcgagtgaaggtctcctgcgaagtcttcgtggattcctaccgtttacctaccttattagtactacctaacggtcgggtcgccgccgacggcccgtcgtacggaaccaaccgtaccgtaggtaggtgggtaggtaggggtacgtacggggacccgtaaaccccgttaacgaccgttgggtacgtaccacgtagttcgttaccttccaaccctacgtcccgtaccggactacggtacctacgacgtacgaccaccgtacctaccctaccaactaaccacactacctagacgtacggtagttaggacggaccgtacctagaactagtccgtagaaccgaccgaccggtaccgtacttacgttacgtcgtacgacgtagtacccgtaccgtaccgaccgtcccgggtagacccggtcccgtacggaccgccgggtccgtttccgtttacggtaccggtttccgggacggggtaccccgg

SEQ ID NO: 207012 - DNA, 715 bp, Homo sapiens
  misc_feature: GYAE6OF01DAZVQ.17.25.C03.1.454.CMB.1.raw
  modified_base (503)..(503): a, c, t, g, unknown or other
  misc_feature (503)..(503): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagagccgtgggcctgaggtgaggtctccgtgcgaaggtcttcgtggtacttcgtaccggttttacctccgttaattaagttacttcaacggtggggtcgccgcgacggtccgcgtaggaacctaaccggaccttggagtgggacgtggggatacggggaccgaaaccctaacgtacgttggtcgtacaacgtagttcgtaccttaccgaacccctgtcccgtacggggactacggtacctttaacgagtaccgaaccaccgtaacctcctaccaaataaccactacgtacctaacgngtacgggtaacgttggaaggtaccgtaccgtaggacctaagtcggtacgaacccggaccggtaccgggttacctaacgttaacgtttacgtacggtacggtaccgtaggtacccgttaccccgaagtccggttacccgggagtacccggcccggttacgggaccgtacgggtcccggttactttccgggtaccggttcgggtaacccggggg

SEQ ID NO: 207013 - DNA, 623 bp, Homo sapiens
  misc_feature: GYAE6OF01AGOO2.17.25.C03.1.454.CMB.1.raw
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaggtctcctgcaaggtcttctggattcaccgtttacctcctatagtatcaacgtgggtgccgccaggccgcgtggaacacgacctggagtggagtgggatcgggaccaaaccctacgacgtggtgtacacgtagtcgtccttaccacccctactcccgtaccgggactagtaccttaccacgtcgaaccacgtaacctccctaccaactaaaccacacgaccctatagtaggtagttggacgacgccgtagactatcgtacgaaccgaccgaccggtccttacgttacttacgtggtacgcgacggtaccgtacccgacggtcggttcccgggagaccgtcccggtaacggccgtacgggtcccggttaccgtttacgtccggttcgggtccgggg

SEQ ID NO: 207014 - DNA, 632 bp, Homo sapiens
  misc_feature: GYAE6OF01EBGE6.17.25.C03.1.454.CMB.1.raw
  modified_base (282)..(282): a, c, t, g, unknown or other
  misc_feature (282)..(282): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcgagtgaaggtctcctgcaaggcttcgtggattcacgtttacctcctatagtatcaactgggtncgccaggccgctggacaacggacctggaggtggagtgggatgggaccgaaaccctaacgacgtggtgtccaacgtagttgtccttccgaccccacgttcccgtacccggggacacgtaccttaaccagtacgacccaacgtaacctccctacctaactaaacacagcctaacagtggtaggttgaaggcgcctaggactagtctacggaccgaccgaccgggtccgttacttagttaacgtggtcggacgtaacgtaccgtacccgaacggtacgttcccggggtagaccggcccgtaccgggacgtaccggtacggttcccgtttaggccgtttccgggtaccgggggg

SEQ ID NO: 207015 - DNA, 702 bp, Homo sapiens
  misc_feature: GYAE6OF01ATN57.17.25.C03.1.454.CMB.1.raw
  modified_base (236)..(236): a, c, t, g, unknown or other
  misc_feature (236)..(236): n is a, c, g, or t
  modified_base (560)..(560): a, c, t, g, unknown or other
  misc_feature (560)..(560): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagagccgtggggcctcagtgaacggtctcngacaggtcttgtggtacttctacgtttacctctatagtatccgaacgttgggtcgccgccgtacggcccgtcgtacggaccaaccgtaccgtggtacggtaggaacggttgggacgttcggggaacccgtaaaccctaacgtaccggttgggtacgtacgaacgtggtcttcccgtacccacccgtacgtcccggtaccgggaaccgtaacgtacccttaaccgactaccgtaaccgtaaccgtaacccgtcccttaaccgaaacttaaaccgaaccgtaccgtacctacgtagtacggaggttaggacggacgtcctacgacncgttaccgaacgaccgaccgtacggtcccgttacgttaactcggtaggtcgtaccggtacggtacctccccgaagtaccggtcggtacggccgtccgtacggcgtccggtccgttaccgtttcgtaccggtggtacccgggg

SEQ ID NO: 207016 - DNA, 793 bp, Homo sapiens
  misc_feature: GYAE6OF01DDP2K.17.25.C03.1.454.CMB.1.raw
  modified_base (553)..(553): a, c, t, g, unknown or other
  misc_feature (553)..(553): n is a, c, g, or t
tcagcgtagactagcacgaccggtgctcgatttagtagtgtagatttgggtttggggactcaacaaccacatctgtcctctagagaaaaccctgtgagcacagctcctcaccatgactggacctggaggatcctcttcttggtggcagcagctacaagtcgcccactcccaggtgcagctggtgcagtcgtgggctaggaggtgaagacgccgtggggcctcgagtagtacggtcctccgtgacgtaaggtcttcgtggtaattcccgtaaccgttttacctaccttaagttaacgtactaccgtaacggttcgggtacgccggaccggacggtcccggtacgtacggaaaccctaacggtacctggacggtggacggtgggacgtacgggaaccctaaacctaacgtcggtggtcgaccgtaagtaggttccgtaccttacccaacccgtccgtcccggtaaccggacctacggtaaccttaccaacgtacccgaaccgtaaccgtaacccttaccctaaccaaagtaaacccactaccgtaacctaaacgnggttacgggtaacgttagggaacggtaccgtaccgttacaacgttagttacccggtaacggtaacccggaccggttacccgggttacctaactttacgtttaacggcggtacggaaacccgtcggtacccctaaccccgggaacgttaccgggtacccgggtacgtaacccggtcccgggtaaccgccgggtacgttcccggtttacccggttagttacccgggtcggggtaacccgggg

SEQ ID NO: 207017 - DNA, 760 bp, Homo sapiens
  misc_feature: GYAE6OF01AY18P.17.25.C03.1.454.CMB.1.raw
  modified_base (288)..(288): a, c, t, g, unknown or other
  misc_feature (288)..(288): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtctcctgcaaggcttcgtggtattctacgtttacctctatagtatcgaacgtgggcnccgcacggccgcgtcggaacaacggcctaggacgtggagtgggacgtcggggacaaacccgtaagacgttggtcgtacacgtagtcgtcttaccaccccgtattccccgtaccggggaactacggtaaccctttaaccgacgtaccgtaacccgaaccgtaacccttccccgttaacccaaaacttaaaacccgaacccgtaacgtaccctaaacgtaaggttcggggtaaaccgtttggaaacggtaccgtccgttacggaactacggttacgtaaccggaacccgtaacccgggtaccggtacccgtttaacgttaacgttaaccggttcggtaacggtacggtaaccgtaacccgtaccccgaacgggttaccgtacccggggtacggaacccgtaccccgggtaacggtacccgtacgggtacccggtttacccgtttacggtaccgggtttcggtaaccccgggggg

SEQ ID NO: 207018 - DNA, 686 bp, Homo sapiens
  misc_feature: GYAE6OF01CM66G.17.25.C03.1.454.CMB.1.raw
  modified_base (265)..(265): a, c, t, g, unknown or other
  misc_feature (265)..(265): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctgagtgaaggtctaccgtgcaaggcttcgtggattcacgtttaccncgtatagtatcaacgtgggtcgaccgccgaggcccgtgtaggaaccaacgtccttggaggttggaagtgggaagtcgggaaccgtaaccctaagacgtgggtactaccacgtagttcgtccttaccacccctagttcccgtaccggggaacctacggttaccttaacccagttaccggaacccctaaccggtaacccttcccctaacccgtaaacttaaaacccacccgtaacgtaccctaaaccgtagttaccggggtagttacgggaagccgtaccctaggaactacgtcgtaacgaccgaccgtacccggtccgttacttaacgttaccgtggacgaccgtaagtcccgtacccgtacggacggtccggtagaccgcccgtacggctacggccggttattcgtacgtcggtaccgggg

SEQ ID NO: 207019 - DNA, 701 bp, Homo sapiens
  misc_feature: GYAE6OF01BHO26.17.25.C03.1.454.CMB.1.raw
  modified_base (545)..(545): a, c, t, g, unknown or other
  misc_feature (545)..(545): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatcgaccctagtcctccactccctccctgtctcgccttcgtggtcgggggtcagtacgtccacctatctacgttcggacccggtacaacgtaccgaacgggtaacgtttaaaaaccttaagttttaaagttaggtaactacgagaccaacgaaaacccgtaacggaaaaccgcccctaacgtacccttccgtacgtacttcgtacgtggtcgactactcctacttcgtacgacgtaacggtcgggacccttacccgtaggttaccggtacggttacgacggttacggcgtaaggtggtacgttacggtagggtaactagttactttacctaacttcccgtaccaccgtacttccaacccgttactcgtacaacccgtacgtgtacgtnttgactacttaactctactactacgtaactaacgtacgtaacccgttactcccgtttaccctacgtacgtttccggttaggaccggtaacgaacttaggtagaagtacctaacgaacgttgtacgcggtactacacgtactcgttcgtcgttaccc

SEQ ID NO: 207020 - DNA, 609 bp, Homo sapiens
  misc_feature: GYAE6OF01CKJAF.17.25.C03.1.454.CMB.1.raw
  modified_base (241)..(241): a, c, t, g, unknown or other
  misc_feature (241)..(241): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcagtgaggtctctgcaggctntggattcacgtttacctctatagtatcaacgtgggtgcgccgaggccgcgtggaccacgaccgtggagtggagtgggagtcggggaccaaacccgtacgacgtgggtcgtacaacgtagttcgtcttccgaccctactcccgtaccgggacacgtaccttaccagtcgaaccgaccgaaccttacccacctaactaaaccgaccaacgtcctaacagttaggacgttaggacggacgaccgtagactactcgtcgaaccgtaccgaccgggtccgtaccttagttaccgtggtacgcgacgtaccgtcccgaagtcgtccggagccgccgtacggcgtacggtccggttcctttcgcgttcggcgggg

SEQ ID NO: 207021 - DNA, 700 bp, Homo sapiens
  misc_feature: GYAE6OF01ELPLM.17.25.C03.1.454.CMB.1.raw
  modified_base (297)..(297): a, c, t, g, unknown or other
  misc_feature (297)..(297): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaacgccgtggggcctcgagtgaaggtctccgtgacaaggtcttcgtggtacttctaccgttttacctcctaatagtatcgaacgtggggtcnccggccaggcccgcgtacggaaccaaccgaccgtggaggtggagtggggatacgggaccgtaaaccctaacgacgttggtacgtaccacgtagttgtccttaccaacccgtactcccggtaccgggaacacgtaccttaccgataccgaaccctacgtaacctcccaacctaaactaaaccaccaacgtaccctagacgtaggtagtttcggaacggtactccgtagactagtacgtaacggtaccgaaccgaccggtacccgttacgttaacgttacgttcgtacggaccggaacgtacccgtaacccgacggtaaccggttccgggtaacggtaccggtaccccgtaacgggtccgtacgggtaccggttaccgttttacgtaccggttcgggtaccgggg

SEQ ID NO: 207022 - DNA, 563 bp, Homo sapiens
  misc_feature: GYAE6OF01A3RVN.17.25.C03.1.454.CMB.1.raw
  modified_base (452)..(452): a, c, t, g, unknown or other
  misc_feature (452)..(452): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggtcttctggattcacgtttacctcctatagtatcaactgggtgcgccaggccgctggacacgacctgagtggagtgggatggggcgaaaccctaacacgtggtcgtcactagtgtcttcacccatccctccggggacacgtacttaccatgaccacgacctcctccaataaaccacacgcctaacatgggagttagaggacgcctagacactcncgacgaccgacggtccgtacttattacgtgtcgcgacgacgtccccagtaccgtcggtcggacgacccgtaggccacggcccggtacctttcgaccgttcggtaccggggg

SEQ ID NO: 207023 - DNA, 576 bp, Homo sapiens
  misc_feature: GYAE6OF01AX9SS.17.25.C03.1.454.CMB.1.raw
  modified_base (434)..(434): a, c, t, g, unknown or other
  misc_feature (434)..(434): n is a, c, g, or t
  modified_base (446)..(446): a, c, t, g, unknown or other
  misc_feature (446)..(446): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctggagtggagtgggatgggacgaacccctaagactggtgtacacgagtgtctcacccatcccgtccgggacagtacttaccatcgaccacgaacctcctacataacacacacctacatggagttgaggacncctagacatcgnaccgacgacggtccgtattacttacgtggtacgacgtaagaccgtacccgaacgtaccgttccgggaggacgtacccgtacgggcctacggtaccggtcccttttacggacccgtttccggtaccggggg

SEQ ID NO: 207024 - DNA, 789 bp, Homo sapiens
  misc_feature: GYAE6OF01BLF9M.17.25.C03.1.454.CMB.1.raw
tcagcgtagactagcacgaccggtgctcgatttagtagtgtagatttgggtttgggactcaacaaccacatctgtcctctagagaaaaccctgtgagcacagctcctcaccatggactggacctggaggatcctcttcgttggtggcagcagctaacaagtcgcccacctcccaggtgcagcgtggtcgcgtagtcgtggggctggagggtaggaaaggaacggccggtcggggtcctcgaggttaggaacggttcctccgtggcgaacggtctttcgtggtacttcgtacgtttacctcgtatagtactcgtaacgtggtcgcgcgacggtccgcgtacggaaccgaaccgtcgtaggacggtggaaggtcgggacgtacggggaacctaaacccgtaacgtacggtggtacgtaacgacgtacgttcgttacccgttacctacccgtaccgtcccggtaccgggtacgtaaacgttaacccgtttaacgacgttaacccgaacccgtaacctacccgttacccgtaactaaaaccgaaaccgaactaacggaacccttaagggaacggtttacggtaacggttacggacggtaccgtccctaacgtacgtaacgtttcggaaccgaacgtaccggacccgggttaccgttaccgttaacttacgggtacgtcggaaccggtcgttaccggaccccggtaacggtaccgttccgggacggtccggtacccgaccgggtcgtaaccggggccctttacggtttcccgggttcgtcggggtacccggggg

SEQ ID NO: 207025 - DNA, 586 bp, Homo sapiens
  misc_feature: GYAE6OF01BZUS9.17.25.C03.1.454.CMB.1.raw
  modified_base (221)..(221): a, c, t, g, unknown or other
  misc_feature (221)..(221): n is a, c, g, or t
  modified_base (446)..(446): a, c, t, g, unknown or other
  misc_feature (446)..(446): n is a, c, g, or t
  modified_base (502)..(502): a, c, t, g, unknown or other
  misc_feature (502)..(502): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctnagtgaaggtctcctgcaaggtcttctggattcgtacgtttacctctatagtatcaactgggcgcgccaggcccgcgtcggacaacgacctggacgtggagtgggacgtgggaccgaaaccctaacgacgtggtcgtaccacgtaggtcgtcgttccaccctatcccgtccgggacagtaccttacacgtcgacctaacgacctccactaataaacacacgcctanacgtggtagtgacggactcctgacatcgacgacgacgaccggcgttctattaccgngtaacgacggtacgtcctaccgacgtcgtcggaggcccgccgtacgacgaggtccgttaccgtttcgtaccgtcggtaccgggg

SEQ ID NO: 207026 - DNA, 606 bp, Homo sapiens
  misc_feature: GYAE6OF01B073B.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctggggcctcagtgaaggtctcctgcaaggcttctggattcacgtttacctcctatagtatcaacgtgggtgcgccaggccgctggacaacgcctgagtggagtgggatgggaccaaccctaacacgtggtgtacacgtagttgtccttccacccctacgtcccgtacccggggacacgtaaccttacccgattacggaacccacgtaacctcctaccaactaaaccacacgacctaacgagtagggaggttgaacggacgccgtagaacagttcacgtaccgaccgaccgggtccgttactattaccgtgttacgcggagtaccgtcccacggacgtcgggtacgaccgcccgtacggccgacggtccggtaccctttaggcctttcgggaccggggg

SEQ ID NO: 207027 - DNA, 626 bp, Homo sapiens
  misc_feature: GYAE6OF01BUHRE.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagagccgtgggcctcgagtgaaggtctccgtgcgaggtcttcgtggtattctacgtttaccctactatagtactacgaacgttgggtacgcgtcgacgggccgcgtaggaccaacgccgtgaggtggagtcgggagtgggaccgtaacctagtacgttggcgtacacgtcgttcgtccttccacccgtactcccgtaccgggactacgtaccttacacgacgaaccaccgacctaccgtacctaacgtaacacacacacagtgtagtgagacgtcgtacgactactcgtcgacgaccgaccggtcctacgttacgtcgtacgtacgacgacgtacccgtaccgacggtaccgttccgggtacggccgaccgtaccggacgtaccggcggttaccgttggtaacccgttcgggtaccgggg

SEQ ID NO: 207028 - DNA, 664 bp, Homo sapiens
  misc_feature: GYAE6OF01DPU3L.17.25.C03.1.454.CMB.1.raw
  modified_base (281)..(281): a, c, t, g, unknown or other
  misc_feature (281)..(281): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctctttgtggtggcagcagctacaggtgtccagtcccaggtccagttggtgcaatctggggctgaggtgaagacgcctgggtcctcgggtgagggtctcctgcaaggcttctggaggcaccttcagcgactatagtttcaagttgggngcggacggctcgtggacaaggccttggagtggagtgggaagagtcgtccctatcgttgacacaaccaaactacgcacaagaacgttcgagggcagactcgaacccagtaaacccgacggaacaaacgttaaacgaaaccaacgtaacgttaatacgtaggagtacgtaagaaccacgaccgttcgtactatccgtaggaacggtacgacgggtcctttaccgttacgtttcgtcggttcgacggtaaggtacggttaaactttaacgttaactaaacctaccgttacgttaccctttaccctttttacctaccctttacccgtttacggttaccgtttaccggtaccgggtaccctacggtccgggtaacccccgttacccgg

SEQ ID NO: 207029 - DNA, 630 bp, Homo sapiens
  misc_feature: GYAE6OF01BMPV8.17.25.C03.1.454.CMB.1.raw
  modified_base (279)..(279): a, c, t, g, unknown or other
  misc_feature (279)..(279): n is a, c, g, or t
  modified_base (290)..(290): a, c, t, g, unknown or other
  misc_feature (290)..(290): n is a, c, g, or t
  modified_base (391)..(391): a, c, t, g, unknown or other
  misc_feature (391)..(391): n is a, c, g, or t
  modified_base (423)..(423): a, c, t, g, unknown or other
  misc_feature (423)..(423): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagcctggggcctcagtgaaggtctccgtgcaggcttctggattcacgtttacctcctatagtatcaactggtncgccaggccgntggaccaacggcctggagtgggatggggactggggaccaaccgtaacacgtggtcgtcactagtatccttcacccgatcccgtacgggacagtaccttacngttacgaccacgtacctccgtaccataaaccncaacgtcccaacgtatcgggagtttcggaacggccgtaccgttgacctaacgtccgttacggaaccgaccggacccggggtccttcttaacggttctggcgtaggacgtaccgtacccggtacgaacgttcccgggagtaccggtccctaacccgggcgtacggggtcccggtacccttttacggccgttttccggaacccgggggg

SEQ ID NO: 207030 - DNA, 632 bp, Homo sapiens
  misc_feature: GYAE6OF01BLRNA.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagcctggggcctcagtgaaggtctcctgcaggcttctggattcacgtttacctcctatagtatcaacgtgggtgcgccgaggccgctggacaacgacctggagtggagtgggagtcgggacgaacccgtaacgacgtggtcgtacgacgtagtcgtcttccaccctactccgtccgggacacgtactaccatacgaccacgacctacctaccaactaacacacgacctaacacgtaggtagttacggaggtacggaccgtcgtacgtactacgtacgaaccggacccgaccgggtaccgttaccgttaacgtttacgtggtacggtcggtacgtaccgtaccccgacggtacgttcccgggtaggacccgtaccgtaccggcgtacggtccgggttccgttcgtaccggttcggtacccggggg

SEQ ID NO: 207031 - DNA, 711 bp, Homo sapiens
  misc_feature: GYAE6OF01A12ID.17.25.C03.1.454.CMB.1.raw
  modified_base (693)..(693): a, c, t, g, unknown or other
  misc_feature (693)..(693): n is a, c, g, or t
tcagcgtagactagcacgaccggtgctcgatttagtagtgtagatttgggtttggggagtcagtctcagtcaggacacagcatggacatgagggtccccgctcagctccgtgggctcctgctactctggctccgagctgccagatgtgacatccagactcgaccctagtcctcccacgtccctccctcgtcctcgtccttcgtggtcgggggtcaggtcgtcgacctactcctacgttcggaccggtacgacgtccgacggtaacgtttaaaacttagtttaaagttcggtactacgagtacaacggtaaaccgtacggaaaaccgtccccaaggtaccctccgtagtacttcgtacgtgggtccactacgtccctacgtcgtaggtaccggtaacggtccggtaccgtacctaggtacggtacggttcgagggtcggtacgtagggtcggtacgtacggtacgggtactagttactttacaaccgttccgtacctaccgtactacccaacctacgtacggtacgtaacccgtacggtaggaacgtttacgtgtacgtaacgttacttcctaacgtacgtactaacgtaagtacgttaacttacccgtacccggtttacccgaggttacttacgggttcggaaccggtacggaacgtagtcgaagttaccgagtaacgcgttgtacgcgtacncctaactcttcggtcctc

SEQ ID NO: 207032 - DNA, 703 bp, Homo sapiens
  misc_feature: GYAE6OF01C1BGW.17.25.C03.1.454.CMB.1.raw
  modified_base (189)..(189): a, c, t, g, unknown or other
  misc_feature (189)..(189): n is a, c, g, or t
tcagcgtagactagcacgaccggtgctcgatttagtagtgtagatttgggtttggggactcaacaaccacatctgtcctctagagaaaaccctgtgagcacacgctcctcaccatggactggacctggaggactcctcttcgttggtggcagcagctacaagtcgcccactcccgaggtgcagctggtnctagtcgtgggactggaggtgaacgaagccgtggggcctcgagtgaaggtcctcctgcaaggtcttcgtggtacttcgtacgtttacctctatagtactacaacgtgggtcaccgcgacggcccgcgtacggaccgaaccgtacctggaggtaggtacgtaggggtacgtcgggaccgtaaaccctacgacggttggttcaccgacgtacggttcgtccttaccaacccgtcttacccggtaccggaactaccgtaactttaaccgacgtaccggaaccaacccgtaaccttaccctacctaaactaaaccaacgtaacgtacccttaaccgagttacgggtaagttaggacggtacgtacgacgtactactacgttacgaacgtacgtacggtaccgttacttacgttacgtagtcgtaccgaggtacccgtaccgaacgtacgtaccgggtcgacccggtaccgtaccggttacgaccgtaccgttccgtttaccgcgtttcgggacccggg

SEQ ID NO: 207033 - DNA, 656 bp, Homo sapiens
  misc_feature: GYAE6OF01A6TFS.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctcctgcaggtcttcgtgattctacgtttaccctctatagtatcaactgggtgcgccaggcccgcgtggaaccaacggaccctggagttcgggagttggggagtcggggaccgaacccttaacgacgttggtcgtacacgagttcgttccttccacccctagtcccgtaccgggactacggtaccttaccgatacgacccacggtaaccttccctaccaactaaaaccactaacgcctaacagtgggacgttggacgacgccgtagactaacgtcgtcggaaccgtaccgaccgggtcccttaccttacttacgtacggtacgaccggtaacgtaccgtaccccgaaggtacgtcccggggtagaccggtcccggtaacggccgtacgggtccggttccgtttacgccgtttcgggtaccggggg

SEQ ID NO: 207034 - DNA, 757 bp, Homo sapiens
  misc_feature: GYAE6OF01DDFUK.17.25.C03.1.454.CMB.1.raw
  modified_base (177)..(177): a, c, t, g, unknown or other
  misc_feature (177)..(177): n is a, c, g, or t
  modified_base (185)..(185): a, c, t, g, unknown or other
  misc_feature (185)..(185): n is a, c, g, or t
  modified_base (304)..(304): a, c, t, g, unknown or other
  misc_feature (304)..(304): n is a, c, g, or t
  modified_base (319)..(319): a, c, t, g, unknown or other
  misc_feature (319)..(319): n is a, c, g, or t
  modified_base (337)..(337): a, c, t, g, unknown or other
  misc_feature (337)..(337): n is a, c, g, or t
  modified_base (382)..(382): a, c, t, g, unknown or other
  misc_feature (382)..(382): n is a, c, g, or t
tcagcgtagactagcacgaccggtgctcgatttagtagtgtagatttgggtttggggactcaacaaccacatctgtcctctagagaaaaccctgtgagcacagcctcctcaccatggactggacctggaggatccttcttcgttggtgcagcagctacaagtcgcccactccaggtncagctggncagtcgtgggctggaggtagaagacgccgtgggcctagagtggaacgtctcgtgcaaggtcttcgaggtacttccgtaaccgtttccctacgtaatacgtactaccgaacggttgggcncggaccgagggtccncgtacgaacgaacgtcgngtaaggtggagtggacgtacggacctaacctagcgtggtacacgngtacgttctccgttaccaaccgtactccggtaccggactaacggtaaccttacgactaacggaacctaccgaaccttaccaccgtaaaacaaaccgtaccaaccgtccctaagacgttacgggaagttacgggaacggtaaccgtcccgtaaggtaacctacgtttacccgggagtaaaccccgggtccgaaccccgggtttaccgttaacctttaaaggttccggttacgtaaccgggtaacggtaaacgtcccccggtaaacccggtaacgttaccgggtacccgggtaaaggccccgtttaaaccgggaccggtacgtaacccgggtttccccgttacgtttacggttacccggtttcggggaacccggggg

SEQ ID NO: 207035 - DNA, 762 bp, Homo sapiens
  misc_feature: GYAE6OF01C9X43.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagagccgtggggcctcgagtagaggtcctccgtgacgaaggtcttcgtcggtattccgtaccgttttacctcctaagttagtactcgaacgttcggggtcgccggaccgagggcccgtacgtcggaaaccaaccgaccgtaggaaggtcggtaggtcggggaagtcggggacccgtaaacccctaacggacgtgggttacgtacctaacgtacggttcggtccctttacccgaaccccgtacgttcccggtacccggggaactacggtaaccctttaccgaactaccgaaccaacgtaaccctccgtaacccaactaaaccacctaacgtaccctaagtacggtagggtagttaggaacggtacgtccttaggaacttgtacgtacgaaccgaccggtaaccggtccgttacgttacgttacgtcggtacgtacgtacggtacccgtaacccgtaacggtacggtacccgggtaggccggttaccccggtacgggaccgtaccgggttacccgggttaccgttttacggtaccgggttccggggtaacccgggggg

SEQ ID NO: 207036 - DNA, 703 bp, Homo sapiens
  misc_feature: GYAE6OF01AOMJH.17.25.C03.1.454.CMB.1.raw
  modified_base (534)..(534): a, c, t, g, unknown or other
  misc_feature (534)..(534): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaacgccgtggggcctcgagtggaaggtcctccgtgcaaggtcttcgtggacttcgtacgtttacctcctatagtatcgaacgtgggtcgccgtccgaggcccgtcgtgggaccaacggaccgtggaacggtggaagttggggagttacggggaccgaaacccccgttaagaccggttggtacgttaccacgtaagttcgtaccgtttccaaccctcgtccccgtaccggggaacacgtaaccttaccagttaccgacccaacgtaacctcccgtacctaactaaaccgacaacgtacctaactagtcggtaaggttacggaaggaccnccgtacgacgactcgtacggaaccgtaccgaccgggtccgttaccttattacgtcggtacgacgacggtccgtacccgacggtaccgtccggggtacggtaaccgacccgttaccgggacgtacccgggccggtttacccgtttcggtccgtttcccggggaccggggg

SEQ ID NO: 207037 - DNA, 665 bp, Homo sapiens
  misc_feature: GYAE6OF01BFXXS.17.25.C03.1.454.CMB.1.raw
  modified_base (311)..(311): a, c, t, g, unknown or other
  misc_feature (311)..(311): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtagaagagccgtggggcctcgagtgaacggtctcctgacgaaggtcttcgtggtacttctacgttttaccctcttaatagtatctaacgtgggtcgccgcgacggcccgngtacggaaccacggacctggaggtggagtggggagtacggggaccctaaacccgtaacgcgttagggtctaccgacgtacggttcgttcccttaccaccccgtaacttcccggtacccggactacgttaaccttaaccagtaccgaacctaccgtacctaccctaccgaactaaaccactaacgaccctaacgtagtaggtaaggtacggacggtacgtccctaagactacgtacgtacgaaccgtacgaccggtccttacttacgttacgtgacgacgtacgccgtaccacggcggttccggagccgaccgtacggcgtacggtcccgttcgttcggtccgttcgggaccggg

SEQ ID NO: 207038 - DNA, 747 bp, Homo sapiens
  misc_feature: GYAE6OF01ARSCJ.17.25.C03.1.454.CMB.1.raw
  modified_base (219)..(219): a, c, t, g, unknown or other
  misc_feature (219)..(219): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctgaggtgaagagccgtgggcctnagtgaggtctctgcaaggtcttcgtggtattcgtaccgtttacctccttagtacgtactcgtaacggtcggtagccgccgaggccgacgtacggaccaaccgacctggagtggtacgtggtacgtgggaccgtaaaccctagacgtggtcgtacaagtcgtgtcctaccacccgtactcccgtaccgggaactacgtaccttaccgacgtaccgaacccgtaacgtacccttaccctacctaaaccgtaaaccaaccgtaaccgtacccttaacgaacggtttcgggaacggtttacggaacgggtaccgtcccgttaacggaaccctaacggtttaccgaaccgggtaacccggtaacccggaaccccggggtttccctacggttttaacgtacgttaccgggcgttaaccgacggtacccgttaacccgaaccggttccggtacccgggtaggaccggaaccccgttagggacccgtcccggttaaccgggttcctttacggtccgttccgggggtaaccccgggg

SEQ ID NO: 207039 - DNA, 748 bp, Homo sapiens
  misc_feature: GYAE6OF01CVV39.17.25.C03.1.454.CMB.1.raw
  modified_base (209)..(209): a, c, t, g, unknown or other
  misc_feature (209)..(209): n is a, c, g, or t
tcagcgtagactagcacgaccggtgctcgatttagtagtgtagattttgggtttggggactcaacaaccacatctgtcctctagagaaaaccctgtgagcacagctcctcaccatggactggacctggaggactcctcttcgttggtggcagcagctacaagtcgcccactcccaggtcgcagctggtgcaggtcgtggggctggaggngaagaacgccgtggggcctcgaggtggaacggtcctccgtgacgtaaggtcttcgtaggtactttcctaccgttttacctctaagtacgtataccgaacgttggggtcgcggtaccacggggccctggtacggaaccaaccggtaccgtaggaggttgggaagttcgggggaattcgggggaaccctaaaccccgtaacgtacggttgggtctacgaacgtagttcggtcctttaccgacccgtacttcccggaccgacacgtacttacacgtacgaccaacgtactaccctacaataaccacgtaccgtactaacgtagtaggggtacgttacggaggaccggtacctagaaccgtagttacgaccggtaaccgacccggttacccgggtaccgttaactttagtttaacggtcgggtaaccgtacggtaaccgcccgtaacccgaacgggtcgttccccgggttaagacccggtaccggtaacccggacgttaccgggccggtttacccgtttaggtcccggttcggtacccggggg

SEQ ID NO: 207040 - DNA, 720 bp, Homo sapiens
  misc_feature: GYAE6OF01E15PZ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcaggtgaacggtctccgtgcaaggtcttctggtattcacgtttacctcctatagtatcaacgtgggtcgcgtccgacggcccgcgtggaccaacgacctggagtggaggttgggagtcgggaccgtaaaccccgtaacgaccgttgggtcgtaccacgtaggttcgttccttcccgaaccctacgtcccgtaccggggtacacggtaaccttaaccactacgaaccctaaccgaaccttcccctacaaactaaaccacaacgtcctaacgagtgggtagttcggaacggacgacccgtaggaaccacgttccgtacggtaaccggacccgtaaccgggtcccgttaacttaacgttaacgttcgggtacgaccggtaacggtacccggtaccccgaacgggtaccggttcccgggtacggtaacccgtaccccggttacgggacccgtaccgggtcccgggttcccgtttacggtaacccggtttcggggtacccgggggg

SEQ ID NO: 207041 - DNA, 746 bp, Homo sapiens
  misc_feature: GYAE6OF01C14R5.17.25.C03.1.454.CMB.1.raw
  modified_base (304)..(304): a, c, t, g, unknown or other
  misc_feature (304)..(304): n is a, c, g, or t
  modified_base (490)..(490): a, c, t, g, unknown or other
  misc_feature (490)..(490): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctggaggtagaagagccgtggggcctcgagtgaaggtcctccgtgacgaggtcttcgtggtacttccgtaccgttttacctctaatacgtataccgaacgtggggtacnccgcgacgggtccgtacgtacggaaccaaccgtaccgttggaggtggtagtcgggagtcgggaacctaaccctaacgtacgtgggtactcgaacgtaggttcgtccttaccaccctacgtcccgtaccgggactacgtaccttacgagtaccgaacctacgtaaccctcctaaccaactaaacccncgtaaccgtacctaagtacggtacgggtaaggttaggacggtacgtcccgtaagaactgttaccgaacggaacccggtaaccggtacccggttccgttaactttacgttacggtcggttaacggaccggtaacgtacccgtacccgtaagggtacccggttccgggtaacgtacccgggacccgtaccgggtaacccgtccgggttacccggtttaccgtttaaccggtacccgggtttccgggaaacccgggggg

SEQ ID NO: 207042 - DNA, 664 bp, Homo sapiens
  misc_feature: GYAE6OF01E078X.17.25.C03.1.454.CMB.1.raw
  modified_base (396)..(396): a, c, t, g, unknown or other
  misc_feature (396)..(396): n is a, c, g, or t
  modified_base (585)..(585): a, c, t, g, unknown or other
  misc_feature (585)..(585): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcgttgggtggcagcagctaacaagtcgccccactcccgaggtgcagctggtgcagtcgtggggctggaggtagaagaacgccgtggggcctcgaggtgaacggtcctccgtgacgaaggtcttcgtggtacttccgtaccgttttacctccttaatacgttataccgaacgttgggtgccgcccgaagggcccgacgtgggaaccaaccggaccgtggacggtggaggtcgggtagtcgggaccctaaaccgtaacncggtggtcgtacacgtgtctccttaccacccgtcgtcccgcggtaaccacgtaacctacagtaccgaacccgaacgtaaccctccctaacaaataaacccacgaactccctaacgtagtacggtagttacgggacgtaccgtccgagaacctgtccggagaaccgacggccggtccttatacgttacgngtacgacgtacgcccgtacgacggtccgtcggcaccggtccgtacgcgtcggtccgtccgttcgtcgttcggaccgggg

SEQ ID NO: 207043 - DNA, 720 bp, Homo sapiens
  misc_feature: GYAE6OF01EO7EN.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctggaggtgaagaacgccgtggggcctcgagtggaacgtctccgtgcaaggtcttcgtggtacttctaccgtttacctcctattagtactcaacgtggtcgcgcctacggcccgcgtaggaccaacgacctggagtggagtgggacgtcgggacctaaaccctacgacgtggtctaccacgtagtcgtacctccaaccctacgttcccgaccgggactacgtaaccttaccataccgaaccctaaccgtaacctcccctaacctaacttaaacccaccgtaacaccccttaacgaacggttacgggtagttacgggaacggtactaccgttacgtaacctacgttaccgacggaaccggacccggtaacccgggttacccgttacttaacgtttccgaggttcggaaccgggtacgtacccggtaccccgaacggtccggttaccgggtacggtaccggccccggttaacggccgtaccgggtcccggttaccgtttacggtccggtttccggggaacccggggg

SEQ ID NO: 207044 - DNA, 779 bp, Homo sapiens
  misc_feature: GYAE6OF01BOX6B.17.25.C03.1.454.CMB.1.raw
  modified_base (245)..(245): a, c, t, g, unknown or other
  misc_feature (245)..(245): n is a, c, g, or t
  modified_base (258)..(258): a, c, t, g, unknown or other
  misc_feature (258)..(258): n is a, c, g, or t
tcagcgtagactagcacgaccggtgctcgatttagtagtgtagatttgggttgggactcgaacgaaccacatctgtcctcgtagagaaaaccctgtgagcacagctccctcaccagtggactggacctggaggactcctcttcttggtgcagcagctacgaagtcgcccacgtcccgaggtgccgagtcgtggtgacagttcgtgggctgaggtgaagacgccgtgggcctgagtgacgtctcgngcgaggtcttcgnggtacttccgtaccgtttacctctaagtacgtactcgtaacggtggtcgccgccgaggccgtacgtacggaaccgtaccgtaccgtgagttgggaacgttggggaactcgggaaccggtaaaccctaacgtacggtgggtaccgtaccgtacgtacgggtttcttacccgttaccgaaacccccgttaccgttccccggttaaaccccggggacctaaccggtttaaaccccttaccgtaaccggttaacccgggaaccctaacccggtaacccgtttaacccgtaaccccgtaaaaccgttaaacccaacccgtaaccgtaccccttaaacgtaggttacgggtacggttacggaacgtaccggacgttacgagtaccgttcgacgaccggtacctacccgggtcgttaccgttagttacccgtggtacgtacggtaccgtaccgttaccgaaccggtcgtttaccggacgtcccgtacggacgtcgtacggtcccgttagtcgtacgtcggtacccggg

SEQ ID NO: 207045 - DNA, 605 bp, Homo sapiens
  misc_feature: GYAE6OF01D56O8.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcagtgaaggtctcctgcaaggcttctggattcacgtttacctccttatagtatcaacgtgggtcgcgccagggcccgcgtggaccaaccggccgtggacggtgggagtgggagtacgggaccgtaaaccctaacgacgtggtcgtacaacgtagttcgttccttaccgaacccctacgtcccgtaccgggacacgtaccttaccgatacgaaccacgtaacctccctacaactaaaccaacacgacctacagtggagttgagcgcctagacatcgtagaaccgacgaccggtacctacttacttacgtgtacgacggacgcgtacccgacgtacgtccggtgacgaccgtcgacgtacggccgttcctttgccgttcggacgggg

SEQ ID NO: 207046 - DNA, 644 bp, Homo sapiens
  misc_feature: GYAE6OF01ESHUV.17.25.C03.1.454.CMB.1.raw
  modified_base (281)..(281): a, c, t, g, unknown or other
  misc_feature (281)..(281): n is a, c, g, or t
  modified_base (293)..(293): a, c, t, g, unknown or other
  misc_feature (293)..(293): n is a, c, g, or t
  modified_base (333)..(333): a, c, t, g, unknown or other
  misc_feature (333)..(333): n is a, c, g, or t
  modified_base (376)..(376): a, c, t, g, unknown or other
  misc_feature (376)..(376): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcgagtgaaggtctcctgcaaggcttctggattcacgtttacctcctatagtatcaacgtgggtnccgccaggccgntcggacaacgcctgaggtgagtgggatgggacaaccctanacgtgtgtcacgtagtgtcttcacccgatcccgtccgggaacngtaccttaccatcgaaccaccgtaacctccctaccgaactaaaccacaacgccctaacgacgttacgggtaagtttcggaagggacgtacccgtagtaacctagtacctacggaaccgaccgacccgggttccgttaccgttacgttaccgtgtacggtcgaacggtccgtacccccggaagtaacccgttccgggtacggaccggtaccccgtaccgggccgtaacggtcccggttacctttaggtacccgttggtaccccgggggg

SEQ ID NO: 207047 - DNA, 832 bp, Homo sapiens
  misc_feature: GYAE6OF01DKSGZ.17.25.C03.1.454.CMB.1.raw
  modified_base (797)..(797): a, c, t, g, unknown or other
  misc_feature (797)..(797): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagacgccgtggggcctcgagtgaacggtctccgtgacgtaaggtctttcgtggtactttccgtaccggttttaccctccgttaagttacgtaacttacgtaaaccggttggggtacgccggacccgtacgggtcccgtaccggttacgggaaaccctaaacccggtaccgttacggggtaacggtttcggggaacggttcggggggtaaacgttccggggggaaaaccccttaaacccccgttaaaacggttcccgggttagggtaccggttaccgtaacgtaaccggtttcggttacccctttacccgaacccccgtaacgttaccccggtacccggggtaactaccggtaaaccccgtttaccgaacgtaaccggtacccctaaccggtaaccccttccccgtaacgtaaaacttaaaccccgacgtacccggtaccttaacgtagttcgggtacgttacggaaccggtagtaccctaggtaacctacgttccggaacgtaaccgccggtaacccgggtctaccgttagttaccgtggtcgtaccggagttaccgcccgaaggtcgtcccggtgaccgtcccgaggtaccncgggttaccggtccgtttacgccgttggaccgggg

SEQ ID NO: 207048 - DNA, 716 bp, Homo sapiens
  misc_feature: GYAE6OF01DS13N.17.25.C03.1.454.CMB.1.raw
  modified_base (176)..(176): a, c, t, g, unknown or other
  misc_feature (176)..(176): n is a, c, g, or t
  modified_base (187)..(187): a, c, t, g, unknown or other
  misc_feature (187)..(187): n is a, c, g, or t
  modified_base (194)..(194): a, c, t, g, unknown or other
  misc_feature (194)..(194): n is a, c, g, or t
  modified_base (198)..(198): a, c, t, g, unknown or other
  misc_feature (198)..(198): n is a, c, g, or t
  modified_base (238)..(238): a, c, t, g, unknown or other
  misc_feature (238)..(238): n is a, c, g, or t
  modified_base (256)..(256): a, c, t, g, unknown or other
  misc_feature (256)..(256): n is a, c, g, or t
  modified_base (648)..(648): a, c, t, g, unknown or other
  misc_feature (648)..(648): n is a, c, g, or t
  modified_base (705)..(705): a, c, t, g, unknown or other
  misc_feature (705)..(705): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactctcttctggtgcagctagctacaagtcgacccacgtccaggtnacagctgggtncagtcgngggntggaggtgaagacgtccgtaggggccttgagtgaacgtcncgtgccgaaggtcttcgnggacttcgtaccgtttacctactagtatacttacgaacgtgggttacgccgtaccggacggcccgttagacggtaaaccgtaaccgaccgttaggaaccggtaggtaacgggtacgggtaagtccgggaaccgtaaaaccccgtagtaccggtgggttacaccgaagtaggtcccgtacttaccaccgttacgaccggttacccggaatacgttacctaacgtaagtaccgaacccgtaacgtaacccgtacctaaccaaacgtaacgacaacgttacgaccgtaagtcggtagttacgggaacgtagtaccacgtaacgacttcgtacgacggaccgtaaccgaccgttacgtacttacgtcgggttacgaggaaccgtacgtaaccccgnggtaacgtccgggtacgaaacgccggtaacggcacgggtcgttactagggttacccngggttaccggg

SEQ ID NO: 207049 - DNA, 754 bp, Homo sapiens
  misc_feature: GYAE6OF01BN0DP.17.25.C03.1.454.CMB.1.raw
  modified_base (584)..(584): a, c, t, g, unknown or other
  misc_feature (584)..(584): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttggtggcagcagctacaagtcgcccactcccaggtgcagcgtggtgcaggtcgtggggctggaggtagaagaagccgtggggcctgaggtagacggtcctccgtgacgtaaggtcttacgtggtacttcctaccgtttacctaccttatagtatacgtaagtgggtcgccgccgacggccgtacgtacggaaccaaccggaccgtggaggtggaggtgggagtacgggaaccgtaaacccgtaacgacggttcggtcgtacgaacgtacggttacgttaccgttacccgtaaccctacgttcccggtacccggggtactaaccggtaaccttaaccgacgttaccggaacccgtaaccgtaaccctccctaaccctaaacaaacccgtacaaccggtacctaacgtaaggtacgggtaaggttaggacggtacgtacccgtanaccgtacgttacgaacgtacccggaccggtacccggtaccgttacgttactttacgtagtacgacggtacgtaccgtaccccgtaaggtaccggtaccggtacggtacccggaccggtaccggacgtccgggtaccgttaccgtttcggtccgttcgggtaacccggggg

SEQ ID NO: 207050 - DNA, 567 bp, Homo sapiens
  misc_feature: GYAE6OF01A0Z9B.17.25.C03.1.454.CMB.1.raw
  modified_base (247)..(247): a, c, t, g, unknown or other
  misc_feature (247)..(247): n is a, c, g, or t
  modified_base (295)..(295): a, c, t, g, unknown or other
  misc_feature (295)..(295): n is a, c, g, or t
  modified_base (330)..(330): a, c, t, g, unknown or other
  misc_feature (330)..(330): n is a, c, g, or t
  modified_base (346)..(346): a, c, t, g, unknown or other
  misc_feature (346)..(346): n is a, c, g, or t
  modified_base (403)..(403): a, c, t, g, unknown or other
  misc_feature (403)..(403): n is a, c, g, or t
  modified_base (411)..(411): a, c, t, g, unknown or other
  misc_feature (411)..(411): n is a, c, g, or t
  modified_base (431)..(431): a, c, t, g, unknown or other
  misc_feature (431)..(431): n is a, c, g, or t
  modified_base (466)..(466): a, c, t, g, unknown or other
  misc_feature (466)..(466): n is a, c, g, or t
  modified_base (524)..(524): a, c, t, g, unknown or other
  misc_feature (524)..(524): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgctaaggctttcgnggacttcacgtttacctcctatagtatcaacgtggtgcgccaggccgntggacaacgctgagtgatggatgggacaaacctancgtggcgtcactagtntcttcaccattcccacgggacagaccttacgatcgaccacgactcctacaataacgnagctaacngtaggagttagacggatccngaacatctagacgaacgcggtcgtattaacgttcngttggacgacgtaacgtcccctaaaggcgttccgggagaaccgtcccgtaaaccgggnaaccgggtccggttaaccttggtaaccgtttcgggaccggggg

SEQ ID NO: 207051 - DNA, 921 bp, Homo sapiens
  misc_feature: GYAE6OF01A6CI7.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccagtggactcggacctggaggactcctcttcgttggtggcagcagctacaagtcgcccactccgaggtgcagctggtgctagtcgtggggctggaggtagaagaacgccgtgggcctcgagtgaaggtcctccgtgcgaaggtcttcgtggtacttccgtaccgttttacctaccttaatagttactacgtaacgttgggtacgccgaccgaacggcccgtacgtacggaaacctaaccggtaccgttgggaggttagggaggttacggggaagtttccgggggaaacccctaaaaccccgttaacgtaccggttacgggttaccgtaaccgaacgttaagggtttccggtttacccttaccccgaaacccccgtactttacccccgggacccgggggtaaactaaccgggttaacccctttaaaccgaaccgtttaacccggaacccctaaaccggtaacccctttaaccccgtaacctaaaaccgttaaaacccacccgtaaccggtacccgtaaacgtacggtttacggggtaacggtttacgggaaccggtaccgtacccgtaaggtaacccttaacggtttccggtaaacggaacccggtaacccggtaccggggtttaccccgtttacgtttaaccgtttaaccggtcggtaaccggtaaccggtaaaccggttacccccggtaccgtaaaccggtacccggtttacccggggaggttaaaccccggccccggttaacggccggttaaccgggtcccggtttacccgttttaccggtaacccggtttcccggggtaaccggggg

SEQ ID NO: 207052 - DNA, 609 bp, Homo sapiens
  misc_feature: GYAE6OF01C907J.17.25.C03.1.454.CMB.1.raw
  modified_base (347)..(347): a, c, t, g, unknown or other
  misc_feature (347)..(347): n is a, c, g, or t
  modified_base (352)..(352): a, c, t, g, unknown or other
  misc_feature (352)..(352): n is a, c, g, or t
  modified_base (367)..(367): a, c, t, g, unknown or other
  misc_feature (367)..(367): n is a, c, g, or t
  modified_base (415)..(415): a, c, t, g, unknown or other
  misc_feature (415)..(415): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagcctggggcctcagtgaaggtcctctgcaggcttcgtggattcacgtttacctctatagtatcaacgtgggtcgcgcgacggccgcgtggaaccacgacctggagtggagtgggatcgggaccaacctaacgctggtntcagngtgtcctccgacccngtcccgtacgggacagacttaccagtacaccacgaacctccacctaanaacacagacctagagtggtagttaggaggactccgtagacagtcgtacggtaacgacgttaccggtaccgttcttaacgtttacgtggtacggaccgtagtaccccggtccgaaccggtacgttcccggtaggaaccgtcccggtacgggacgtacgggaccggttcccgtttagcggtttccgggaccggggg

SEQ ID NO: 207053 - DNA, 838 bp, Homo sapiens
  misc_feature: GYAE6OF01CW2FL.17.25.C03.1.454.CMB.1.raw
tcagcgtagactagcacgaccggtgctcgatttagtagtgtagattttgggtttgggagtcagtctcagtcaggacacagcatggacatgagggtccccgctcagctccgtgggctcctgctactctggctccgagctgccagatgtgacatccagatgacccagtcctccactccctccctgtcctcgcctcgtggtggggtcagacgtcaacccatccacgttcggacccgaacgtaacgtaccgaacggtaaacctttaaaaccttattttaaaagtttggtactacgaagtaccaaaacggtaaaacccgtagggaaaaacccgcccctaaacggtaaccccttaccgtacgtaacttccgttccgtacgggtaccacttacctaccctaaccgttcgtacggtaccggtaaagggttcccggtcgtacccccgtaagttaccgggtacggttacggtaacggtcgggtacgtaggtagggtacgtttaccgggaacgggaagttacgttaaacttttaccaaacttccctaacctaccctaactaccccgtaaccctaacctccgttaaccgaacccgttaaccggtaacggtaacggtttacgttgttaccgaactttaacctaaccttaccgttaacgtacgtaacgtaaccgtaaacggtttacttaaacccgttcccgtttaccccgtaccgttaaccgtttaccggttacccgggtaaaccgtaacgggtaaccttaaaagggtcgaaacgtaaaccgttaaacggaaacccgttaggttaacggtcgaaccgtttcgaaaccctcttaaccgttgttacgtttaccg

SEQ ID NO: 207054 - DNA, 806 bp, Homo sapiens
  misc_feature: GYAE6OF01D1GTC.17.25.C03.1.454.CMB.1.raw
  modified_base (254)..(254): a, c, t, g, unknown or other
  misc_feature (254)..(254): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtagcagtcgtggggctggaggtagaagaagccgtggggcctcgagtagaggtctccgtgacaaggcttcgngtacttctacgttacctcctaatagtactacaagtgggtcgacgccaggccgtgtagacaacgctggaggtgacgtgggagtcgggacctaaccctaacgtagtcggtacgtcgacgtagtcgttaccttccaaccgtacgtcccggttaccggggaacacgttaaccttaacgtacgtaaccgaccctaaccgtaacccttccctaaccgtaactaaaacccactaaccggtacccttaagaccggttaggggtacggtttacggaacgggtacgtaccccgtaggtaacccttacgttccgtaacgggaaccggtaacccggtaacccgggttaccccggttaacgttttaaccgtttaccgggttacggtaccgggtaacccgggtaacgggttaaccccggtttacccggaaaccgggtttaacccgggttacccgggttaacggttaaccccggggtaaccccgtaacggggaccggttacccgggttacccgggttacccgtttttaaccgggttaacccggtttcggggtaaacccccggggggg

SEQ ID NO: 207055 - DNA, 924 bp, Homo sapiens
  misc_feature: GYAE6OF01DEME5.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcgagtgaaggtctcctgcaaggcttctggattctacgtttacctcctattagtatcaacgtgggtgcgcacgggccgcgtacggacaaccgaccgtgtacggtcggagtggggtaacgtcggggaaccgtaaaccccctaagaccgttgggtacgttccgaacgtaacggtttcgtaccgtttacccaaaccccgtagttcccccggttacccggggaaccttacgggtaaaccccttttaacccgtaacgttaccgggaaaccccttaaacccgggttaaacccgtttacccccttaaacccccgtaaaacgttaaaaaacccccgttaaccgtaaaacccgggtacccctttaaaaccggaacccggttttaacggggggttaaaccggtttttaacggggaaacgggggtaaccccgggtttaaccccccgttaagggtaaacccctttaaacgggtttccccgttaaacggggtaaaccccccggtaaaccccgggtaaccccgggttaccccggtttaaccgtttaaaccgttttaaccggttcgggttacgggtacccggtaaacggtaacccggtaccccccggtaacggttaaccgggttccccgggttaacggaaccggtaccccgttaacccggggaccgtacgggttccccggttacccgttttacgggtaccccgtttggggtaaccccgggggg

SEQ ID NO: 207056 - DNA, 713 bp, Homo sapiens
  misc_feature: GYAE6OF01BBR99.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgctagtcgtgggctggaggtgaaagagccgtggggcctcgagtgaaggtctccgtgcgaggtcttcgtaggtacttcgtacgtttacctctagtagtatcgtaacgtgggacgtccgccgaggccgtcgtacggacaacggaccgtaggaggtggagtagggatcgggaacctaacccgtaagacgtggtacgacacgtagttcgtccttaccaccctagtcccgtacgggactacgtaccttacagttacgaccgtacgtactaccgtacaacgtaaacacgtacgacccttacgaagtacggtacggtaggaacggtacgtaccgtagactacgtacgtacggaaccgtacccggtaccgggttcccttaacgttaacttacggtacggtacgaacgggtaaccttaccgggtaaccccgtaaggtacccggttacccgggacgggtaaacgcccccgtaacgggtaccgtaccggggttacccgtttacccgtttacgggtaacccgtttcggggaaccccgggggg

SEQ ID NO: 207057 - DNA, 807 bp, Homo sapiens
  misc_feature: GYAE6OF01BKEH5.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtagaagagccgtggggcctcgagtgaaggtctccgtgcgaaggtcttcgtggtattctacgtttacctccttatagtatcgtaacgtgggtcgccgccgagggcccgcgtacgggaacctaaaccggaccgtggaacggttgggagtggggtaacgtcggggaacccgtaaaacccgtaaacgtacggtcgggttacgtacaacgtcggttcgttaccctttacccgaaccccgtacgttcccggtacccgggtaactaacgtaacctttaaccaacgttaccgaacccaacggtaaccccttaccccgtaaccctaaacttaaaacccaaccgtaaccgtacccttaaacgtaacgttagggtaacgttacgggaacgggtaaccgtacccgtaacgaaccgttacgttaccggtaaccgggaaacccggtaccgacccggggttacccttaactttaacgtttaacccggtggtaccggtacggaacggtacccggtacccccgaagggtacccgttcccggggtaacggacccgacccggttaacccggccggtaaccggtcccggttaccttttcgggacccgtttcccgggtacccgggggg

SEQ ID NO: 207058 - DNA, 711 bp, Homo sapiens
  misc_feature: GYAE6OF01B7FN5.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagaagccgtggggcctcagtgaaggtctcctgcaaggcttctggtattctaccgtttacctcctaatagtatcaacgtgggtcgccgccgaggcccgcgtcggaaccaacgacctggaggtggaggtgggagtcggggaccgtaaacccctaacgtacgtggtacgtacgacgtacgttcggtccttaccgaaccccgtacgtccccggtaccgggaactaacgtaccttaaccaagtcccggaaccctaaccgtaacccttccccgtaacctaaccttaaaaccacgtaacgtccctaaacgagtcgggtaagttggaacggactccgtagacctagtcgtacgaaccgtaccgtacggtacctactttaacgttccgttggaccggacgtacggtacccgtacccgtaaccggtacggttacccgggacggtacccgccccgtaagggcccgtaccgggttcccggttacctttcgggtacccgtttcggggtacccgggggg

SEQ ID NO: 207059 - DNA, 818 bp, Homo sapiens
  misc_feature: GYAE6OF01BDS2U.17.25.C03.1.454.CMB.1.raw
  modified_base (177)..(177): a, c, t, g, unknown or other
  misc_feature (177)..(177): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctaacaagtcgcccactcccaggtncagctggtgcagtcgtggggctaggaggtagaagaagccgtggggaccttcgaggtagaacggtcctaccgtgacgaacggtcttcgtaggatttacgtaccgttttacccgtctaaagttacggtaattacctaacgttggggtacgtaccgaccgtaacggggtcccgagttacgggaaaccctaaacggtacccgtagggtaaggttagggacggtttaggggaacgttacggggaaaccccgtaaaaccctaaacggtaaccggttggtacggtactaacgtacgggttcgttacccgttaaccaccccgttaacgtcccggttaaccggggaacaacgggttaccttaaccagtaacccgaaccgtacggtaaaccctctaaccaacgtaaaccacgtaaccgtacctaaacgtacgttagggaccttagggaacgtacgaccgttagaacttaacgtcgtaacggaacgtacccggacgggtacccgtttactaacggtttccgtacggtacggaaccgtaagggttaccccgtaacccgtaaggtcccgggtaacggtacggtaacccgtacccggtaccgggaacctacgggtaccgtttacccggtttacggaccgtttccgggaaccgggg

SEQ ID NO: 207060 - DNA, 733 bp, Homo sapiens
  misc_feature: GYAE6OF01BLG86.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccgaggtgcagctggtgcagtcgtggggctggaggtgaagaagccgtggggcctgagtgaacggtcctcctgacgaaggtcttacgtggtacttcgtaaccgttttacctccttaagtacgtactaccgtaaacgttggggtcgaccgcccgaagggtcccgcgtacgggaacaaccgtaccgtggaggtcggagtgggagttcggggaacctaaacccctaagacgttcggtcgtacaccgtggttctccttaccgaccctacgtcccgaccgggactacgaccttacgacgtacgaacccacgtacctaccctacaaactaaaccactaacgacctaacgagttacggtagttacggaacggtcgtaccgtagacctacgttcgaacgtaacggacccgtacgggttaccccgtttagttaacctttaaccggtgtaacgggtaccgtaacggtcccggttacccgaacggtacggttcccgaacgggttcgaccccggtaccgtaaccgggacgtacccgggtaaccccggtttcgttacccgggtaacggtcccgggggg

SEQ ID NO: 207061 - DNA, 740 bp, Homo sapiens
  misc_feature: GYAE6OF01CDZRV.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcgagtgacggtctcctgacaggtcttcgtggtacttcaccgtttacctccttatagtatcaacgtgggtgccgccagggccgacgtcggaacaaccgccgtaggaggtaggagtggggaagtcggggaaccgtaaaccccgtaacgtacgtgggttcgtacacgtaggtcgttccttaccgacccctacgtcccgtaccgggactacgtaaccttaccgagttaccgaaccctaaccggtaacccttaccctaacctaaactaaaccaccgtaaccgtacccgtaacgtagtacgggtaagtttaggaacgggtaccgaccgtacgacctaacttacggtacggaaccgtaacccgtaccggggttacccttacgtttaacgtttaccggtcggtacggaccggtaacgtacccggtacccgaaccggtaccggttccgggtacggacccggtcccggtaaacggcccggtaacggtcccggttaccgttttccggtaccggttccggggtaaccggggg

SEQ ID NO: 207062 - DNA, 554 bp, Homo sapiens
  misc_feature: GYAE6OF01BTW0D.17.25.C03.1.454.CMB.1.raw
  modified_base (219)..(219): a, c, t, g, unknown or other
  misc_feature (219)..(219): n is a, c, g, or t
  modified_base (281)..(281): a, c, t, g, unknown or other
  misc_feature (281)..(281): n is a, c, g, or t
  modified_base (292)..(292): a, c, t, g, unknown or other
  misc_feature (292)..(292): n is a, c, g, or t
  modified_base (447)..(447): a, c, t, g, unknown or other
  misc_feature (447)..(447): n is a, c, g, or t
  modified_base (480)..(480): a, c, t, g, unknown or other
  misc_feature (480)..(480): n is a, c, g, or t
  modified_base (484)..(484): a, c, t, g, unknown or other
  misc_feature (484)..(484): n is a, c, g, or t
  modified_base (490)..(490): a, c, t, g, unknown or other
  misc_feature (490)..(490): n is a, c, g, or t
  modified_base (507)..(507): a, c, t, g, unknown or other
  misc_feature (507)..(507): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctnagtgaaggtctcctgcaaggcttcgtggattcacgtttacctcctatagtatcaactgggtncgccaggccgntggacacgacctgagtggatgggagtgggcaaaccctaacacgtggtgtcaacgtagttgtccttcaccccatcccgtaccgggacagtaccttaccatcgaccaccgaacctccgtaccaataaaccactaacgcctacagtgagttgaggacnctgacatctgacgacaccggtccgtatattacngtancggaanccgcccagacttcgggngacggtaccctagggcaggtcccggcctttcgaccgttggtccgggg

SEQ ID NO: 207063 - DNA, 843 bp, Homo sapiens
  misc_feature: GYAE6OF01BM55V.17.25.C03.1.454.CMB.1.raw
  modified_base (283)..(283): a, c, t, g, unknown or other
  misc_feature (283)..(283): n is a, c, g, or t
  modified_base (294)..(294): a, c, t, g, unknown or other
  misc_feature (294)..(294): n is a, c, g, or t
tcagcgtagactagcacgaccggtgctcgatttagtagtgtagatttgggtttggggactcaacaaccacatctgtcctctagagaaaccctgtgagcacagctcctcaccatggacctggacctggaggatcctcttcttggtggcagcagctacaagtgccactcccaggtgcagctggtgcagtctggggctgaggtgaagagcctggggcctcgagtgaacggtctcctgcaaggtcttctggacttcacgtttacctctatacgtatcaactgggtcncgccaggccgntggacacgcctggagtcggagtgggattcggggacctaacccgtaagaccgttggtcgtaccaacgtacggttcgttccgttacccgaacccctagttcccggtacccggggaactacggtaaccccttttaaccgacgttaccgaaccccgtaacggtaacccttccccttaaccgaaacttaaaacccacgtaacggtaccccttaaagaccggttgggtaacggtttacggaagggttaacccgtccctaacgggaacttaccgggttaccttacgggaaacccgttaaccccgggtaacccgggtttacccgggtttaactttaacccggttttaaccgtcggggttaaacccggaccggggttaaacgtaacccccggggttacccccgtaaaccggggttaaccggttccccgggggtttaaaggaaaccccggttccccggtacccggggggttaacccaaccgggggttttccccgggttaaccccgttttttaccgggttaaaccccgggtttttcccgggtaaacccccgggggggggg

SEQ ID NO: 207064 - DNA, 704 bp, Homo sapiens
  misc_feature: GYAE6OF01A8RVQ.17.25.C03.1.454.CMB.1.raw
  modified_base (244)..(244): a, c, t, g, unknown or other
  misc_feature (244)..(244): n is a, c, g, or t
  modified_base (261)..(261): a, c, t, g, unknown or other
  misc_feature (261)..(261): n is a, c, g, or t
  modified_base (292)..(292): a, c, t, g, unknown or other
  misc_feature (292)..(292): n is a, c, g, or t
  modified_base (317)..(317): a, c, t, g, unknown or other
  misc_feature (317)..(317): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagcctggggcctcagtgaaggtctcctgcaaggcttcnggtattcacgtttaccnccttatagtatcaactgggtgcgccaggccnctggacaacgcctgagtggatgggntgggcgaaccctaagacgtggtgtcacagtcgtcttcacccctatccctccggggacacgtacttaccagttacgacccacgtaacctccctaccgaataaaaccacagaccctaacgagtgggtaagttcggaacgggtacgtcccgttaggaacctagttaccgtacggaaccggacccgtaacccggggtcccgttactttaaacgtttaacccggtgggtcggaaccggtaacgggtaccggttaccccccgaaacggtaaccggtttccccggggtacggtaacccggtaccccccgtttaaccgggggacccgtaaccgggccccggggttttaacccttttccgggtaacccggttttacccggggtaccccgggggggg

SEQ ID NO: 207065 - DNA, 761 bp, Homo sapiens
  misc_feature: GYAE6OF01EE7DN.17.25.C03.1.454.CMB.1.raw
  modified_base (277)..(277): a, c, t, g, unknown or other
  misc_feature (277)..(277): n is a, c, g, or t
  modified_base (302)..(302): a, c, t, g, unknown or other
  misc_feature (302)..(302): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgccccactcccaggtgcagtcgtggtgctagtcgtggggctggaggtgaaagagccgtgggcctgagtgaaggtcctccgtgacgaggtcttcgtggtacttcgtaccgtttaccncgttatagtactacgaacgtgggcncgtaccgacggccgtcgtacgggaaccaaccggtacctgggagtaggaggtcgggtagtcgggaaccgaaacccctaagcggtaggtacgcctaagtacgttcgtaccttccacccgagtcccgtaacggactacgttactaccacgtacacccgaacgtacctacccgtaactaacgaaaccacgaacgtacccgtaagtacggttacgggtaagttcggaaacggtccgtaccctaagggtaactaccgtacggttaacggaaccccgttaccggaacccggtttaccggtttaaccttagtttaaccgggtagtaccgtaaccgggtaccgtaaccggtaccccggttacggtaccggtttacccgggtacgaacccggttacccgggtaaccggaaccggttcgggttacccggtttaccctttacggtacccgttccgggggtaaacccggggg

SEQ ID NO: 207066 - DNA, 721 bp, Homo sapiens
  misc_feature: GYAE6OF01ESJXE.17.25.C03.1.454.CMB.1.raw
  modified_base (254)..(254): a, c, t, g, unknown or other
  misc_feature (254)..(254): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagacgccgtggggcctcgagtggaacggtctccgtgcaaggtcttcgnggtacttctaaccgtttacctctatagttactacgaacgtgggtcgaccgtccgacgggcccgtacgtacgggaaccaacggtaccgtaggaggtggagtcggggagtcgggacctaaacccgtactacgtggtacgtacgacgtagggttcttaccttaccaccccgtacgttcccggtaccgggactacgtaaccttacacgtaccgaacccgtaccgtaaccctcccgtaacctaaactaaacccacgtaccgtaaccctaaggacgtttagggaacgtttggaaccggtacgtccctaagacctacgtacgtcggaacccgtacggcccgttaccgttaacttacgttacggtcgtacgacggtaacggtcccgacccgtaaggttcccggtacgggtacgacccgtacggtaacccgccggacggttcccggttacctttcggccgtttcggggacccgggg

SEQ ID NO: 207067 - DNA, 762 bp, Homo sapiens
  misc_feature: GYAE6OF01DLZ7P.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattcgtacgtttacctcctatagtatcaacgtgggtacgcgccgaggcccgtcgtcgggaaccaacggtacccgttgggaaggtttcgggaagttgggggaaacgtttcggggggaacccgtaaaacccccgttaaaaccgtaccgtttaggggttacgttaccgtaaccgaacggtttcggttccctttaccaaacccccgtaacgttccccgttacccgggggacaacgtaaccctttaaccattaccggaaccctaacgtaaacccttccccgttaaccctaaattaaaaacccaccgtaacgtacccttaaacgacgttagggtaacgtttcggaacggaccggtccctagaacgtactacgtacggaaccgaccgtaccggtcccgttactaactttacgtggtacgaccggaacgtaccgtaccccacggtaccgtccgggttagaccggtaccccgtaacgggccgtacggtcccggttacctttacggtccgtttccggtaccgggg

SEQ ID NO: 207068 - DNA, 603 bp, Homo sapiens
  misc_feature: GYAE6OF01A8LRH.17.25.C03.1.454.CMB.1.raw
  modified_base (343)..(343): a, c, t, g, unknown or other
  misc_feature (343)..(343): n is a, c, g, or t
  modified_base (427)..(427): a, c, t, g, unknown or other
  misc_feature (427)..(427): n is a, c, g, or t
  modified_base (545)..(545): a, c, t, g, unknown or other
  misc_feature (545)..(545): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagccgtggggcctcgagtgaaggtctcctgcaaggtcttctggattcgacgtttacctcctatagtactcaacgtgggtgccgccgaggcccgcgtggacaacgcctgagtggagtgggatcgggactaacccgtacncgtggtgtcacgtagtgtccttccaccctctcccgtccggacacgtaccttacatcgacctacgacctcctaccaataaccacncgtacctacagtggtagttggaggtacgcctacggactactcgtacgaaccgacccgtaccgggtccgttactaactttaccgtgtacgcggacgaccgtacccgagtccgtaccggngaccgtcccggtacggccgtacggtcccgttccgttacgtcccgttcggtaccggggg

SEQ ID NO: 207069 - DNA, 694 bp, Homo sapiens
  misc_feature: GYAE6OF01EFVJA.17.25.C03.1.454.CMB.1.raw
  modified_base (222)..(222): a, c, t, g, unknown or other
  misc_feature (222)..(222): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagacgcctggggcctngtgacggtctcctgcaggtcttctggtacttactacgtttacctctatagtactctaacgtggtgccgccgacggcccgtcgtcggaaccgaacgtacgtaggaggtcgggagttagggacgtacgggaccgtaaacccgccttaacgggtacttcggtacgtacgtacgtaacgttcgtacccttcgtacccctacgggtacccctacgggaaccttaaccggaacgtttaccgaaccgtcgtaaccctacccgtaaacctaccctaaaccgaactaaaaccgaacctacgaccgttaacgacgttcgggaaacggttagaccggtagacctagtacctaacgtacgaaccgtaccggaccgtaccgttaccgttactacgttacgcgtagccgtaccgaacgtaccgtccggagtaccggtcgaccggccgtacggtccgtacggttacggccgtttcggccggtccggg

SEQ ID NO: 207070 - DNA, 628 bp, Homo sapiens
  misc_feature: GYAE6OF01C42HS.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcagtgaaggtctcctgcaggcttcgtggattctacgtttacctcctatagtatcaacgtgggtgcgccaggccgcgtggacaacgacctgaggtggagtgggatcgggaccaaccctaacgacgtggtctcacgagttgtccttcacccatcccgtaccgggacacgtaccttacatcgaccaacgtacctcctaccaataaaccacacgacctaacacgtgggagttagacggtacgccgtagacctagtcgtacgaaccgtaccgaccggtccgttacttaacgtttacgtggtacggaccggtaagtacccggtacccgaacggtaccgttacccggggtagaccgtacccggtacggacccgtacggcccgggttcctttacggccgtttcgggtacccggggg

SEQ ID NO: 207071 - DNA, 770 bp, Homo sapiens
  misc_feature: GYAE6OF01BSPZW.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcagtgaaggtctcctgcaaggcttctggattcacgtttacctcctatagtatcaagtcgggtgcgccaggccgctggacaacgcctgagtggatgggatgggcaaccctaagacgtggtacgtcaacgagttcgtaccgttcaccccgtaattcccgtaccggggtaacacggtaaccttttaacccgagttaccggaacccctaaaccggtaaacccttacccgttaccccaaacgtttaaaaacccaaaccctaaacggtaccccttaaacccgaagttacggggtaaacggttttacgggaacgggtaaccgacccgtttaacgggaacctaagttacccgttaacggaaccgaaccgaacccggggtacccgttaaccgttaacgtttaaccggtggttaccggacggtaacggtaaacccggtttccccgaacggtacgttaccccggggtacggaacgggtacccccggtaaaccgggtcccgtaaacgggtccccggggttaccccgttttgggtaaacccgttttccggggtaacccggggggg

SEQ ID NO: 207072 - DNA, 728 bp, Homo sapiens
  misc_feature: GYAE6OF01ELTFF.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctcctgtctcgcctcgtggtgggggtcagacgtcaccatcacttgccggacaagtcacggtacgttaaaacctatttaaattggtatcagcaagaacctaggaaaacgccccagacctcctagactctcgtggtcgactactccctactcgtcgacgtaaggtcggccgtcccagtccgtacggttcaggtcggacgtaggtcggagtcggtaggggactagtagtttacaacttacctaccgaaccctactaccctaacctaccgttacctaccgtaccctaaaccggtaggaagggttactttcgggtactaaccgtaactttacccgttaaccgttaccgttacggtaacctaaacggttaacggttaaaccttaccgttaacccgttttccccctacggttacctttaaccggttttaccggggaaccccggttaaggggtaaacctaaacgggtttacgtaaacggttaaacgttaacccgtaaaacgggtaccgttcgggtacgggtcccttacggaccctaacccgttagttcccgtttagtttacccg

SEQ ID NO: 207073 - DNA, 581 bp, Homo sapiens
  misc_feature: GYAE6OF01A8LCF.17.25.C03.1.454.CMB.1.raw
  modified_base (281)..(281): a, c, t, g, unknown or other
  misc_feature (281)..(281): n is a, c, g, or t
  modified_base (368)..(368): a, c, t, g, unknown or other
  misc_feature (368)..(368): n is a, c, g, or t
  modified_base (441)..(441): a, c, t, g, unknown or other
  misc_feature (441)..(441): n is a, c, g, or t
  modified_base (460)..(460): a, c, t, g, unknown or other
  misc_feature (460)..(460): n is a, c, g, or t
  modified_base (503)..(503): a, c, t, g, unknown or other
  misc_feature (503)..(503): n is a, c, g, or t
  modified_base (513)..(513): a, c, t, g, unknown or other
  misc_feature (513)..(513): n is a, c, g, or t
  modified_base (533)..(533): a, c, t, g, unknown or other
  misc_feature (533)..(533): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctccttatagtatcaactgggtnccgcaggccgctggacaacgacctggagtggagtgggatcggggacaaaccctaacacgtggtcgtcactagtcgttcttcaccctntcccgtaccgggacacgtacttaccatcgacccaacgaccttccctaccgaataaacccacaacgtccctaanagtggaacgttgaggaccncgtgaacagtcaacgaccacgacccgggtccgttactaattcncgtgcggaanccgtcccaacgtcgtccggngaccgcccgtaggcgacgtcggtccctttggacccgttggtcccgggg

SEQ ID NO: 207074 - DNA, 601 bp, Homo sapiens
  misc_feature: GYAE6OF01BNE5F.17.25.C03.1.454.CMB.1.raw
  modified_base (279)..(279): a, c, t, g, unknown or other
  misc_feature (279)..(279): n is a, c, g, or t
  modified_base (372)..(372): a, c, t, g, unknown or other
  misc_feature (372)..(372): n is a, c, g, or t
  modified_base (390)..(390): a, c, t, g, unknown or other
  misc_feature (390)..(390): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctcgtggtgggggtcagagtcaccatcacttgccggacaagtcacggtacgttaaaactatttaaattggtatcagcagaaacctaggaaacnccccagaccctcctgacttctcgtggtcgcactcccactctgacgaaggtcggctcccagtcgaggttcaggtcggcgaggtggatcgtgganagtatttacgaatcctanacctactaccacctacgtctacgacctaacgtgtagtacgttgtacgtacacgttactactactcgtacaacgtagtaacgttaccgaccgtttacccgtctaccgttacggtttcggaaccggtacgggtaaccgtaaagttacggaacgtaacgtacgtaaaccggtacgttcggtcgacgtacgactaaccgtacttcgtcgttaccg

SEQ ID NO: 207075 - DNA, 612 bp, Homo sapiens
  misc_feature: GYAE6OF01CS5UH.17.25.C03.1.454.CMB.1.raw
  modified_base (222)..(222): a, c, t, g, unknown or other
  misc_feature (222)..(222): n is a, c, g, or t
  modified_base (232)..(232): a, c, t, g, unknown or other
  misc_feature (232)..(232): n is a, c, g, or t
  modified_base (243)..(243): a, c, t, g, unknown or other
  misc_feature (243)..(243): n is a, c, g, or t
  modified_base (258)..(258): a, c, t, g, unknown or other
  misc_feature (258)..(258): n is a, c, g, or t
  modified_base (288)..(288): a, c, t, g, unknown or other
  misc_feature (288)..(288): n is a, c, g, or t
  modified_base (324)..(324): a, c, t, g, unknown or other
  misc_feature (324)..(324): n is a, c, g, or t
  modified_base (332)..(332): a, c, t, g, unknown or other
  misc_feature (332)..(332): n is a, c, g, or t
  modified_base (353)..(353): a, c, t, g, unknown or other
  misc_feature (353)..(353): n is a, c, g, or t
  modified_base (363)..(363): a, c, t, g, unknown or other
  misc_feature (363)..(363): n is a, c, g, or t
  modified_base (389)..(389): a, c, t, g, unknown or other
  misc_feature (389)..(389): n is a, c, g, or t
  modified_base (489)..(489): a, c, t, g, unknown or other
  misc_feature (489)..(489): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccgaggtgcagctggtgcagtcgtggggctggaggtgaagagcctggggcctnagtgaggtcnctgcaggcttngattcacgtttaccnctatagtatcaacgtggtgcgcgaggccgntggactacgctgagtggatgggatcgggcaacctanacgtggtntcacgagtcgtcttcgacccntccgccgganacgacttaccatcgaccacgactccncaataaccacacgcctaacagtacggtagttaggacgacgtaccgtagactacttccgtacggaaccgaccggtacccggtaccgttactacgtttaacncgggttacgacggtacgtaccgtacccgtaacggacgttcccgggacgtaccggtacccgtacgggtacccgtacgggtacccggttccgttttacggaaccgtttccggggtaacccggggg

SEQ ID NO: 207076 - DNA, 658 bp, Homo sapiens
  misc_feature: GYAE6OF01EKXNO.17.25.C03.1.454.CMB.1.raw
  modified_base (290)..(290): a, c, t, g, unknown or other
  misc_feature (290)..(290): n is a, c, g, or t
  modified_base (482)..(482): a, c, t, g, unknown or other
  misc_feature (482)..(482): n is a, c, g, or t
  modified_base (511)..(511): a, c, t, g, unknown or other
  misc_feature (511)..(511): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctggaggtgaagagccgtggggcctcagtgaaggtctcctgcaaggcttctggattctacgtttacctccttatagtatcaacgtgggtgccgccgnggcccgcgtaggaaccaacggaccgtggaggtgggagtggggagtcggggaccgaaaccccgtaaacgacgtgggtcgtacgaacgtagtcgttaccttaccaccccgtacgttcccggtccgggaacacgtaccttaccactccgaacccaaccgtaaccctccctacctaaataaaccacgactacctanacgtggtaacgttgacggactctagaacncgtcacgaaccgacgccggtaccttacttacgtacgtagtggaccgtaggtaccccgtaccgaacggtaccgttcgggaacgccggtacccgtacggaccgtacgggtcccggtttaccgtttcggtcccgttcgggtacccggggg

SEQ ID NO: 207077 - DNA, 585 bp, Homo sapiens
  misc_feature: GYAE6OF01D60RA.17.25.C03.1.454.CMB.1.raw
  modified_base (339)..(339): a, c, t, g, unknown or other
  misc_feature (339)..(339): n is a, c, g, or t
  modified_base (458)..(458): a, c, t, g, unknown or other
  misc_feature (458)..(458): n is a, c, g, or t
  modified_base (461)..(461): a, c, t, g, unknown or other
  misc_feature (461)..(461): n is a, c, g, or t
  modified_base (485)..(485): a, c, t, g, unknown or other
  misc_feature (485)..(485): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcagtgaaggtctcctgcaaggcttctggattccacgtttacctcctatagtatcaacgtgggtgcgccaggcccgctggaccaacgacctgacgtggatgggatggggacaaccctaanacgtggtcgtcacgtagtcgtccttccaccctacgtcccgtcccgggacacggaccttaccatcgaccacgaacctcctaccaataaacacacgcctacatggtagtgagagcctgacntcngacgacacggtcttactattacgngtcgcggagtaccgtccccgaagtcgttccgggtacggacgtccccgtaacgggccgtaacgggccggttaccctttcggaaccgttccggtacgggggg

SEQ ID NO: 207078 - DNA, 805 bp, Homo sapiens
  misc_feature: GYAE6OF01EU4E6.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttggtggcagcagctacaagtcgcccacctcccaggtgcagcgtggtgcagtcgtgggctggaggtagaagacgccgtggggcctcgaggtaggaaggttccttccgtggaccgaacgggtcctttcgtaggtactttaccgtaacccgtttttaccctccgttaagttaacggttaacttaccgtaaaccggttggggtaccgccggacccggtaacgggccccgtcgtacgggaaaccaaaccggtacccgtaggtaagggttgggaacggtcggggtaacggttccggggaacccgtaaaaccccgttaaaccgacgggttacggtacggtaccgaacgtaggtttcgttacccttaccgaccccgtaccgtcccggtaccgggaacacggtaaccttaccgaataccgaaccctaacgtaaccctcccgtaacctaaactaaaccgacctaaccgtacctaacgtaacggttagggtaacgttcggaacggtactccgtaagaacctacgtaccggtacgaacccgaaccggtaccggtcccgttaacttaacttcggtaggtaccgacgtaccggtaccgtaccgagttaccgtcggacggtacccgaccgtacggcccgtacggtcccgtttccgttacgtccggttcgggaaccgggg

SEQ ID NO: 207079 - DNA, 612 bp, Homo sapiens
  misc_feature: GYAE6OF01A6WWW.17.25.C03.1.454.CMB.1.raw
tcagcgtagactagcacgaccggtgctcgatttagtagtgtagatttgggtttggggactcaacaaccatatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcagtgaaggtctcctgcaaggtcttcgtggattctacgttttacctccttatagtatcaacgtgggtgcgccaggccgcgtggacaacgacctggaggtggagtggggagtcggggaccgaaccctaacacgtggtcgtacacgtagtgtccttcacccgtactcccgtccgggacacgtacttaccatacgaccacgtaacctcctaccaactaaacacacgcctaacagtggagttaggaggacgcctagacatcgtgaccgacgaccggtccgttacttacttacgtcgtcgacgtaagaccgtacccgaacggtacgttcccgggtggtaccgcccggtaccgggcgtacggtcccggttaccgtttcggtaccgttcgggtaccggggg

SEQ ID NO: 207080 - DNA, 653 bp, Homo sapiens
  misc_feature: GYAE6OF01AGQWY.17.25.C03.1.454.CMB.1.raw
  modified_base (218)..(218): a, c, t, g, unknown or other
  misc_feature (218)..(218): n is a, c, g, or t
  modified_base (332)..(332): a, c, t, g, unknown or other
  misc_feature (332)..(332): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctnagtgaggtctcctgcaaggcttctggattcacgtttacctcctatgtatcaacgtgggtgcgccaggcccgctggacacgacctgagtggatgggatgggaccgaaccctaacncgtggtgtcacgtaggtgtccttccaccctactcccgtccggggacacgtaccttaccagtacgaccacgtaacctcctaccaactaaccacacgaccctacagtacgggtagttggaggtacgccctagactctacgtcgaaccgacgtaccgggtaccttaccttaacgtttacccgtggtacggtaccggtaacggtaccgggttacccccgaacgggttaccggtaccccggggttacggacccggtcccggttaaccgggccgtaacgggtcccgggttacccgttttcggtaccggtttccgggtacccgggggg

SEQ ID NO: 207081 - DNA, 800 bp, Homo sapiens
  misc_feature: GYAE6OF01APOAW.17.25.C03.1.454.CMB.1.raw
  modified_base (190)..(190): a, c, t, g, unknown or other
  misc_feature (190)..(190): n is a, c, g, or t
  modified_base (682)..(682): a, c, t, g, unknown or other
  misc_feature (682)..(682): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagactacaagtcgcccacctcccaggtgcagcgtggtgcngtcgtgggctggaggtagaaggacgtcgtcggggcctacgaggtaggtacgtcctccgtagacgtaacggtctttcgtacggtacttacctaccgttttaccctccttaagtacgttactacgtaacggtgggtcgccgtccggaccggccgtcggtacggaaccgaaccggtaccgtaggtagggtacggtagggtagggtacggtacggggaacccgtaaaacccgttaacgtacggtaggttacggtaccgtaagtcggttacgttcccttacccacccgtaccgtacccggtacccgggaactaaccgtaaccctttaaccgacgtacccggaccctaaccggtaacccttacccgtaaccgtaaacctaaaccgaccgtaaccgtaccgtaagtaacgacggttaacggtggaaccgtcgaccgttacgacgtacgtaccggtaacgaaccggtaccgtacccggttacgttcttaacgttaccggngtaccggtacggtacgtaccgtaccccgtacggtaccggttacggtaccggaccgtacccgggtactcccggtacggtaccgttcccggtttacgtaccgggttccgggtaaccgggg

SEQ ID NO: 207082 - DNA, 885 bp, Homo sapiens
  misc_feature: GYAE6OF01C1FU6.17.25.C03.1.454.CMB.1.raw
tcagcgtagactagcacgaccggtgctcgatttagtagtgtagatttgggtttggggactcaacaaccacatctgtcctctagagaaaccctgtgagcacagctcctcaccatggactggacctggaggatcctcttcgttgggtggcagcagctacaagtcgccccactcccgaggtgcagcgtgggtgcagtcgtggggactggaggtagaaggacgtccggtgggggccttagaggttaggaacggttcctccgtggacgtaacggtctttcgtaggtacttacgttaaccgttttaaccctaccttaagttacgttaactaccgaaacgttggggtacgaccggtaccgacgggcccgtacggtacggaaccgaaaccggtaccgtaggaacgggtgggtaaggttaggggacgtacgggggaaccccaaaaccccgttaaacgtaccggtacgggttacgtacaaccggttacggttacgttacccgtttacccgaacccttaccggtaccccggttaacccggggaaccttaacgtaacccttaaccgtaacgtaccggaacccgtaaaccggtaaaccctaccccgttaaccgtaaacttaaaaacccgacccgtaacggtaaccctaaacgtaacggtacgggtaaggtttacgggaagggtaacgtcccgttaacggaactacttaccgacggtaaccggacggtaccgggttacccgttaagttaaccgtttaacggtacggtacggtaacggtaaaccgtaccgggttaaccccgaggttaaccggtcccggtaggtacccggtaccggtaccgggaccgtaacgggttaccccggtttactttaacgggttccgttccggggtaaccgggggg

SEQ ID NO: 207083 - DNA, 691 bp, Homo sapiens
  misc_feature: GYAE6OF01A0ZLU.17.25.C03.1.454.CMB.1.raw
  modified_base (236)..(236): a, c, t, g, unknown or other
  misc_feature (236)..(236): n is a, c, g, or t
  modified_base (290)..(290): a, c, t, g, unknown or other
  misc_feature (290)..(290): n is a, c, g, or t
  modified_base (305)..(305): a, c, t, g, unknown or other
  misc_feature (305)..(305): n is a, c, g, or t
tcagcgtagactagcacgaccggtgctcgatttagtagtgtagatttgggtttggggacgtcaacaaccacatctgtcctctagagaaaaccctgtgagcacagctcctcaccatggactggacctggaggatcctcttcttggtggcagcagctacaagtatccactcccaggtgcagctggtgcagtcgtgggctggaggtggaagagccgtggggctcgagtgaaggtctcgngcaggcttcgtggtacttacgtacgtttacctcttatagtatacaacgtggtcnccgtccacggggccncgtaggaaccgaaccgaccgttggaaggtcggagtcggggaagtcggggactaaacccgtaacgtgtacggtcgtaacgcctaagggtcgtcttaccaccccgtagtaccccgtacgggtactaagtaaccgttacccaggttaccaacccgtaccgtaacttacccacctaactaaaccgtaaccaaccgtacctaaccgtacgtacgggtaggttacggacggtacgaccgtacgaccacgtacgttcgtacgaccgtacgtaccgttcttacgtacgtcgtacgacgacggtacgtaccggtaaccggtcgttacgggacgtcggtaccgtaacggtaccggtacggtacgttccggttacgtccggtttcgggtacccgggg

SEQ ID NO: 207084 - DNA, 916 bp, Homo sapiens
  misc_feature: GYAE6OF01BSEY3.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctggaggtgaagaagccgtggggcctcgagtgaaggtctccgtgcaaggtcttcgtggattcacgtttacctcctatagtatcaacgtgggtcgcgccaggccgctggacaacgacctggaggtggagtgggagtcggggaccgtaaaccctaacgacgttgggttacgtccgtaacgtacggttcgttccttacccgaaccccgtacgttaccccggtacccggggaacctaacggtaacccgtttaacccggaacgtttaccggaaaccccgtaacccggtaaaccccttcccccgtaaacccgtaaaaccgttaaaacccgaaacccgtaaccgtaaccccgtttaaaacaacggtttacggggtaaacgggttttacgggaaacgggttaaccggtaccccggttaaggtaacccgtaacggttacccgttaacgggaaaccccggtaacccggtacccggggtacccccggttttaacgtttaaaccgttttaacccgggtcgggttaaccgggtaaacccgggttaacgggtaaaccccgggttaaccccccggtaaaccgggttaaccggttccccccgggggttaaacgggtaccccggttaacccccgggttaaccggggtaaccccgggtaccgggggtttacccccgggtttaaccccgtttttacggggtaacccccggtttttccggggggtaaacccccgggggggg

SEQ ID NO: 207085 - DNA, 667 bp, Homo sapiens
  misc_feature: GYAE6OF01A4WVU.17.25.C03.1.454.CMB.1.raw
  modified_base (293)..(293): a, c, t, g, unknown or other
  misc_feature (293)..(293): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaacgtgggtgcgccgaggcccgngtcggaacaacgacctggagtggatggggatcgggaccgaaacccgtacgacgtggtcgtacacgtagttcgtcttaccacccctacgtcccgtaccgggacacggtaaccttaccagttaccgaaccctaaccgtaaccttccctaaccaactaaaccacgtacgacccttaatacgtagggtagttaggacggtacgcctagactacgtcgtagaaccgaccggtaccggtacccgtattaacgttacgtgtacggtacgacgtacccgtacccgacggtaccgttcccgggtagacccggacccgttacgggacccgtacgggttccccgggttaccttttacgggacccgttttcgggtaacccgggggg

SEQ ID NO: 207086 - DNA, 673 bp, Homo sapiens
  misc_feature: GYAE6OF01AVAPW.17.25.C03.1.454.CMB.1.raw
  modified_base (295)..(295): a, c, t, g, unknown or other
  misc_feature (295)..(295): n is a, c, g, or t
  modified_base (502)..(502): a, c, t, g, unknown or other
  misc_feature (502)..(502): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtcgcccactcccaggtgcagctggtgcagtcgtgggctggaggtagaagagccgtggggcctcagtgagtctctgcaggcttgtgtattctacgtttacctctatagtatctaacgtggtcgcgaccgaggccgngtcggacaacgccgtgacggtggagtgggagtcgggacccgaaacccgtagcgttcggtctcgacgttagtcgttctaccgtaccctacgtcccggaccggactaccgtaccttaccacgtaccgaaccgtaccgtaacctaccctaccaactaaaccactaacgtcctaacgtacggtaggtacggttcggaacgtacgaccgtanacgtacgtacgaccgaacggtacccgaccggtacccgttagttaccgttacggtacgtacggacggtacgacccggttacccgaccggtaccgtcccgggtacgtccgggacccgtacggtcccgtacgggttcccggttaccgtttcggtcccggtttcgggacccgggg

SEQ ID NO: 207087 - DNA, 667 bp, Homo sapiens
  misc_feature: GYAE6OF01BQL35.17.25.C03.1.454.CMB.1.raw
  modified_base (177)..(177): a, c, t, g, unknown or other
  misc_feature (177)..(177): n is a, c, g, or t
  modified_base (235)..(235): a, c, t, g, unknown or other
  misc_feature (235)..(235): n is a, c, g, or t
  modified_base (238)..(238): a, c, t, g, unknown or other
  misc_feature (238)..(238): n is a, c, g, or t
  modified_base (250)..(250): a, c, t, g, unknown or other
  misc_feature (250)..(250): n is a, c, g, or t
  modified_base (268)..(268): a, c, t, g, unknown or other
  misc_feature (268)..(268): n is a, c, g, or t
  modified_base (447)..(447): a, c, t, g, unknown or other
  misc_feature (447)..(447): n is a, c, g, or t
  modified_base (590)..(590): a, c, t, g, unknown or other
  misc_feature (590)..(590): n is a, c, g, or t
  modified_base (627)..(627): a, c, t, g, unknown or other
  misc_feature (627)..(627): n is a, c, g, or t
  modified_base (635)..(635): a, c, t, g, unknown or other
  misc_feature (635)..(635): n is a, c, g, or t
tcagcgtagactagcacgaccggtgctcgatttagtagtgtagatttgggtttggggactcaacaaccacatctgtcctctagagaaaaccctgtgagcacgagctcctcaccagtggactgaacctggaggactcctcttcttggtgcagcagctacagtcgcccactcccaggtncgagcgtggtgctagtcgtggggctggaggtgaagacgcgtgggcctgagtgacgtcncgngacaggtcttgngtcttcgtacgtttaccncgtaatagttacgtcgtaacggtgggtcgccgtaccgacggtccgcgtaacggaaccgtaacgaccgttaggacggttggacgtgggacggtaccggtacccgtaaaacccgtagaccggttgggacctacgtaacgtagttcgtacccttaccaaccctccggtaccgtacccggganaaccgttactaccgtaacgaccgaaccgaaccgtaacctacctaaccgaaactaaccaccgactacgaactttggactagggtacgacggacacctagactaacgtcggaacgaacgacggtaccgtacttacgttatacggngtcggacgtagccctcggtaaccgcgtcgtcggaccncggaccgngtccgccgtttagccggtacgtgggtacccgg

SEQ ID NO: 207088 - DNA, 990 bp, Homo sapiens
  misc_feature: GYAE6OF01C1MA2.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggagatcctcttcttggtggcagcagctacaagtcgcccactcccaggtgcagctggtcgcaggtcgtggggctggaggtagaagacgtccgtggggcctgaggtgaacggtcctaccgtgacgaggtcttcgtggtacttccgtaccgtttacctactaataattactacctaacggttgggtcgtaccgaccgtacgggcccgtacggtacggaaccgaacccggtacgttagggacggttgggtaaggtacggggtaacggtacggggaacccgtaaaccccgtaaggtaaccggttgggtaccgttccgaacgttacggtttaccgtaccgttacctaaccccgtacgttccccggtaacccggggactaaccggttaacccttaacgtacaacccggtaaccgtaaacccgttaacccgttacccctaaccgtaaaaccttaaaacccgaaccgttaaacccgtaacccgttaaacgtacgggtttacgggtaaccgggtttaacggggaaaccggtaccgttaacccgggttaccgtaaccgttaacggttttaaccccggaacgggaaacccccgggttaaccgggtaaaccccggggttaccccgtttaaacgggtttttaactttaacccggggttttacgggtaaccgggtaaaccccggggtaacgggttaaacccccgtaaccccgggttaaacccgggttacgggggtttaccccggggttaaacgggtaccccggggttaaaccccggtttaaccccgggggacgttaaccccggggggtttcccggttttaaccccccggggttttaaacggttccccgggggtttaacccgggggtaaccccggggggg

SEQ ID NO: 207089 - DNA, 666 bp, Homo sapiens
  misc_feature: GYAE6OF01D77HH.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaacgtgggtgcgccaggcccgcgtcgggaaccaacggacctggacggtggagtggggagtcggggaccgtaaacccctaacgtacgtgggtagtccgaacgtacggttcgtcctttaccacccctacgtcccgtacccggggaacagtaaccttaccagtccgaaccctaacgtaacctccctaccaaactaaaccaacaccgtacctacacgtagggtacgttaggaggtacgtccgtaggactacgtcgtacgaaccggtaccgacgggtccgttacttacttacgtgtcggacgacgaccgtacccgaacggtcgttaccgggtagaccggcccgtacgggaccgtaacgggtcccgttaccgttttcggtaccgttcgggtacccgggggg

SEQ ID NO: 207090 - DNA, 684 bp, Homo sapiens
  misc_feature: GYAE6OF01CSD3T.17.25.C03.1.454.CMB.1.raw
  modified_base (275)..(275): a, c, t, g, unknown or other
  misc_feature (275)..(275): n is a, c, g, or t
  modified_base (510)..(510): a, c, t, g, unknown or other
  misc_feature (510)..(510): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttgggtgcagcagctacaagtcgcccactccaggtgcagctggtgcagtcgtgggctggaggtgaagagccgtgggcctcgagtgaggtctccgtgactaggcttcgtgtattctaccgttttacctcctatagtntacaacgtgggtgccgccgacggccgtcgtacggaacgaccgaccgttggagtggaggtgggacgtcgggaaccaaccctaagtacgtgggtcgtacacgtacgtacgttcccttaccaacccttccgtcccggaccgggtaaccaacggttaccctttaacccacgttaacgaaccccgtaaccgtaacccttacccgttaaccaaactaaacccaacctaaccgtaccctaanagggtttacgacggttaaggacggacgttaccacggtactaacgttcgtacgacccacgtacccggtcttacgttacttcgtcgtacgacgtaacgaccgtacccaggtaccgtcccggtagacccgtaccgtacggactcggtacccgttgtttaacgcggttcgggccgggg

SEQ ID NO: 207091 - DNA, 895 bp, Homo sapiens
  misc_feature: GYAE6OF01EUGPE.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccaactcccgaggtgcagtctggtcgcagtcgtgggctgaggtagaaggaacgtccgtacggggcctacgtaggtacggtaacggttccgtcccgtggaccgtaacggtccgtttccgttaggtacgtttaccgtaacccggttttacccttaccgttaacgttaacgttaacgttaccgtaacggttcggggtacggacccggtaccggaacggggtccccgtacggtaaccgggtaaccgaaaccggtaccgttacggggtaacgggtgggtacggttacggggacgttacggggaacccgtaaaccccggttaaacgtaccggttagggtaccgtacgtaaccggtaacggtttccgttaaccctacccgtaaccccgtacccgttccccggtaacccggggtaaccctaaccggttaaaccccgttacccgtaaacggtacccgaaaccccgttaaccggttaaacccccttaccccaaccgtaaaaccttaaacccgacgtaacccggttacctaaccgtaggttacgggtaggtttaccgggaacgtaaccctccggtaagtaaccctacgtacggttacccgaaccgaccgggttcccggtacctttaacgttaacgttcgtacgggttcgacgggtaacgtccccggttaccgacggtacggttcggactaccggaccgtacggccgttacggcccggttactttccggcgtcggggtaccggg

SEQ ID NO: 207092 - DNA, 812 bp, Homo sapiens
  misc_feature: GYAE6OF01ATEOE.17.25.C03.1.454.CMB.1.raw
  modified_base (292)..(292): a, c, t, g, unknown or other
  misc_feature (292)..(292): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcgagtgaggtctccgtgcaggtcttcgtggtacttctacgtttaccctctaatagtatctaacgtgggtacnccgccgacggccgcgtcggaccaacgtacctggacggtaggagtaggggagttcggggaacccgtaaaaccccgtaacgtacggtcggtacgtaccgaacgtaggttccgttaccgttaccccaaccccgtaaccgttccccggttaaccccggggtaaacccgtaaccggttaaccctttaaccccgaaacgttacccggaaacccctaacccggtaaacccttccccgtaaccctaaaccgtaaaacccgaacccgtaaccgtaccctaacgtaacgttacggggtaagtttacgggaacggtacgtcccgtaacgactacgttacccgagggtaacccgaccggtaacccgggttcccgttacgtttaaccgtttaacgtacggttccggaaccgggtaactacccggtacccgtaaccgtaccgggttcccggttaacgggcccgtaaccccgtccggggtaccgtacgggtaccccggttccgttttacgggtcccggtttcgggtacccggggg

SEQ ID NO: 207093 - DNA, 609 bp, Homo sapiens
  misc_feature: GYAE6OF01A7O9H.17.25.C03.1.454.CMB.1.raw
  modified_base (281)..(281): a, c, t, g, unknown or other
  misc_feature (281)..(281): n is a, c, g, or t
  modified_base (386)..(386): a, c, t, g, unknown or other
  misc_feature (386)..(386): n is a, c, g, or t
  modified_base (470)..(470): a, c, t, g, unknown or other
  misc_feature (470)..(470): n is a, c, g, or t
  modified_base (481)..(481): a, c, t, g, unknown or other
  misc_feature (481)..(481): n is a, c, g, or t
  modified_base (552)..(552): a, c, t, g, unknown or other
  misc_feature (552)..(552): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagcctggggcctcagtgaaggtctcctgcaaggcttctggattcacgtttacctcctatagtatcaacgtgggtnccgccgaggcccgctacgggacaaccggacctggagtggatggggatcggggaccgaaaccctaacgacgttggtagtccacgtaggtcgttccttaccaccctntcccgtaccgggacacgtacctacatacgaccacgtaacctcccacaactaaaccacacgacctacagtggtagttgacggacnccgtcgaactntcgcgaaccgaccgaccggtaccttactaattacgtgtacgtagacgtaccgtcccgacgtcgtcgggacnccggtcccgtacggccgtaacgggccgttccgtttacggtccgttcgggtccggggg

SEQ ID NO: 207094 - DNA, 614 bp, Homo sapiens
  misc_feature: GYAE6OF01CMBY7.17.25.C03.1.454.CMB.1.raw
  modified_base (346)..(346): a, c, t, g, unknown or other
  misc_feature (346)..(346): n is a, c, g, or t
  modified_base (558)..(558): a, c, t, g, unknown or other
  misc_feature (558)..(558): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttgggtggcagcagctacaagtgcccactcccaggtgcagctggtgcagtcgtggggctggaggtgaagaagccgtgggggcctcagtgaaggtctcctgacaaggcttcgtggattcacgtttacctcctaatagtatcaacgtgggtgcgtcaggccgctggacaacgacctgaagtggatgggatggggaccaaacccgtaanacgtggtgtacacgagttcgtcttcacccatcccgtacggacagacttacatacgaccaacgtaacctccaacctaataaacacacgaccctaacgagtagggtagttacggaaggacgtcccgtaggaaccagttccgtaaggaacccgaccgaccgggtccgttactaattacgtgtacgacgagccgtacccacggtacgtccgggtanaccggtccgtaacggcgtaacggtcccggtacctttacggacgttcggtaccgggg

SEQ ID NO: 207095 - DNA, 667 bp, Homo sapiens
  misc_feature: GYAE6OF01A51XZ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgagtgaagaagccgtggggcctcgagtgaaggtctcctgacaggtcttcgtggattccacgtttacctcctatagtatcaacgtgggtgcgccaggccgcgtggaccaacggtacctggagtgggatggggactgggaccgtaaacccgtaactacgtggtcgtacacgtagttcgttccttaccgacccctagttcccgtaccggggacaggtaaccttacccagtccgaaccacgtaacctccctacaactaaaccacacgtacctaacgtatagggtagtaggaacggacgtcctaggacctagccgttaaggacccgtaacgacccggtccgttacgttaaccgttacgtacgtcggacggtacggtacccgtaccccgaacggtcccggtacccggttaggaccggtacccgttaaccggcgtaaccggtccggtacccggtttcgtaaccggttggtacccggggg

SEQ ID NO: 207096 - DNA, 519 bp, Homo sapiens
  misc_feature: GYAE6OF01D4LZL.17.25.C03.1.454.CMB.1.raw
  modified_base (280)..(280): a, c, t, g, unknown or other
  misc_feature (280)..(280): n is a, c, g, or t
  modified_base (330)..(330): a, c, t, g, unknown or other
  misc_feature (330)..(330): n is a, c, g, or t
  modified_base (337)..(337): a, c, t, g, unknown or other
  misc_feature (337)..(337): n is a, c, g, or t
  modified_base (355)..(355): a, c, t, g, unknown or other
  misc_feature (355)..(355): n is a, c, g, or t
  modified_base (408)..(408): a, c, t, g, unknown or other
  misc_feature (408)..(408): n is a, c, g, or t
  modified_base (425)..(425): a, c, t, g, unknown or other
  misc_feature (425)..(425): n is a, c, g, or t
  modified_base (456)..(456): a, c, t, g, unknown or other
  misc_feature (456)..(456): n is a, c, g, or t
  modified_base (481)..(481): a, c, t, g, unknown or other
  misc_feature (481)..(481): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctggagtggatgggatgggcaaccctanactggtntcacagtgtcttcacccntccgtcgggacagtactacatcgaccacgaactcctacataacacacgcctanatggagttgagactccngacatctagaccgacacggtcctatattacngtgcgagacgtcccagacgtccggngacgcctaggcacggtcgtacctttgcgttcgtcgggg

SEQ ID NO: 207097 - DNA, 638 bp, Homo sapiens
  misc_feature: GYAE6OF01A0ROH.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcagtgaaggtctcctgcaaggcttctggattcacgtttacctcctatagtatcaacgtgggtgcgccaggccgcgtcggacaacgacctgagtggagtgggagtcgggacgaaccctaagacgtggtgtacacgtagtgtccttcaccctactcccgtccgggacacgtaccttaccgatcgaaccaccgtaacctccctaccaactaaaccaccaacgtaccctaactaggtacggtagttaggacggtacgacctagactagtccgtacggaaccgaaccgtaccgggtacccgtacgttattacgtacggtcgtacggacgtaccgtaccccgacggtaccgtccgggtacggtaccgcccgtaacggcccgtacggtcccggttaccgttttcggtaccgttcgggtaccgggg

SEQ ID NO: 207098 - DNA, 604 bp, Homo sapiens
  misc_feature: GYAE6OF01C76TO.17.25.C03.1.454.CMB.1.raw
  modified_base (191)..(191): a, c, t, g, unknown or other
  misc_feature (191)..(191): n is a, c, g, or t
  modified_base (219)..(219): a, c, t, g, unknown or other
  misc_feature (219)..(219): n is a, c, g, or t
  modified_base (225)..(225): a, c, t, g, unknown or other
  misc_feature (225)..(225): n is a, c, g, or t
  modified_base (229)..(229): a, c, t, g, unknown or other
  misc_feature (229)..(229): n is a, c, g, or t
  modified_base (236)..(236): a, c, t, g, unknown or other
  misc_feature (236)..(236): n is a, c, g, or t
  modified_base (250)..(250): a, c, t, g, unknown or other
  misc_feature (250)..(250): n is a, c, g, or t
  modified_base (254)..(254): a, c, t, g, unknown or other
  misc_feature (254)..(254): n is a, c, g, or t
  modified_base (281)..(281): a, c, t, g, unknown or other
  misc_feature (281)..(281): n is a, c, g, or t
  modified_base (381)..(381): a, c, t, g, unknown or other
  misc_feature (381)..(381): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttctggtggcagcagctacaagtcgcccactcccaggtgcagctggtgcagtcgngggctgaggtgaagagcgtgggcttagngagtcnctgnagtctgngcttctacgttccnctanatatacacgtggtcgcgacgaggccgntacggacaacgcgtagaggtaggacgtggacgtgggaccctaaacccgtagacgtcggtactcgaacgtgtcgtacctaccgaacctgtcccggacgganacgtactacagtcgaacctacgacctccacaactaacacactactacagtggtactaggacgacgctagactagtacgtacgaaccgacgaccgtaccgtacgttacgtagttcggacggtacgaacggtactacccgtaaggtacggttccgggagtacggtccgaccggcggaccggttccggttaacgttacggttacgtcggggtaccgggtaccgggg

SEQ ID NO: 207099 - DNA, 748 bp, Homo sapiens
  misc_feature: GYAE6OF01CNKB5.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctggaggtgaagagccgtggggcctgagtgaaggtcctccgtgacgaaggtcttcgtggtacttctaccgtttacctcctaatagtactcgaacgtgggtcgccgccgacgggccgcgtacggaaccaaccggaccgtggacggtggagtgggagtacgggacctaaacccctaagacgtggtcgtacacgtagtcgttcctaccaccctacgtcccggtaccgggactaacgtaccttaccacgtacgaacccgaaccgtaaccctaccctaacctaaactaaaaccgaaccgtaccgtaacccttaaacgtacggttagggtaacggtttacgggaacgggtaccgtacccgtaaggacctacgttacgacggtaacccgaaccggtaccgggtaccctttacgtttaaccgttaccgttcggtacgggaaccggtacggacccgtaccccggaacggtaccggtttccgggaacggtacccggacccggtaccgggtacgtcccgggtaccggtttcgtttaccgggtccgtttccggggtacccggggg

SEQ ID NO: 207100 - DNA, 1031 bp, Homo sapiens
  misc_feature: GYAE6OF01EOEYG.17.25.C03.1.454.CMB.1.raw
  modified_base (160)..(160): a, c, t, g, unknown or other
  misc_feature (160)..(160): n is a, c, g, or t
  modified_base (276)..(276): a, c, t, g, unknown or other
  misc_feature (276)..(276): n is a, c, g, or t
  modified_base (360)..(360): a, c, t, g, unknown or other
  misc_feature (360)..(360): n is a, c, g, or t
tcagcgtagactagcacgaccggtgctcgatttagtagtgtagatttggggtttggggactcaacaaccacatctgtcctctagagaaaaccctgtgagcacagcctcctcaccatggactggacctggaggactcctcttcgttggtggcagcagctanaagtcgcccactccgaggtgcagtcgtgggtgcgtaggtcggtcggggctagggtaagggtagaaacggacggtccggtacggggcccttagaaggtacggtaacggtccttccgnggacgaacggtcgtttcgaggttactttaccgtaccgtttaccctacgttaagtaacggttactacgtaacgggttcggggtcncccggtaccggtaaccgggtcccgtacgtaacggggaaccctaaaccgggtaccgtaggggtacgggtagggtaaccggtcggggtacggtaacccgggaaacccttaaaaccccgttaaacggtcgggttacggggtaaccttacgtaaccggtagtttccggttaccccttaaccggaacccccgttaaccgggtttaccccgggacgggtaacccgtaaaccgtttaaccgtttaacccggaacgttaacccggaaaaccccttaaccccggttaaaacccccttaacccgttaaaaccccggtaaaacccttaaaacccgtaaaccccgtaacccggttaaaccccggttaaaacggttaccggtttaaccgggggtaaaggtttaacccggggtaaaccgggtcccgtttaacccgggtagtaaacccgttaccgggttaacccggtaaccggggtaaaccccgttaacccggggttaccccgggttaactttaaccggttttaaccgggttacccggtaccgggttaccggaacggggttaacccgttacccggaaccccggtaggtacccggttacgggaaccgtacccgggtaccccgtaacgggtcccgggtaacggtttccccggttaggttaccgggttacgcccggggggttaaccggg

SEQ ID NO: 207101 - DNA, 759 bp, Homo sapiens
  misc_feature: GYAE6OF01B4AJW.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctggggcctcagtgaaggtctcctgcaaggcttcgtggattcacgtttacctctatagtatcaactgggtgcgccgaggccgctaggaccacgacctggagtggatgggatgggacgaaccctaacacgtggtcgtcacgagtgttcttccaccctacgttcccgtccggggactacggtaaccctttacccgaagttacgaacccctaaccgtaaccctacccgttaccaaacttaaaacccaacgaaccgtacccttaacgtaacggttacggggtaacggtttacgggaaaccgggtacgtccccgttagtaacccgtactttacccggtcgggaaacccggtacccggtaacccggggttcccgttaaccgttttaacgtttaaccggtccggtttacgggaccggtaaacggttacccggttaacccccgaacggtacccggttccccggggttacggaaccgggtacccccgtaacggggcccgtaacgggtcccgggtttaacccgtttttcgggtaaccccggttttccggggtacccgggggg

SEQ ID NO: 207102 - DNA, 659 bp, Homo sapiens
  misc_feature: GYAE6OF01BNITY.17.25.C03.1.454.CMB.1.raw
  modified_base (281)..(281): a, c, t, g, unknown or other
  misc_feature (281)..(281): n is a, c, g, or t
  modified_base (294)..(294): a, c, t, g, unknown or other
  misc_feature (294)..(294): n is a, c, g, or t
  modified_base (342)..(342): a, c, t, g, unknown or other
  misc_feature (342)..(342): n is a, c, g, or t
  modified_base (355)..(355): a, c, t, g, unknown or other
  misc_feature (355)..(355): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagccgtggggcctcagtgaaggtctcctgcaaggtcttcgtggattcacgtttacctcctatagtatcaagtgggtncgccgaggcccgngtggaccaacggacctggagtggagtgggatcgggacaaaccctaacncgttggtctacanagtcgtccttacaccctgtccgtaccgggacacgtaccttaccatacgacccacgtacctccaccaataaaccacacgtaccctaagacgtacggtaggttacgacggtacgtccgtagacctaacgttccgtacggaaccggaacccgtacccgggtacccgtttacgttaacgttaaccgtggtaccggacggtacgtaccgtaccccgtaccggtaccgttacccgggttacgaccggtacccgtacgggaccgtaacgggtccggttacccgttttggtacccggttgggtacccggggg

SEQ ID NO: 207103 - DNA, 626 bp, Homo sapiens
  misc_feature: GYAE6OF01B6DF1.17.25.C03.1.454.CMB.1.raw
  modified_base (547)..(547): a, c, t, g, unknown or other
  misc_feature (547)..(547): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcgagtgaggtctcctgcaggcttgtggattcacgtttacctcctatagtatcacgtgggtcgcgtccgaggccgcgtcggacaccgccgtggagtggagtcgggagtcgggaccgtaaccctacgtacgtggtcgtaccaacgtagttcgttccttaccgaccccgtaccgtcccggtaccgggactacgtaccttaccgtacgtaccgaaccaaccgtacctacccgtaacctaacaaacaccacgtaaccctaacgtaggttaggacggttaggacgacgtcgtaagaacctgtcgtcgaaccgtacgaccgttccgtatacttcgngtcgaccgtagaccgtacccgcgtccgtggcgacgcccgtacgcgtaccggcggttaccttcggccgtttgggaccggg

SEQ ID NO: 207104 - DNA, 644 bp, Homo sapiens
  misc_feature: GYAE6OF01AB8D3.17.25.C03.1.454.CMB.1.raw
  modified_base (561)..(561): a, c, t, g, unknown or other
  misc_feature (561)..(561): n is a, c, g, or t
tcagcgtagactagcacgaccggtgctcgatttagtagtgtagatttgggtttggggacgtcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggcctcgagtgaacggtctcctgcaaggcttctggattctacgtttacctcctaatacgtatctaagtgggtgccgtccgaggccgcgtggacaacgacctggacggtggagtgggaagtcgggactaaccctagactgggtctaccgagtagtcggtccttacaccgtacttcccggccgggaactacggtaaccttaccgacgttacgaacccgacggtaacccttacccgtaactaacttaaaccgaccgacgtacccttaagaccgggttagttacggtacaacggggtctaaccctgggtaactcttacgcgtaacggcaacgggtcctagttactacggntcggacacggtctacccggagtcgtccggtagcccggttacgacggcgaacgtccggttaacttcgggacttcgggtaacggg

SEQ ID NO: 207105 - DNA, 714 bp, Homo sapiens
  misc_feature: GYAE6OF01BY0NE.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtgggcctgagtgaacgtctacctgacgaggtcttgtggtacttcctacgtttaccctacgtataagtactaccgaacgtgggtcgccggaccgtacgggcccgcgtacggaacctaaccggtaccgtaggacggtaggaggttgggagtcgggaacccgtaaacccgtaactcgtggtcgtacacgtagtcgtccgttacacccctagtcccgtacgggacacgttaaccttaccgactaccgaacccgtaactaacctccctaacctaactaaaccacaacgtcctaacgtagtaggtagttaggaacgtcgtaccgtacgaactacgtacgtaccgtaaccggacccgaccgggttcccgttaacttacgtttacgtcgtacggtaccggtacgtacccgtacccggtaacggtccgttccggggtacgtacccgggtaccccgtacggacccggtaacggtcccggtttaccgtttcgggtaccgttccgggtacgggg

SEQ ID NO: 207106 - DNA, 933 bp, Homo sapiens
  misc_feature: GYAE6OF01DGE6R.17.25.C03.1.454.CMB.1.raw
tcagcgtagactagcacgaccggtgctcgatttagtagtgtagatttgggtttgggactcaacaaccacatctgtcctctagagaaaaccctgtgagcacagctcctcaccatggactggacctggaggatcctcttcgttggtgcgagcagctacaagtcgcccactcccgaggtgcagtctggtgcgaggtcgtcggggctgggaggtaggaagacggccggtggggcctcggagtaggtaacggttcctccgtaggacgtaacggtccgtttacgtacggttacttcccggttaaccgttttaccctaccttaagttacgttacgttaccgtaacggttcggggtcgcccggccggtaacgggtcccggtacgtacggaacccgtaacggtaccgttaggtaacgggtaggaggttacgggggaacgtacccgggggtaaccccgtaaaaccccgttaacggtaccgggttaacggttaccggttaccgaaaccgggtttacggtttccccggttaaccctttaccccgaacccccgttaacccggtttaccccggttaaccccgggggtaaactaaacccggtttaaaccccgttacccgtaaaccggtaaccccggtaaaccccgtaaacccggtaacccccttaaccccttaaccccgtaaaaccttaaaacccgaacccgtaaacccgtacccgtaaccgtaaggtaacgggttaacggttacgggaaccgtaccgttaccgacgtaacgtaccgttaccggaaccggaaccggtaacccgtccgggtacccgtttacgtaaccgttcgtacggtcggaacccggttaacgaccccggtaacccgtaccggtacggtacccggttcgaccggttacccgagggtccgacgggtcccgttacgtccggttccggtcgggtacccggg

SEQ ID NO: 207107 - DNA, 785 bp, Homo sapiens
  misc_feature: GYAE6OF01BF3PE.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagaagccgtggggcctcgagtgaaggtcctccgtgacgaaggtcttcgtggtacttcgtacgttttaccgtccttaagtacgttatacgtaacggttgggtcgccggccgtacgggcccgtacggtacggaaacccgaaccgtacccgtggaacggtagggaggttagggggacgtcggggaacccgtaaaaccccgtaacgacggttacgggtacgtacctaacgtacggtttacgtccttacccgaccccgtacgttacccggtacccggggtaactaaccggttaaccctttaacccgaacgttacccgaaacccgtaaccggtaacccctttacccctaacccgtaaaactaaaacccgtaccgaaaccgttaccctaacgtacgtacgggtaacggttaggaaccggtacggtacctacggacctatccggtacgaacccgtacccggaccgggtaccttacttaacggtttactcgggtcgtaacgtacggtacccgtaccgtacgccggttccggacgccggtacccgtacggcgtacgggcccggttatttacggccgtttgggtacccgggg

SEQ ID NO: 207108 - DNA, 794 bp, Homo sapiens
  misc_feature: GYAE6OF01C9UNL.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagaagccgtggggcctgagtgaacggtctccgtgacaaggtcttcgtggtattcctaaccgttttacctcctaatagtatacgtaacgtggggtacgcgccgaggcccgcgtaggaaccaacggtacctaggaggtgggtagtggggtaacgtacggggtaacctaaaaccccgtaaacgtaccggttagggtcgtaaccgaacgtaaggttccgttaccttaccgaaccccgtacgtcccggtaaccgggaactacggtaacctttaacccgaagttaaccgaacccgtaaaccgtaaaccttaccccgtaaccgtaaaacttaaaaacccaccgtaacgttaacccctaaacgtaacggttagggtaaacggtttaacgggaacgggtaccggtaccttacggaactaacgttcccggttaaccggaaccggttacccgaaccggggttcccttaagtttaacgttacggtacgtcggaaccgtaaggtacccgtaccgtaacggtcgtaccgggtacggaccgtacccgacgggtacgtaccgggtccggttaccgtttacggttaccggttcgggtaaccgggg

SEQ ID NO: 207109 - DNA, 705 bp, Homo sapiens
  misc_feature: GYAE6OF01DY9AO.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatccttttccgtggtggcagcaggcacaggtcgcccacgcccgaggttcagttggtgcagacgtggggctgaggtgcagaagccgtgggcatcagtgacttgtctccgtgcaacggcctaggtggattatataccttacaaactaaaagttagtaggtaatagtaagtttggggcgtaccggaaccgacccggggacccccggaacggaacggggtccgttagggagggttgggggtaggggtggtacgaggtcggttcgttagggtaacggtaaggtccgacgtagtatacgaccgaacgtaaaggtagtaggaagggtccgaaagtacggtaccgaacgtaaccgttacccgaacggtaaccccacccccgaaacgaaccgaccgtacgtaccgtaacacgtacaccgtaagtaccggacgtacgccgtagaagcgacgtacgacgtaccgacggtccttagttacttaagtcggtacgaacgttagttaactttgttttaccgtagttacctaacgtttacgtaacctttaaggttacgtacttaacggttcttacgttaggtcggttacgg

SEQ ID NO: 207110 - DNA, 642 bp, Homo sapiens
  misc_feature: GYAE6OF01B0CZX.17.25.C03.1.454.CMB.1.raw
  modified_base (487)..(487): a, c, t, g, unknown or other
  misc_feature (487)..(487): n is a, c, g, or t
  modified_base (497)..(497): a, c, t, g, unknown or other
  misc_feature (497)..(497): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcgagtcgtgggggctggaggtgaagaagccgtggggcctgagtgaaggtctctgcaggcttcgtggtacttctaacgtttacctctatagtatacaacgtgggtcgcgccgaggccgcgtaggacaacgacctgagtggagtgggagtacgggacctaacccgtaacagtggtcgtacacgagttcgtccgttacaccccgtatcccgtacgggtaacaggtaacccttacaacgttcggaaccctacgaacctccctactaaacgtaaacacagaccctatatagggtagttaggacggtanccctagaccntaccgtagaaccggtacaccggggttccctagttactaacgtggtaccgacgtagggtacctacccgagtaccgggtcccggaggaccgtccccgagggccctacggggacccgttccgttacggtccgttcggtacccgggggg

SEQ ID NO: 207111 - DNA, 727 bp, Homo sapiens
  misc_feature: GYAE6OF01AFHU1.17.25.C03.1.454.CMB.1.raw
  modified_base (621)..(621): a, c, t, g, unknown or other
  misc_feature (621)..(621): n is a, c, g, or t
  modified_base (667)..(667): a, c, t, g, unknown or other
  misc_feature (667)..(667): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcgagtgaacggtctcccgtgcgaaggtcctttctggtacttccgtaccgttttacccgtacctattagttactcctaacgtgggtcgccggccgacggcccgcgtacggaacctaaccgaccgttacggaggttcgggagtggggacgtacgggtaacccgaaaccccttaacgtaccgttgggtcgtaccacgtaggttcgttaccttaccgacccgtacgttcccggtaccgggaacctacgtaacccttacgacgtcgaaccctacgaaccttcccgtaccaaactaccgaccgtacgaccctaacgaggtacgtacggtagacggtacgcccgtaggaactaccgtcggtaacgaaccgacccggtaaccgggttcccttaaccgtacgtttaccgnggtaccgacggtaccgtaccgtaccccgaggtacccgttccggganaccggtacccgtccgtacgtaccgggtcccgttacgtttcgaccgggtcggtaccggggg

SEQ ID NO: 207112 - DNA, 693 bp, Homo sapiens
  misc_feature: GYAE6OF01D8DE0.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcagtgaaggtctcctgcaaggtcttcgtggtattcctaccgtttacctccttatacgtactactaacgtgggtcgccgccgacggcccgcgtacggaacaaccggcctaggaggtggagtggggacgtcggggaccaaaccctagacgtggtcgtacacgtaggtcgtccttaccacccgtacgtcccgtacgggactacgtaacctacgatccgaacctacgtacctccctaacaactaaccacacgtccctaagacgtagggagttggacggtactccgtacgactcgtcgtacggaacccgtacgtacccgggttccgttacttaacgttccggtaggtccgaaccggtagtaccccggtacccgtaaccgggtcgttacccggggtacgacccggtaccccgggtaaacggcccgtacgggtccccggtttccgttttaccgggtacccggttcgggtaacccgggggg

SEQ ID NO: 207113 - DNA, 627 bp, Homo sapiens
  misc_feature: GYAE6OF01DIUPW.17.25.C03.1.454.CMB.1.raw
  modified_base (433)..(433): a, c, t, g, unknown or other
  misc_feature (433)..(433): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcctggggcctcagtgaaggtctcctgcaaggcttcgtggattcacgtttacctcctatagtatcaactgggtgcgccaggccgcgtggacaacgacctgagtggatggggatgggacgaacccctaacacgtggtgtcaacgagtgtcttccaacccactccgtccgggacacgacttaccgatcgaccaacgaacctcctaccaataaacacacgtcctaacngtacgggagtttcggaaggtacgtaccgtagacctattcgtagaaccgaaccgtaccgggtccgtacttaagttaccgtggtgaccgaaggtaccgtacccgacggtaacgtcccgggtaggaccggtacccgttaccgggaccgtacggacccgggttccctttttacgggcccgtttcgggtacccgggggg

SEQ ID NO: 207114 - DNA, 683 bp, Homo sapiens
  misc_feature: GYAE6OF01DCKAY.17.25.C03.1.454.CMB.1.raw
  modified_base (295)..(295): a, c, t, g, unknown or other
  misc_feature (295)..(295): n is a, c, g, or t
  modified_base (490)..(490): a, c, t, g, unknown or other
  misc_feature (490)..(490): n is a, c, g, or t
tcagcgtagactagcacgaccggtgctcgatttagtagtgtagatttgggtttgggactcaacaaccacatctgtcctctagagaaaaccctgtgagcacagctcctcaccatggactggacctggaggatcctcttctggtggcagcagctacaagtcgcccactcccaggtgcagctggtgctagtcgtggggctggaggtgaagaagccgtggggcctcgaggttggaaggttctccgtgacgaaggtcttgtggatttccgacgtttactcctatagtatcgaacgtggtnccgacgacggtccgtcgtagacccgaacgtaccgtaggacggtcggagtagggactcggggacctaacccgtaagaccgtaggtcgtacagtacgtcgtaccttccgaaccacgtcccgtacggaactacgtaccgtaccagtacggacccaacgtaacctacccgtaccaactaaaccgcaacgtaccctaatntagggcgttaagagacgtcaacgctacgtcgtacgacgtaccggtaccgtaccgttacgttaacttaaccggtgtacccggagtaccgggtaccgtacccgtaaccggtccggttaaccggcgtaaccggtaccccggtaacggcccgtaacggtcccggttacctttccggtaccgttcggggtaacccggg

SEQ ID NO: 207115 - DNA, 902 bp, Homo sapiens
  misc_feature: GYAE6OF01CUERE.17.25.C03.1.454.CMB.1.raw
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtcgcccacctcccaggtcgcgagcgtggtagcgagtcggtgggctaggaggtacggaagacgtccggtcggggcctagaggtagaacggtcctccgtcggacgaacggtcttcgtaggtactttaccttaaccggtttaccttaccgttaagtttaacgtaacttaccgtaaggtttcggggacgtcccggacccggtacgggccccggtacgtaacggggaaaccctaaaccggtaccggttagggaacgggtttacgggaagggttacgggggtaacgggttacccggggaaaacccgtaaacccccggttaaaaccggtaccgggtttgggtaccgttaccgaacggttacggttacggttacccttaccgtaaaccccgtcgttaccccggtaacgggaaccttaaccggtaaccttacgactaccggaacccaaccgtaaccctacccgtaaccaaactaacctaaaccgtccgtaacgtaaccgagttacgggtaacggttacgggaacgtacgtaccgttaacgacgtaacgtccggtaacggtaacccggtacccggtaacccgggttaccttaacggttttaacctaccggttacggttaacggacggttaaaccgcccggtaaccccgtacgggttacccggtaccgggtacggtaccggtacccggtaccgggtacgtcccgggttacccggttcccggttttcggtaccggttcggggtaaccccggggg

SEQ ID NO: 207116 - DNA, 783 bp, Homo sapiens
  misc_feature: GYAE6OF01CY1KW.17.25.C03.1.454.CMB.1.raw
  modified_base (276)..(276): a, c, t, g, unknown or other
  misc_feature (276)..(276): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttggtggcagcagctacaagtcgcccactcccaggtgcagctggtgcagtcgtgggctggaggtgaagacgccgtggggcctcgagttgaaggtctccgtgcgaaggtctttcgtggtacttcctaccgtttaccnccgttatacggttactacgtaacgtttgggatccggacgtacgggcccgtacgttcggaaacctaaccgcccgttaggaaggttcggggtaacttagggggaacttacgggggaaccccgtaaaacccgttaacgaccgttagggtacgtaaccgtaccgtaagggtttcgtaccctttaccaaccccggttaacgttcccggtaacccgggggtactaaccggtaaaccctttacccggatttacggaaaccccgtacggtaaacccttcctaacccgtaaacttaaacccgtaaccgaaccgtacccttaaacgaacggttcgggttaacgttacgggacggtaacgtacccgtagtaactaccgtacgtacggaaccgtacgtaccggtcccgttattacgttacgacgttcgaacgacgaccgttccaacggttcctacgggtgacccggttaccgacggacccgtacgtcccggttactttacggcgttcggtacccggggg

SEQ ID NO: 207117 - DNA, 691 bp, Homo sapiens
  misc_feature: GYAE6OF01CI42D.17.25.C03.1.454.CMB.1.raw
  modified_base (283)..(283): a, c, t, g, unknown or other
  misc_feature (283)..(283): n is a, c, g, or t
  modified_base (295)..(295): a, c, t, g, unknown or other
  misc_feature (295)..(295): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaaggcctggggcctcagtgaaggtctcctgcaggcttcgtggattctacgtttacctcctatagtatcaactgggtnccgccaggccgngtcggacaacgacctggacgtggagtgggatcgggaccgaaaccctaacgacgtggtcgtcgacgtaggttcgttccttaccgacccctacgtcccgtaccgggactacgtaccttaccgattccgaaccctaacgtaaccttccctaccaaactaaaccacaacgtccctaacgacggttacgggtagttacggaggtacgtacccgtaggaacctacgttcgtacggaaccgaccgtaccgggtcccgttacttaacgtttaccgtcggtacggacggaacgtacccggttaccccgaacggtaccgttcccgggtacggacccggtaccccggtacggccgtaacgggtcccgggttaccttttcgggtacccgtttccggggtacccggggg

SEQ ID NO: 207118 - DNA, 924 bp, Homo sapiens
  misc_feature: GYAE6OF01CF3S5.17.25.C03.1.454.CMB.1.raw
tcagcgtagactagcacgaccggtgctcgatttagtagtgtagatttgggtttggggactcaaacaaccacatctgtcctctagagaaaaccctgtgagcacagctcctcaccatggactggacctggaggatcctcttcgttggtggcagcagctaacaagtcgcccacctcccaggtgcagcgtggtgcagtcgtgggctggaggtgaagaacgccgtggggcctcgagtgaacggtctccgtgacgaaggtcttcgtggtacttcctaccgttttacctacctataagtactaccaacggttggggtacgccgaccgacggggtccccgtacgtacggaaaccgaaccggaacccgttagggtaaggtcggggtaggttagggggacggtacggggtaacccgtaaaaccccgttaaccgtaacggttcgggtaccgtacgtaacgtacggtttacggtttacccttacccgtaacccccgtacgtaccccggtacccggggtaactaaccggttaaccctttaacccgacgttaacccggaaccctaaacccggtaacccttccccgtaacctaaaactaaaccctaaccgtaaccgtaacccttaaacgtaacggttacgggtaacggtttcgggaaacgggttacccgtaccccgttaagaacccgttacgttaccggtaaccggaaacccggtaaccccgggaacccgggttcccgttttaaccgtttaacgttttaacccggtcgggttaaccgtaaccgggtaaccgggtacccccggttaacccgaaaccgggttcccggttaacccggggacggttaaccccggtccccgggttaacgggacccgttaacgggttcccccgggttaacccggtttttacgtaacccgggtttcccggggtaaaccccgggggg

SEQ ID NO: 207119 - DNA, 601 bp, Homo sapiens
  misc_feature: GYAE6OF01A64OS.17.25.C03.1.454.CMB.1.raw
  modified_base (546)..(546): a, c, t, g, unknown or other
  misc_feature (546)..(546): n is a, c, g, or t
  modified_base (552)..(552): a, c, t, g, unknown or other
  misc_feature (552)..(552): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagctggggcctcagtgagtctcctgcaaggcttctggattcacgtttacctctatagtatcaacgtggtcgcgaccaggccggctcgggaacaaccggacctggagtggacgtggggatcggggaccgaaacccctaacgacgtggtgtaccaacgtaggttcgtccttacgaccctacgtccgtcccggggaactacggacttaccatcggaccacgaactcctaccaataacacagtaccctacgagtacggagttacgaggactccgtgaacctatcgtacgacgacgaccggcgttactattaccgtgcgacgagtcggtacccagtcccgtacggnggaacncccgttaaggcctacgggcccgttacgttcggtacgtccggtacggggg

SEQ ID NO: 207120 - DNA, 607 bp, Homo sapiens
  misc_feature: GYAE6OF01EXT3C.17.25.C03.1.454.CMB.1.raw
  modified_base (184)..(184): a, c, t, g, unknown or other
  misc_feature (184)..(184): n is a, c, g, or t
  modified_base (278)..(278): a, c, t, g, unknown or other
  misc_feature (278)..(278): n is a, c, g, or t
  modified_base (435)..(435): a, c, t, g, unknown or other
  misc_feature (435)..(435): n is a, c, g, or t
  modified_base (522)..(522): a, c, t, g, unknown or other
  misc_feature (522)..(522): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtncagtctggggctgaggtgaagagctggggcctcagtgaaggtctcctgcaggcttctggacttcacgtttacctctatagtatcaacgtgggtncgccaggccgctggacaacgcctgacgtggagtgggatcgggacaaaccctaacgacgtgggtgtcacgagtcgtacttacaccctacgtcccgtaccgggacacggtaccttaccgattccgaacctacgtaacccttccctaacaacttaaaccncgtaaccgtcctaacgagttagggacgttaggacggtacgccctagactagtcgtacggacaccggaccggtccttacttaattcgngtcgaccgacgtccgtacccaggtacttcccgggataccggcccgtacgggcacggggtcgtacctttggccgttgggaccgggg

SEQ ID NO: 207121 - DNA, 637 bp, Homo sapiens
  misc_feature: GYAE6OF01CLHCV.17.25.C03.1.454.CMB.1.raw
  modified_base (184)..(184): a, c, t, g, unknown or other
  misc_feature (184)..(184): n is a, c, g, or t
  modified_base (277)..(277): a, c, t, g, unknown or other
  misc_feature (277)..(277): n is a, c, g, or t
  modified_base (287)..(287): a, c, t, g, unknown or other
  misc_feature (287)..(287): n is a, c, g, or t
  modified_base (432)..(432): a, c, t, g, unknown or other
  misc_feature (432)..(432): n is a, c, g, or t
  modified_base (473)..(473): a, c, t, g, unknown or other
  misc_feature (473)..(473): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtncagtcgtgggctgaggtgaagagcctggggcctcagtgaggtctcctgcaggcttcgtggattctacgtttacctcctatagtatcagtggtncgcaggccgngtggacacgaccgtgagtggatgggagtcgggacctaaccctagacgtggtcgtcacgtagttcgtaccttaccgaccctatcccgtccgggacacgtaccttaaccgatacgaccaaccgaccttacccgacctaactaaaccnctacgtacctacaggtacgagttgaacggtcacgtacgacncgtacgtcgacgacgaccggtaccgtacttacgtttacgcgttacgaccggtacgtaccggttacccgaggtacccgttcccgggacggtaccgtaccccggtaacgggtccgaaccgggtccgggttacccttttacgggtccggtttccggtacccgggggg

SEQ ID NO: 207122 - DNA, 740 bp, Homo sapiens
  misc_feature: GYAE6OF01CQENF.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaaggtctcctgcaaggcttctggattctaccgtttactcctatagtatcaacgtgggtgcgccaggccgtcgtggacaacgacctggagtggatgggagtcgggaccaaacccgtaacgacgtggtcgtacacgtagtcgttaccttccacccctactcccgtaccgggacacgtaccgttaccactcgaaccacgtaacctccctaccaattaaaccgaaccacgtaccctaacgagttacgggtaagtttacggaaggtcgtacccgtaggaaccctagttaccgttaacggaacccggtaaccggtacccggggtacccgtttaccgttaacgtttaaccgttgggtaaccggtaccggtaaggtacccggtaccccgtaaaccgggttaccggttaccccggggtttaggaacccggttacccccgggttaaccggggacccgtacccggggttacccgggtttacccgtttttacgggtacccgttttcccgggggtaaccccggggggg

SEQ ID NO: 207123 - DNA, 645 bp, Homo sapiens
  misc_feature: GYAE6OF01E0WXS.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtctggggctgaggtgaagaagccgtggggcctcagtgaaggtctcctgcaaggcttcgtggacttcacgtttacctctatagtatacaacgtgggtgccgcgacggccggctaggaaccaaccggaccttggaggtggagttggggatcggggacctaaacccctaacgacgttggtgtaccataggttcgttccttacacccctaagtcccgtccggggaacagtacctaccataccgaaccacgaacctacctaccaactaaacacacgacctaacagtgagttaggaaggtacgacctgactacgtacgacgaacgaccgacgggtacccttagttacttacgtaggtcggacgaagtaccgtacccgaaccggtagttaccgggtacggtacgacccgtaccgggacgtaacgggtcggttacccgtttacggtacccgttcgggtaccgggg

SEQ ID NO: 207124 - DNA, 697 bp, Homo sapiens
  misc_feature: GYAE6OF01CJI7G.17.25.C03.1.454.CMB.1.raw
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
  modified_base (365)..(365): a, c, t, g, unknown or other
  misc_feature (365)..(365): n is a, c, g, or t
  modified_base (388)..(388): a, c, t, g, unknown or other
  misc_feature (388)..(388): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggtattctacgtttacctcctatagtatcaactgggtncgccaggccncgtggacaacgacctgagtggatgggatggggacgtaaccctaacgactggtagtcactagtgtcttcacccntcccgtcgggacacgcttaaccntacgaccacgaactccctaccaattaaacacagcctaagatagggagtttaggacggactccgttacgaactactccgttaacgggacccgtaaacgacccggggtacccgtttacgttaacgttttaacccggtggtttaaccgggcccggttaaaacgggtacccggttacccccggtaaaccggtacggttaccccggggttaggaaacccgggttcccccggtaaaaccggggtcccgtaaacgggtccccggggttaccccttttttcgggtaaacccgtttcccgggggtaaccccggggggg

SEQ ID NO: 207125 - DNA, 515 bp, Homo sapiens
  misc_feature: GYAE6OF01B3941.17.25.C03.1.454.CMB.1.raw
  modified_base (402)..(402): a, c, t, g, unknown or other
  misc_feature (402)..(402): n is a, c, g, or t
  modified_base (410)..(410): a, c, t, g, unknown or other
  misc_feature (410)..(410): n is a, c, g, or t
  modified_base (421)..(421): a, c, t, g, unknown or other
  misc_feature (421)..(421): n is a, c, g, or t
  modified_base (427)..(427): a, c, t, g, unknown or other
  misc_feature (427)..(427): n is a, c, g, or t
  modified_base (430)..(430): a, c, t, g, unknown or other
  misc_feature (430)..(430): n is a, c, g, or t
  modified_base (444)..(444): a, c, t, g, unknown or other
  misc_feature (444)..(444): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcaccccatcctccgggacagacttaccatgaccacgaactccaccataaacncagcctanatggattgagnctgacntcngacgcgacggcctntattactgtcgcgagcgtcccagctccggagcgccgtacggcacggccgtacctttgaccgttggtcgggg

SEQ ID NO: 207126 - DNA, 722 bp, Homo sapiens
  misc_feature: GYAE6OF01DPH34.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtctccgtgcgaaggtcttcgtggtacttctacgttttacctcctatagtatcaacgtgggtcgcgccgaggccgcgtcggacacgacctggagtgggagtgggagtcgggaccgtaaccctaacgacgttgggtgtaccgaacgtaggttcgttccgttacccaaccctacgtccccgtaccggggaactacgtaccttaaccatacggaacccacgtaaccgtcccttacctaactaaacctaacaccgaacctacctaacgtaggtacgggtagtacgggaacggtaccgtacctacggaactcgttacgacggtaaccggacccgggttacccggtaccgtttacgtttaacgttcgtacgggtcggaacggtaccgtaacccggtacccgtaaccggtacggttacccgggacggtacccgtacccgggtacccgggtacggtacggtccccgggttttaacgttccggttccgggttacccggggg

SEQ ID NO: 207127 - DNA, 952 bp, Homo sapiens
  misc_feature: GYAE6OF01EOFW7.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagacgccgtggggcctcgagtgaacggtctcctgcgaaggtcttcgtggtacttcctaacgtttaccctccttatagtactactaacggtggggtcgccggaccgacgggcccgtacgtacgggaacccgaaaccggtacccgtagggaacggttggggaaggttacgggggaacggttccgggggaaccccgtaaaaacccccgttaaaacgtacccgggtttaggggttacgtaaccgtaaccggtaaggtttcggtttaccctttacccgaacccccgttacgttacccccggtacccgggggtaaacctaacggttaacccctttaaacccgtaacgttacccggaaaccccgtaacccgtaaacccctttaccccctaaacccgtaaaccgttaaaaacccgaacccgtaaacccgtaaccccgtttaaaccgtaacgggtttaacggggtaacggtttaacggggaacgggtaacccgttcccgtaacggaaaccgttacgttaacccggtacggtaaaccccgggtaacccggaccccggggtttaccccgtttaacgtttaacgtttaccgtacgggttacccggaaccgggtaaccggtacccggttaacccccggtaacgggttacccgggttacccggggtaacgtaccccgggtaccccggtaaccgggacccgtaccggggtccccggtttaacccgtttaccgggtacccgtttccggggggtaaccccgggg

SEQ ID NO: 207128 - DNA, 726 bp, Homo sapiens
  misc_feature: GYAE6OF01AN7VL.17.25.C03.1.454.CMB.1.raw
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtgcccactcccaggtgcagctggtgcagtcgtgggctggaggtagaagaagccgtggggcctcgagtgaaggtcctccgtgcgaaggtcttcgtggacgcctaccgttcgagccgtactaattagtttacaagttgggtcgcggaccggtcctcgtcggacacggtccgttgagtaggtacgtgggaagtctccgtaccgttagtcgttacgaccaaccaaccgtaaacgtacgacaacgacgtaacgttccgaagggacacgtaaccgtacaacctaacgtaacccggacgtaaccgaaaacgttaacgaaactaacgtaacgttaaacgtacgtacggacgtaccgtaagaaccgacgtaccgttacgtacgacttaccgtacggacgtaaccggtaccggttaccttaccgttaccgtttacgtacggtaggtacgtaaaggtacgttaaaacgttacgtaaacgtaaaccttacgttacgttacccttttaccccgttttaacgtacccccttttacccgtttacgttacccgttccggtccgggtacccgttaaccccggg

SEQ ID NO: 207129 - DNA, 839 bp, Homo sapiens
  misc_feature: GYAE6OF01B9E11.17.25.C03.1.454.CMB.1.raw
  modified_base (236)..(236): a, c, t, g, unknown or other
  misc_feature (236)..(236): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctgggaggatcctcttcttggtggcagcagctacaagtcgcccactcccaggtgcagctggtgcaggtcgtggggctaggaggtgaagagccgtggggcctcgagtgaggtcncctgcaggtcttcgtggtattcctacgtttacctactatagtatacgaacgtgggtcgcgtccgacggccgcgtaggaaccaacgaccgtagaggtcggagtgggacgtcgggaaccgtaaacccgtaacgtacgtggtcgtacgacgtaggttcgttaccttacccgaaccctacgtacccggtaccggggtaaactaaccggttacctttaacccgaacgttacccggaaaccgtaaccccggtaaaccctttacccgtaaccctaaaaccggtaaaaccctaaccgtaaccggtaacccttaacgtaacggttacgggttaacggtttaagggaccgggtaaccgtaccggtaacggtaaccgtaacgttaccgtacgggaaacccggtacccggtaacccggggttacccgtttaaccgttaaacggtttaccggtcgttaccgggaacccgggtaaggttaccccgaaaccccgggttaacggtacccgggttaccgggtaccgggtaacccggttacccggtaaacccggggccgtaacccggggtaccgtttaccccggttttacggtacccgggttcccggggtaacccgggggg

SEQ ID NO: 207130 - DNA, 646 bp, Homo sapiens
  misc_feature: GYAE6OF01CAOE2.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgctagtctggggctgaggtgaagagccgtggggcctcagtgaaggtcctccgtgcgaaggtcttcgtggtattctaccgtttacctacctatagtatcaacgttgggtcgcgccaggccgcgtcggaaccacgaccgtggaaggtggagtgggagtcggggaccgtaaaccctaactacgtggtacgtcgacgtagtcgtcttccaccctacgtccgtccggactagtaccttaccagtacgacctacgtaaccctccctaaccaactaaaccacacgtcctaagtacgtaggtacgttaggaggtactccgtagactacgtcgtagaccgtaccaccggggtacccttcgttaacgttacgtggtcgacgacggtaccgttaccgacggtacgtccggtacggcggtacccgtacggacgtaccgggcccgtttacgtttacggccgtttcgggtaccgggg

SEQ ID NO: 207131 - DNA, 956 bp, Homo sapiens
  misc_feature: GYAE6OF01EYL11.17.25.C03.1.454.CMB.1.raw
  modified_base (336)..(336): a, c, t, g, unknown or other
  misc_feature (336)..(336): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactccgaggtgcagctggtgcagtcgtgggctggagggtaggaagaacgccggggggtacggggccctcgaaggttgtaacgggttccttcccgtggacgtaacgggtctttcgacgggtacttccgtacgttttaccctacgtagtacgttataccgtaacgtggggtcnccggccgtacgggcccgtcgtacggaaccaaccggtaccgtaggagggttggaacggttggggaacggttccggggaaccccgttaaaccccgtacgacggtttccgggtacgtaccgaacggttacggtttccggttacctttaccccgaaccccgttacccggtttaccccgggtaaccccgggggtaaaccttaaccggtaaccccgtttaaacccggaaccgttaacccgggtaaacccccgtaacccgttaaccccctttaccccgtaacccgttaaaaacctaaaccccgaaccccgttaaccgaccccgtttaaacggaacggtttaacggggtaggttacgggaacggttacgacccgttacgaacctacgtttaccggtacccggaaaccggacccgtacccgggtttacccttaacgttttaaccgttccggtacgggttaacgggaccccgtaacgggttaaccccggtaaccccggtaccggggttacccggttacccgggtaaccggtacccggttacccggggtaaaccccgtcccgggtaaccgggtttacccccggttaccggttttaaacccggttcccggggttccggggtaacccgggggg

SEQ ID NO: 207132 - DNA, 568 bp, Homo sapiens
  misc_feature: GYAE6OF01E1SSA.17.25.C03.1.454.CMB.1.raw
  modified_base (280)..(280): a, c, t, g, unknown or other
  misc_feature (280)..(280): n is a, c, g, or t
  modified_base (291)..(291): a, c, t, g, unknown or other
  misc_feature (291)..(291): n is a, c, g, or t
  modified_base (327)..(327): a, c, t, g, unknown or other
  misc_feature (327)..(327): n is a, c, g, or t
  modified_base (334)..(334): a, c, t, g, unknown or other
  misc_feature (334)..(334): n is a, c, g, or t
  modified_base (413)..(413): a, c, t, g, unknown or other
  misc_feature (413)..(413): n is a, c, g, or t
  modified_base (433)..(433): a, c, t, g, unknown or other
  misc_feature (433)..(433): n is a, c, g, or t
  modified_base (445)..(445): a, c, t, g, unknown or other
  misc_feature (445)..(445): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgntggacaacgcctgagtgatgggatgggacaacctanactggtntcacgagtgtcttcaccctatcccgccgggacagacttaccatacgaccacgactcctacactaaacgacagaccctanagtacggtagttcgaggacncctagacatcgngtaacgaccgaccggtcctacttattaacgtggtacgcggagtacgtaccccgaggtacgtccgggtagaccggccctacgggctacggcccggttacccgttttgaccgttcgggtacgggg

SEQ ID NO: 207133 - DNA, 654 bp, Homo sapiens
  misc_feature: GYAE6OF01BJKG9.17.25.C03.1.454.CMB.1.raw
  modified_base (280)..(280): a, c, t, g, unknown or other
  misc_feature (280)..(280): n is a, c, g, or t
  modified_base (292)..(292): a, c, t, g, unknown or other
  misc_feature (292)..(292): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagccgtgggcctcagtgaaggtctcctgcaaggcttctggattcacgtttacctctatagtatcaacgtgggtncgccaggcccgngtcggacaacgtacctggagtgggatggggatggggaccaaacccgtaacgacgtggtcgtacgacgtaggtcgttccttccaccctactcccgtacccgggacacgtaccttaccacgtacgacccaccgaaccttccctaccaagtaaaaccacaacgtcctaacgagttacgggaagttcggaacggacgcccgtagacgactcgtacggaccgacgaccggtccttactagttaccgtaggtcgacggagtacccggtacccacggtcgttacccgggtagaacccggcccgttaaccgggcgttaacccgggccgggtttaccctttacgggtcccgttttcggggtacccgggggg

SEQ ID NO: 207134 - DNA, 846 bp, Homo sapiens
  misc_feature: GYAE6OF01EEFSB.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctgagggtagaagaagccgtggggcctcgagtcgaaggtcctcctgcgaaggtcttcgtggtatttacctaccgttttacctaccttaagtaagtactacaacgttggggtcgccgaccgacggccgcgtacggaaccgaacggtaccgtaggaggtggacggttgggacgtcggggaaccgtaaaacccctaaacggtacgttgggtacgtacgaacgtacggttcgtacccttaccgaccccgtacgttccccggtaccggggaacctaacggttaaccttaaccgaacgttacccggaaacccgtaaccgtaacccgttacccctaacccgtaaaacttaaaacccaccgtaaccgaaccccttaaacgtaaggttacgggtaacgggttttacgggaaaaccgggtcgttaccccggtaagaacccgttaacgttacgggtaaccggaaccggtaacccgtaccccggggttaacccgttttacgtttaactttaccggttacggtcgaaccgggtacgtaacccgtaaccccggtaacggtaccggttacccgggacggtaacccggtccccggtaaaccgggccgtaacgggttaccccgggtttacccgttttacgggtccccggttccgggtacccgggggg

SEQ ID NO: 207135 - DNA, 708 bp, Homo sapiens
  misc_feature: GYAE6OF01DSAMK.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaggtctcctgcaaggcttcgtggattctaccgtttacctcctattagtatcaacgtgggtcgccgccgacggccgtcgtggaaccaacgtacctaggaggtggacgtagggagtcggggacccgtaaaccccgtaactacgtgggtacgtacgaacgtaggttcgtcctttccaacccctacgttcccggtaccgggacctagtacccttaccgactacgtaaccctaccgtaaccctcccttaaccgaaacttaaacccactaaccgtacctaactacggttaggtacggttacggaggaccgtccgtagtaactacgttccacggaaccgaccggtaaccgggttcccgttagttaacttacgtaggtacggaccgtacgaccgttacccgaacggtcgttccgggtacgaccggtaccccgtaacggtccgtaacgggttcccggttacccttttcggtaccgttcgggtaacccggggg

SEQ ID NO: 207136 - DNA, 783 bp, Homo sapiens
  misc_feature: GYAE6OF01EJL9T.17.25.C03.1.454.CMB.1.raw
  modified_base (184)..(184): a, c, t, g, unknown or other
  misc_feature (184)..(184): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtncagtctggggctggaggtgaagaagccgtggggcctcgagtgaaggtctccgtgcaaggtcttcgtggtactttccgtacgtttaccctccttaataggttactcctaacgttggggtacgccggaccacgggtcccgaccgtcgggaaccgaaacccggtaccgtgggtacggtagggaaggttaggggacgttcggggaacccgtaaaaccccgttaaacgtaccggttgggtacgtaccgaacgtacggttcgttcccttaccacccccgtacgttccccgtaccggggaactacgtaccttaccagttaccgaaccctaaccgtaaccctaccctacctaactaaacccactaaccgacccttaacgacggttgggtaacggtttaggacgggtactcccgtaacgaactacggttaccgtaggaacccgaaccggtaccgggtccgttactttaacgttacggtacggtcggaccgtaacggtaccggtacccccaagggttacccgttacccgggaggtacccggtaccgtaaccgggaccgtaccggttcccggttacccggttttcggtaaccggttcgggtacccggggg

SEQ ID NO: 207137 - DNA, 684 bp, Homo sapiens
  misc_feature: GYAE6OF01BK58D.17.25.C03.1.454.CMB.1.raw
  modified_base (189)..(189): a, c, t, g, unknown or other
  misc_feature (189)..(189): n is a, c, g, or t
  modified_base (224)..(224): a, c, t, g, unknown or other
  misc_feature (224)..(224): n is a, c, g, or t
  modified_base (235)..(235): a, c, t, g, unknown or other
  misc_feature (235)..(235): n is a, c, g, or t
tcagcgtagactagcacgaccggtgctcgatttagtagtgtagatttgggtttggggactcaacaaccacatctgtcctctagagaaaaccctgtgagcacagcctcctcaccatggactggacctggaggactcctcttcgttggtgcagcagctacgaagtcgcccactcccgaggtgcagtctggncagtcgtgggctggaggtgaacgagcgtgggcctnaggtgaggtcncctgcaggtcttgtggtacttcgtaacgtttaccttcgtagttatacttacgaacgttgggcgccgccgacggtcccgtcgtaggaacccaacgaccgttggaaggtggtactaggggacgtacggggaaccttaaacccgtacgtacggttgggttacgtaccgaatcggttctaccttaccgaccccgtagtcccgtacgggacctagtaccttaccgataccgaccacgacttccaactaagaaaccacgactacctaacgagtaggtacgttaggacgtaccgacaggactagtaccgtacgaccgtacgaacccgggttcctttactaacttaccggtgtaaccggcgaacggtacccgttcccgaaacgtccggttaccggtacggacgacccccgtagaaccgtcgggtacttacccggttgtaaccgttcgggaacccggg

SEQ ID NO: 207138 - DNA, 753 bp, Homo sapiens
  misc_feature: GYAE6OF01ANQ29.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggactcctcttctggtggcagcagctacaagtgcccactcccaggtgcagctggtgcgagtcgtggggctgaggtgaagagccgtggggcctcaggtgaacggtctccgtagacaaggtcttcgtcggtattcgtaccgtttacctcctaatacgtatacgaacgttggtcgccgcgacggccgtcgtagggaaccaacggtacctgggaggttagggaggttaggggacgtacggggaaccgtaaaaccccgttaaactacggtgggtacgtcgaagtacggttgttacccttccaacccgtacttcccggtaccgggaactacggtaccttacacgtacggaaccaactacctccctacgaaaactaaccaaccgtacacctaagaggttagggtacgtacgggaaacggtcccacttacgaccgtatttcccgaaggaaccccggtacggtacccggttaacccgtttacgtaaagttttaccggggacgttaccgggacgtaaacggttccccgggttaccccaaacggggttaccgttcccgggggaacttccggaaccccgttaggaccggtaaccgggttcccgttagtttaccggaccccgggtttcggggacgggg

SEQ ID NO: 207139 - DNA, 815 bp, Homo sapiens
  misc_feature: GYAE6OF01CI9A6.17.25.C03.1.454.CMB.1.raw
tcagcgtagactagcacgaccggtgctcgatttagtagtgtagatttgggtttgggagtcagtctcagtcaggacacagcatggacatggagggtccccgctcagctccgtggggctcctgctactctggctccgagctgccagatgtgacatccagatcgacccagtcctcctactccctccctgtctcgcctcgtgggtgggggtcaggtacgtaccacctatccgtacgttcggaccggactaacggtcgtaaccggtaaccgtttaaaaaccttaattttaaaacgttggtaatcaacgacgaaacgaaaaccgtaacggaaaaaccgccccaacgtaccccttccgtacgacttcccgttgtacgggtcgtacctaccttaccctaccgttcgtacggacggtaacggtccgggtacccctaacccgtacggttacgggtaacggtttacgagggtaccggtagtacgggttcggtaacgtcggtacgggaacgtaacgtttaactttaccaaacgttcctaacctaccctaaccgtaccctacccgtaccgttcgtaaccgtacccgtaaacccgttaagggtacgttacgttagtaaccgaccgttaaacttacccgtttaaccttacggtaacgttaaaccctaacggtaaccgttacgttaaccccgttacccgtttcccctacggttaccttacggttaccgggaacccgggtaaaggtaaacccgtaaggttacgtaaactaaccggtaacgtaaaccgtacgttccggacgtaccgactaccgtacttacgttcgttcgtacc

SEQ ID NO: 207140 - DNA, 621 bp, Homo sapiens
  misc_feature: GYAE6OF01ERMCU.17.25.C03.1.454.CMB.1.raw
  modified_base (245)..(245): a, c, t, g, unknown or other
  misc_feature (245)..(245): n is a, c, g, or t
  modified_base (279)..(279): a, c, t, g, unknown or other
  misc_feature (279)..(279): n is a, c, g, or t
  modified_base (340)..(340): a, c, t, g, unknown or other
  misc_feature (340)..(340): n is a, c, g, or t
  modified_base (348)..(348): a, c, t, g, unknown or other
  misc_feature (348)..(348): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttgggtggcagcagctacaagtgcccactcccaggtgcagctggtgcagtcgtggggctgaggtgaagaagcgtggggcctcgagtgaggtctcctgcaggcttcnggtattcacgttacctctatagtatcagtgggtncgccaggccgcgtggacaacggacctggagtggagtgggagtacggggactaacccgtaanacgtggtntccactaggtcgtcgttaccacccctacgtcccgtaccggggactacgtaacctaccatacgaacccaacgtacctaccctaccaactaaaccacgaacgccctaagtacgtagggagttacggaaggtacgcctaggactactcgtacggaacgtaccgaccgggtccgttaacttagttaccgtggtacgacggtacgtccgtcccaggtccgtcggtgacggtcccgtacggaccgtacggtccgtaccgtttgtccgtgggtaccgggg

SEQ ID NO: 207141 - DNA, 711 bp, Homo sapiens
  misc_feature: GYAE6OF01D7T1J.17.25.C03.1.454.CMB.1.raw
  modified_base (219)..(219): a, c, t, g, unknown or other
  misc_feature (219)..(219): n is a, c, g, or t
  modified_base (503)..(503): a, c, t, g, unknown or other
  misc_feature (503)..(503): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagccgtggggcctnagtgaaggtctctgcgaacggtcttcgtggtacttcgtaccgtttacctccttatagttactactaacgtgggtcgccgaccgacgggtcccgacgtacgggaacctaaccggacccttaggaacggtggagtgggaagtcgggaccgaaaccccgtaaacgcgttagggtacgtacacgtagttcgtccttacccgacccgtacgtcccggtacgggaccacgtaaccttaccgataccgaaccctaacgtaaccctcctaaccaataaaccacacgacctanagtagacgtgaacgtacgcgtagactacgttacgacgtaacgtaccgacggttaccctacttaacgttcgtacggtaccgtacggaacgtaaccccggtaccgaccgggtaacgggtacccgggttaggaacccggtacccgtaacgggacccgtacgggtaccccggttaccttttacccgggcgtttccccgggggtacccggggg

SEQ ID NO: 207142 - DNA, 657 bp, Homo sapiens
  misc_feature: GYAE6OF01AOXUG.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagcctaacaagtcgccccactcccaggtgcagctggtgcagtcgtggggctggaggtgaagacgccgtggggcctcagtgaggtctccgtgcgacggtcttcgtggtacttcctaccgtttacctccttatagtactcgaacgtgggtcgccgccgacggccgcgtaggaaccaacgaccgtgaggtggagtgggacgtcgggaccgaacctacgtacgtggtcgacacgtagttcgtccttaccacctacgtccgtcgggactacgtaccttaccagtacaacccgacgtaacctaccctacaactaaacaacgcctacgagttcggaagttggacgacgtcccgtagaactactacgtacggaccgtaaccgtccgggtaccttacgttaacttaccggtgtcgaccgtacgtcccgtacccggactccgggttaccgggtgaccggtcccgccggacgcgggtaccccgttcgtttaccggccggtttcgggcgggtacccggg

SEQ ID NO: 207143 - DNA, 694 bp, Homo sapiens
  misc_feature: GYAE6OF01AF5ES.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtctctgcaggcttctgattcacgtttacctcctataagtatcgaactgggtacgcgccgaggcccgctacggaacaaccgaccgtgacggtggagtgggatggggaccaacccgtacacgtgggtctcacgagtcgtccttccaccccgtatcccgtaccggggacctacggtaacccttaccagttaccgaacccacgtaacctccctacaaactaaaccacacgacctaactacgtggtaagttggaacggtacgccgtacgaactacgtaccgtacgaacccgtacgaccgggttacccggttacctttaacgtttacgcggttacggacccgaaggtaaccccgttacccgaaccggtaccggttacccgggagtaaccccgggaccccgtttaacgggaccgttaccgggtcccgggttaccctttacgggtacccgttttcggggtaaccccggggg

SEQ ID NO: 207144 - DNA, 1039 bp, Homo sapiens
  misc_feature: GYAE6OF01E6IEG.17.25.C03.1.454.CMB.1.raw
tcagcgtagactagcacgaccggtgctcgatttagtagtgtagatttgggtttgggactcaacaaccacatctgtcctctagagaaaaccctgtgagcacagctcctcaccagtggactggaccgtggacggtactccttcgttcgttggtggcagcagactaacgaacgtccgaccctaccgtccgaggtcgcgacggtcgttggtacgcgtacgggttccggtggggtacgtaggaacgggtaacggaacggtaaccggtccggttacggggccttacggtagtacggttaacgttcccgtacgtacggtaccgttacggttccgtttacgttacggttacctttaaccgttaccgtttacctaacgttaacgtacgttaacgtaccggtacggtccggaccgacccggtaccggtaccggtacccggtacggtaaaccggtaaccgtaaccggttacggtacgggtaacgggtacgggtaccgggttaacgggtaacccggtaaaccgtaaacccgttaaccggtacggttaccggttacggtaaccgttaccggttaccgttaccgtttacccgtaaccccggttaacccgtaacccggttacccgggtaaacccggtaaccgttaaaccgtaaacccgttaacccgtaaccgtaaaccccgtaaacccgtaaaccccgttaaacccgtaaccccttaaaacccgtaaaaccgtaaaccgtaacccggtaaaccgttaccgttaacgggttaaccgggtacggttaaccgggtaacggtaaccggttacccggtaacccgttacggtaacccgtaacggttaccggtaacccgtacccgggtaacccggttaccggtttaccgttacgtttaaccggttacgtacgggtaccgtaaccgggtaccgtacccggtaacccgtaccggtacccgggtccggttaacgggtacccggtacccggtacggttacccggtccgggttacccggttaccggtttacccggtccggggttacccgggtaccgggtaaccggg

SEQ ID NO: 207145 - DNA, 711 bp, Homo sapiens
  misc_feature: GYAE6OF01DJSI8.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatgactggacctggaggatcctcttcttggtggcagcagctacaagtgcccactcccaggtgcagctggtgcagtcgtgggctggaggtgaagagccgtggggcctcgagtgaaggtcctccgtgacgaaggcttcgtggattctacgtttacctctatagtatacaacgtggtacgcgccgacggccgcgtaggaacaacgacctggagtgggagtgggagtacgggaccgaaaccctaacgtacggtggtcgtacaacgtaggttcgtccttacccaaaccccgtacgttcccggtacccggggaacctaacggtaaccctttaaccaagtaacccgaaccctaaaccggtaacccctttaccctaaccctaaaaccttaaaaccgaaccgaccgtaacccttaacgagttagggtagttagggaacggacgtaccgtagacctaggtttccgaacgaaccgtaccgtaccgggttacccgtactttaacgttacgtggtacgtaccgaacgtccgtacccgacgtacgtaccggcgtaccgacccggtacgacggttacggcccgttaccgtttacggtccgttcgggtaccgggg

SEQ ID NO: 207146 - DNA, 748 bp, Homo sapiens
  misc_feature: GYAE6OF01CVYNB.17.25.C03.1.454.CMB.1.raw
  modified_base (649)..(649): a, c, t, g, unknown or other
  misc_feature (649)..(649): n is a, c, g, or t
  modified_base (727)..(727): a, c, t, g, unknown or other
  misc_feature (727)..(727): n is a, c, g, or t
tcagcgtagactagcacgaccggtgctcgatttagtagtgtagatttgggtttggggactcaacaaccacatctgtcctctagagaaaaccctgtgagcacagctccctcaccagtggactggaccgtggaggactccttcttcgttggtggcagcagctacgaagtcgccccactcccgaggtcgcaggtcgtggtcgcgtgtcggtggggcgtggaaggtaggaagacggccggtcgggccttgaaggtaggaacggttccgtccgtagacgtaacggttcttagtggtactttaccgtaccgtttacctacgtatacgtatacgtaacggtggtacgccgaccgacggtccgacggtacgaacgaaccgtacgtaggtaggtaggaggtagggtagtaccgggaaccgtaaaacccgtaagtacggtggtacgtacgtacgtaacgttccgttaccctacccgtaacccgtaccgtacccggtacccggtaaacgaacgttaacccgtaccgtaagtacccgaaccctaaccgtaacccttaccgaaacctaaacaaccacctaaccgtacctaaggtaggtacggttagaacggacgtacggctaacggatacgtcgacgaccgtacgccgttctaattcgtagnggtacgacgtacgacccgtactacggtcggtacccggagccggttacccgacgggactaccgggtcgtttaacccggngtacccggttcggggacccgg

SEQ ID NO: 207147 - DNA, 700 bp, Homo sapiens
  misc_feature: GYAE6OF01EBV20.17.25.C03.1.454.CMB.1.raw
  modified_base (279)..(279): a, c, t, g, unknown or other
  misc_feature (279)..(279): n is a, c, g, or t
  modified_base (290)..(290): a, c, t, g, unknown or other
  misc_feature (290)..(290): n is a, c, g, or t
  modified_base (404)..(404): a, c, t, g, unknown or other
  misc_feature (404)..(404): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagagccgtggggcctcagtgaggtctcctgcaggcttctggattctacgtttacctctatagtatcagtggtncgcgaggccgntcggacaacgacgtggagtggagtgggagtcgggaccgaaacctaacgacgtggtactacacgtagtctcttaccaccctacgtcccgtacgggacctacggtaccttaaccgntaccgaaccaaccgaccttccctaccaataaacccgacaacgacctaacgtacgtggtacgttaggaacggacgtcccgtacggtaactagttaccgacggaacccggtaccggtaaccggggttaccccgttaagtttacgtttaacggtcggttacggaacggtaaccggtacccggtaccccggtaacggtaaccggttccgggttaacggacccgggtaccccggttaaccgggccgtaccgggtccccggtttaccggtttaccggtaccggtttccgggtacccgggggg

SEQ ID NO: 207148 - DNA, 613 bp, Homo sapiens
  misc_feature: GYAE6OF01E3WL6.17.25.C03.1.454.CMB.1.raw
  modified_base (247)..(247): a, c, t, g, unknown or other
  misc_feature (247)..(247): n is a, c, g, or t
  modified_base (282)..(282): a, c, t, g, unknown or other
  misc_feature (282)..(282): n is a, c, g, or t
  modified_base (294)..(294): a, c, t, g, unknown or other
  misc_feature (294)..(294): n is a, c, g, or t
  modified_base (337)..(337): a, c, t, g, unknown or other
  misc_feature (337)..(337): n is a, c, g, or t
  modified_base (366)..(366): a, c, t, g, unknown or other
  misc_feature (366)..(366): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagcctggggcctcagtgaaggtctcctgcaaggcttcgnggattcacgtttacctctatagtatcaactgggtnccgccaggccgngtggaccaacgacctgagtggagtgggatgggccaaccctaanactggtcgtcacgtagtcgtcttcacccntcccgtcgggacacgtactacatacgaccaacgaacctcctaccaataaaccacacgacctacgatacggagttaggagacgccgtagacatcgtacggaaccgaccgaccgggtaccttcgttaacttacgtggtacgcgaacggtaccgtaccccgaacggtccggttaccgggtaggtaaccgtaccggtaccgggccgtacgggtcccggttacccgtttcgacccggtttcgggtacggggg

SEQ ID NO: 207149 - DNA, 630 bp, Homo sapiens
  misc_feature: GYAE6OF01BGZYP.17.25.C03.1.454.CMB.1.raw
  modified_base (248)..(248): a, c, t, g, unknown or other
  misc_feature (248)..(248): n is a, c, g, or t
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
  modified_base (460)..(460): a, c, t, g, unknown or other
  misc_feature (460)..(460): n is a, c, g, or t
  modified_base (475)..(475): a, c, t, g, unknown or other
  misc_feature (475)..(475): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggcctcagtgaacggcctccgtgcaaggtcttcnggtattcacgtttacctctatagtactcaacgtgggtcncgcgaggccngtcggacaacgtcctggaggtggacgtgggagtcgggaccgtaaacccgtaagacgtgggtctacaacgtaggtcgttaccttaccgaacccctacgtccggtaccggggacacggtaccttaccgagtcgaccacgtaacctcctacaataacacagcctangtggagtgaaggtcncctagacctagtcgacggaacgaccgacggttcccgttacttattaccggtggtccgacggtaccgtacgtacccccgaggtaaccgttccgggacgacggtaccccgtaggcgtacggtccgggttaccctttggcccggtttcggaccggggg

SEQ ID NO: 207150 - DNA, 730 bp, Homo sapiens
  misc_feature: GYAE6OF01CR3VY.17.25.C03.1.454.CMB.1.raw
  modified_base (589)..(589): a, c, t, g, unknown or other
  misc_feature (589)..(589): n is a, c, g, or t
  modified_base (625)..(625): a, c, t, g, unknown or other
  misc_feature (625)..(625): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccgaggtgcagcgtgggtgcgagtcgtggggctaggaggaggaaagaacgccgtggggcctcgaggtggtaacgggtcctccgtagcgacggtcttcgtaggtattccgtacgtttaccctactattacgtactacgtaacgtgggtcgcgtcgaggccgtcgtcgaactaccgacgtgaggtggagtgggagtcggggaaccgtaaaccgttaaccgcggttacggtcgtaacgtaacgtcgttcggtacctttaccaaccccgtaccgtcccggttaaccgggacctacggtaacccgtttaacaacgtaaccggaaccgaacccgttaaccgtaccccttaaacccaacggttaaaaccctgaaaccctaaccttaacgacggttaagggtcggtaaggtaacggcctaaccggtanaaccgtagtccgtaacgacgaaccggtccgacgttnaacgtttagcgttgcggtaaccaccgtaccggtagaccggttcggacaccgggttacctacgggacgtcggtcccggttatttacggccgtttcccgggacgggg

SEQ ID NO: 207151 - DNA, 738 bp, Homo sapiens
  misc_feature: GYAE6OF01DN3AE.17.25.C03.1.454.CMB.1.raw
  modified_base (222)..(222): a, c, t, g, unknown or other
  misc_feature (222)..(222): n is a, c, g, or t
  modified_base (292)..(292): a, c, t, g, unknown or other
  misc_feature (292)..(292): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcaggtctggggctgaggtgaagaagccgtggggcctnagtgaaggtctcctgcaggcttcgtggattcctaacgtttacctcctaatacgtactcaacgttgggtcnccggccgagggcccgtcgtacgggaaccaaccggtaccgtgacggtgggagtaggggacgttacggggaaccctaacccgtaacgtacggttggtacgtacgaacgtacggttcgttaccttaccgaaaccccgtcgttaccccggtaccggggaacctaacgtaaccctttaaccgaacgtaccgaacccgaaccgtaacctccctaacaaactaaaccacctaacgaccttaagacgttagggaggttacggacggactacccgtagaactacgttacgacgaaccggaacccgtaccggggtccttacgttacgtttacggtaggacgggaacgtacggacccgtacccgaaggtaccgttccgggtacgtaccggacccggtacggaccgttaccgggttaccggttaccgttttacggtcccggttcggggtaacccgggg

SEQ ID NO: 207152 - DNA, 823 bp, Homo sapiens
  misc_feature: GYAE6OF01BXKOW.17.25.C03.1.454.CMB.1.raw
  modified_base (102)..(102): a, c, t, g, unknown or other
  misc_feature (102)..(102): n is a, c, g, or t
tcagcgtagactagcacgaccggtgctcgatttagtagtgtagatttgggtttgggggagtcagtctcagtcaggacacagcatggacatgacgggtccccnctcagctccgtgggctcctgctactctggctccgagctgccagatgtgacatccagatcgacccagtcctccactccctcctgtctcgccttcgtgggtcggggtcaggtacgtccaacctatcctacgttcggaccggaaactaacggtaccgaaccgggttaaacctttaaaaaccttaagttttaaaacgttggtaacttcgaagaccgaaaacggtaaaaccgtaacgggaaaaaccgcccctaacgtacccttcgtagtacttccgtacggttcggtcgacctacgttacctaccgttcgtacggacgtaacggtccggtacccgtaccgtaggttccggtaaggttacgaggtacgggacgtaggtacgtacgtacgggtacgggaactaacggtttactttaccgaaacttcccgtaacctaaccctacgtacccctaaccgtacctaccgtaacggaacccgttaacggtaggtaaacggttcgtttacgggactaaacctaacgttacccgtaacgtttacgtacgtaaacctacgggttaacgttaaccgtttaccccgtacccgtttcccgtaacgttccgtttaacgggttaccggaaccggtaaacgggtaaccttaagggtacgaaccgtaacgtaaacgtaaaccggttcgttacgtaccggtaccttaacggaaccccttagttaccgttcgttcccgttaaccg

SEQ ID NO: 207153 - DNA, 840 bp, Homo sapiens
  misc_feature: GYAE6OF01CCHB1.17.25.C03.1.454.CMB.1.raw
  modified_base (293)..(293): a, c, t, g, unknown or other
  misc_feature (293)..(293): n is a, c, g, or t
  modified_base (769)..(769): a, c, t, g, unknown or other
  misc_feature (769)..(769): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtgcagcagctacaagtcgcccactcccaggtgcagctggtgcagtcgtgggctggaggtgaagacgccgtgggcctcgagtgaggtctccgtgcgaggtcttagtggtattctacgtttcctacgtatacgtataccgtaacgtggtacnccggtacgaggccccaggtcggaaccaaccggtccgttaggaggtacgggtaggtacggggttaacgacggggtaccccgaaacccgtaaacggttccgtacgggttaccgtacgtacgtaacggtttccgttaccgtttacccgaaccccgttaacggttccccggtaaccggggtaaacctaaccggttaaacctttaaacccgtacgttaacccgggtaacccctaaaccgggttaaccccttacccgtaacccgtaaaacctaaaacccgtaacccgtttaaacccgggaccttaaaacccggtaggttaaccggggtacggttacggaacgggtaccgtccccgtaaaggtactaccgttaccgtacgggaacccggtaaccgtaccggggttccctaacggtttaacttcccggtaggtaccgtacggtaactaccccggtacccggaacggttacccgtcgggttaacncccgggtaccgtaccgggtacgtaccgggttccccgttaaccgttacggtaccggttccgggaacccgggg

SEQ ID NO: 207154 - DNA, 887 bp, Homo sapiens
  misc_feature: GYAE6OF01B2BHN.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagcgtggtgcagtcgtgggctgaggtagaagagccgtggggcctcgagtgaaggtcctccgtagcgtaagggtctttcgtgggtactttaccgtaaccgttttaccctaccgttaattaacggttaacttaccgtaaaccggttggggtacgccggacccgtacggggccccgtcggttacgggaaccctaaaccgggtaccccgttagggacgggttacgggtaacggtgggggaacgtacgggggaaccccgtaaaacccccgttaaacgaccggtttacggggtacgtaccgtaaccggttaggtttccgttacccttaacccgtaacccccgtaacgttcccccggtaccggggaacctacggtaaccctttacccgagttacccgaacccgtaacgtaaccctacccgtaaccaaactaaaccacgtaaccgtacccgtaatacggtaggtaacggttaggaaccggtaccgtacccgtaggtaacctaccggttacgtacggaaccgtacccggtaccccggtaccgtttaaccgtttaacgtttaccggtcgtaacccgggaccgggtaaacggtaccccggttaaacccccgacggttaacccggttcccggggtaccggtaccggtaccccggtaccgggaccgtacccgggtcccggttttaaccgtttcccggtaccggtttccggggtaaccgggggg

SEQ ID NO: 207155 - DNA, 905 bp, Homo sapiens
  misc_feature: GYAE6OF01C02RX.17.25.C03.1.454.CMB.1.raw
  modified_base (179)..(179): a, c, t, g, unknown or other
  misc_feature (179)..(179): n is a, c, g, or t
  modified_base (242)..(242): a, c, t, g, unknown or other
  misc_feature (242)..(242): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatccttcttcgttggtggcagcagctacaagtcgcccactcccgaggtncagctggtgcagtcgtgggctggaggtgaacgacgccgtggggcctcgaggtaggacggtccnccgtgacgtaaggtctttcgtggtactttcctaccgtttacctaccgtaattaacgtataccgtaacggtcgggtcgaccgcgacggcccgtacggtacggaaaccgtaaccggtaaccgttaggaacgggtagggtaggtacggggtaacggtaccggggtaacccgtaaaacccgtaaacggtaccggtttcgggtaaacgttccgtaaccggtacggttttacccgtacccgtttaacccgtaacccgttaacccggttaccccggtaacccgggggtaacctaaacccggttaaacccgtttacccgtaaaccggttaacccggaaacccgttaaacccgtaaaccccgtaccccttaaaccctaaaacccgttaaacccaacccgtaaaccgtaacccgttaaacggtaaccggttacggggttaaaggtttaccgggaaacggtacccgtacccgtaacgggtaaccttacgttaaccggtaacggtaacccggtacccgttacccgggtaccgttaaccgtttaacgttacccggttaggttaccgaccgggttaaccgacccggtaccgaaccggtcggtaccgggtactaccggtacccgtagggcccgtaacgggttcccgttacggttacggtccgggttgggaacccgggg

SEQ ID NO: 207156 - DNA, 549 bp, Homo sapiens
  misc_feature: GYAE6OF01BZ54M.17.25.C03.1.454.CMB.1.raw
  modified_base (413)..(413): a, c, t, g, unknown or other
  misc_feature (413)..(413): n is a, c, g, or t
  modified_base (440)..(440): a, c, t, g, unknown or other
  misc_feature (440)..(440): n is a, c, g, or t
  modified_base (511)..(511): a, c, t, g, unknown or other
  misc_feature (511)..(511): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgcctggagtggatgggatgggacgaaccctaacacgtggtgtcacgagtgtcttccacccatccctcgggacagaccttaccactcgaacccacgaacctcctaccaataaacnccagcctaacatgggagttggaggacnccgtgacatctaggaccgacgaccgggtccttcttacttacgtgtcgcggagcgtcccgagtcgtccgggngcgccgtacggcgaggcgtccgttgcgttcggccgggg

SEQ ID NO: 207157 - DNA, 830 bp, Homo sapiens
  misc_feature: GYAE6OF01C2KFF.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccgaggtgcagctggtgcagtcgtgggctgaggtgaagagccgtggggcctcgaggtagaacggtcctccgtgacgaaggtcctttcgtggactttaccgtaccgtttttaccctccgttaagttaagttactaccgtaacggttggggtcgcccggaccgacgggtcccgtacggtacggaaccgaaccggtaccgtggtaaggttgggaagttcggggaacgtaccggggaacccgtaaacccctaacgtaccggttggtccgttacgtaaccgtaggtttcttcccttacccaaccccgtacgttacccggtaccgggaactaacggtaacctttaacccacgttaccgaaccctaccgtaaccctcctaaccctaactaaaacccaccgtaaccgtacctaaacgtaacggtcgggttaacgtttacgggaaacgggcgttacccggtacgtaacctacgttaccgtacggaacccggtaccggtaacccggttaccgttactttaacgttaccgttcgggttacgaccgggtaacgtacccgtccccggtaaccgtcggttacccggggtacgtaacccgggtaccccgttacgggacccgtcggttaccccgggtttaccgtttaccggttaccgggttccgggtaacccggggg

SEQ ID NO: 207158 - DNA, 644 bp, Homo sapiens
  misc_feature: GYAE6OF01DJF7J.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagagccgtggggcctcgagtgaaggtcctccgtgcgaaggtcttcgtggacttctacgtttacctcctatagtatcaagtgggtcgcgccgaggcccgcgtacggaacaaccgtacctggaggtggagtggggagtcgggaccgtaaccctaactacgtggtgtccagtaggttcgtccttccaaccctactcccgtaccgggactacgtaccttaaccatacgaccaaccgtaacctccctaaccaataaaccacgacgaccctaacgagtaggtagttacggaggacgtccgtacgactactacgacgaccgtaaccgaccggtccgttacttacgttacgtggtacgacggacggtacccgtcccgacggtacgtcccgggtagaccgtccgtacggcctacgggtccgttccgttacgtccgttcgggacgggg

SEQ ID NO: 207159 - DNA, 700 bp, Homo sapiens
  misc_feature: GYAE6OF01C0RNN.17.25.C03.1.454.CMB.1.raw
  modified_base (246)..(246): a, c, t, g, unknown or other
  misc_feature (246)..(246): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctcctgcaggtcttntggattctaccgtttacctacctatagtatacaacgtgggtcgcgccgacggccgcgtacggaaccaacgccgtggacggtggtagtgggagtcgggacccgtaaaccctaactacgtggtctcgaacgtaggttcgttccttaccacttacacgttcccccggtaccgggtaacaccggtaacctttaccgaacgttaccgaacccgtaaccggtaacccttacccgttaacccaaaacttaaaacccacgtaaaccggtaaccctaacgtaggtacgggtaacggtttagggaacgggtacgaccgtacgaacgtacttcgacgaacgaccgtaccggccgttacttaagttcgtaggtcggaccggtaggacccgtacccgacgtacggtcccggtacggaccgtaccggtaccggcgtaacggtccggttccgttcggtcgttaccgggg

SEQ ID NO: 207160 - DNA, 808 bp, Homo sapiens
  misc_feature: GYAE6OF01BTIA7.17.25.C03.1.454.CMB.1.raw
tcagcgtagactagcacgaccggtgctcgatttagtagtgtagatttgggtttggggactcaaacaaccacatctgtcctctaagaagaaaacctgtgagcacagctcctcaccatggactggacctggaggatcctctttgtggtgcagcagctaacaagcacccactcccgaggtgcagtcgtggtgctagtcgtgggggctaggaggagaacgaagccgtgggctgagtgaagtctcgagacgtaacgtcttgtaggactttaccgtacgttttaacctctagttagtaactacgaacgttggcgacaccgtaggcccgagtaggaacctaaccgcgtaggagtacggtagtggggtaacgcggaaccgtaaaccccgtaaagtcggtaggtttacgtaaccgaaggtttcgtaccttaccgaaaccccggtttcaccccgggtaaccggaataaaccgtttaaaccgttaacctaagtaccccggaaacccctttaaacggaaacccctaccggtttaaaaccgaaaaccttaaaaacccgtaccgaacgttaacccgaaaggtaaccggttaagggtaaccggtttagggaacgggttaaccgtaccgtaaggtaaacgtaaaccgtttacgtaacccggaaacgggaaacccttcccgggtaacggttaacctaacgtttacggtaccgtagaccgggaaacgtacgtaacccgtaaggacccgtttacgggacgtaccggtacctacccgggattaaccggacggtttccctaaacgttcggttaccgggacgggtacggg

SEQ ID NO: 207161 - DNA, 680 bp, Homo sapiens
  misc_feature: GYAE6OF01BF1D9.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagcctggggcctcagtgaaggtctcctgcaaggcttctggattctacgtttacctctatagtatcaacgtgggtgccgccaggccgctggacaacgacctggaggtggagtgggatcggggaccgaaaccctaacacgttggtcgttacaccgtaggttcgtaccttccaacccctattcccgtacccggggactacggtaccttaaccaagttcgaacccaacgtaacccttcccgtacctaaactaaacaccacgtacctaacagtacgggtaggttaggacgggtaccgtcgtacgaacctacgttcgtaggaaccggtacgttacccgggtaccgttaccttacgtttacgtggtacgacggtagtacccggtaccccgtaacggtccggtaccgggtacggtcggtacccgtacccgggacgtacgggtacccggttcgttttacgtaccggtttccgggtaccggggg

SEQ ID NO: 207162 - DNA, 639 bp, Homo sapiens
  misc_feature: GYAE6OF01AW9WD.17.25.C03.1.454.CMB.1.raw
  modified_base (363)..(363): a, c, t, g, unknown or other
  misc_feature (363)..(363): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgatgtagaagaacgccgtggggcctcgagtgaaggtctccgtgcaaggtcttcgtggattcacgtttacctcctatagtatcaacgtgggtgccgccaggccgcgtaggacaaccgcctggagtgggatgggatcggggaccaaaccctagacgtggtactcacgngtcgtcttcaccctagtcccgtccgggactacgtacttaccatacgaccacgtaacctcctaccaataaacccacacgtaccctacgtatcgggtattacggaggacgtccgtagactaacgtccgtaacggaccgaccgtaccggtcccgttacgtaactttactggtacggaccgtacggtacccgtcccgaacggtaccgtccggggttgaaccgtacccggttacggacccgtacggttcccgggttacccttttggcccgtttaccggggg

SEQ ID NO: 207163 - DNA, 914 bp, Homo sapiens
  misc_feature: GYAE6OF01AURJT.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgctagtcggtcgggctggaggtaggaaggacggccgtcggggcctcgaggtacggtaacggtctccgtagaccgtaacggtcctttacgtacgggtactttaccgttaccggttttaacccttccgttaagttaacgttaacttaccgtaacggttcggggtcgcccggtacccgaacgggcccggtaccggtaacgggtaacccgaaccggtaacccggttaggacgggtagggacggttaggggtacggtacggggaaaccccgtaaacccgtaacgtacggttcgggtacgtaccgtaacgttaacggttcgttcccttacccgaaccccgtaccgttacccggtaaccgggacctaaccggttaacccgttaacccgacgtacccggaaacccgtaccgtaaaccttcccctaactaaacccgtaaacctaacccgacgtacccgtaataaggttacgggtaacgtttacgggaaacgggtaccgtacccgttacggaacttacgtaccgtacggaacccggtaaccggtaccggttaccggtttaccttaaacggttcggttaacgacccgggtacgtaaccggttaccccggttaacccgtaacggtttcccggggttaccggtaacggggtaccccgtacccgggtaaccgggtacccgtaccggggtttacccggtttaccggtttccgggttaacccgggtttaccccgggggaccggggg

SEQ ID NO: 207164 - DNA, 552 bp, Homo sapiens
  misc_feature: GYAE6OF01D6ZF1.17.25.C03.1.454.CMB.1.raw
  modified_base (392)..(392): a, c, t, g, unknown or other
  misc_feature (392)..(392): n is a, c, g, or t
  modified_base (523)..(523): a, c, t, g, unknown or other
  misc_feature (523)..(523): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctcgtggtgggggtcagagtcaccatcacttgccggacaagtcacggacgttaaaacctatttaaattggtatcagcaagaaacctaggaaaacgcccagacctctgatctctggtgctactcccactctgcgaagtcggcgtcccagtcgaggttcaggtggcagtggatcgtgggacagtactttacaatctacacctatccaccnctctgaccaaccgtggagtattgtacacaatctactactacgacaacagtattacgtaccgtttcccctagtccttacgtttcggaccgtaaggggtaacctaaaggttgaacgtactaacaaacggtagngtcggacttcgaccacctatcgtgttacc

SEQ ID NO: 207165 - DNA, 738 bp, Homo sapiens
  misc_feature: GYAE6OF01DEFZT.17.25.C03.1.454.CMB.1.raw
  modified_base (103)..(103): a, c, t, g, unknown or other
  misc_feature (103)..(103): n is a, c, g, or t
tcagcgtagactagcacgaccggtgctcgatttagtagtgtagatttgggtttggggactcaacaaccacatctgtcctctagagaaaaccctgtgagcacanctcctcaccatggactggacctggaggatcctcttcttggtggcagcagctacaagtgcccactcccaggtgcagctggtgcagtcgtggggctggaggtgaagaagcctggggcctcgagtgaaggtctcctgcaaggcttctggattctacgtttacctcctatagtatcaacgttggtcgcgccacgggccgcgtaggaaccaacgacctgacgtggagtgggagtcgggaccgtaaccctaacacgtggtgtacacgtagtcgtccttcgacccctatcccgtaccgggacacgtaccttaccatcgaacccacgtacctccctacaactaaaccacgaacgaccctaacacgttagggtacggttaggacgggtacgcccgtttaggaacctacttaccgtaacggaaacccggtaacccggtaacccgggttccccggtttaactttaacgtttacccgttaggttccgggaaccggtaacggtaccccggttaccccggtaaccggtacccggttacccgggggttacgacccgggtacccccggttaacgggcccggtaaccgggttccccgggttaccccgtttttacgggtaaacccgggttttcccgggggtaaccccgggggg

SEQ ID NO: 207166 - DNA, 726 bp, Homo sapiens
  misc_feature: GYAE6OF01D086H.17.25.C03.1.454.CMB.1.raw
  modified_base (176)..(176): a, c, t, g, unknown or other
  misc_feature (176)..(176): n is a, c, g, or t
  modified_base (314)..(314): a, c, t, g, unknown or other
  misc_feature (314)..(314): n is a, c, g, or t
  modified_base (591)..(591): a, c, t, g, unknown or other
  misc_feature (591)..(591): n is a, c, g, or t
  modified_base (651)..(651): a, c, t, g, unknown or other
  misc_feature (651)..(651): n is a, c, g, or t
  modified_base (677)..(677): a, c, t, g, unknown or other
  misc_feature (677)..(677): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtncagtctggtgcagtcgtgggctggaggtgaagagccgtggggcctcgagtgaacggtctccgtgacaaggtcttcgtggtacttccgtaaccgttttaccctccttaagttagtacttaccgaacggttcggggtacnccggaccgacggggtcccgtacgtacgggaaaccctaaccggtacccgttagggacgggtagggaggtacggggtacgtaccgggggaacctaaacccgtaacgtccggttaggtcgtactacgtaggttcgtccttacccgaaccgtacgtcccggtaccgggaactacggtaaccttaccaacgtcgaacccaccgtaacccttaccgtaacaaactaaaccgactacgtaccctaagtacggttagggtaacgttaggacggtacgtaccgtanaacctagtcgaacggtacgaccgtaccgtccgtttactagttcgtagtaccgacggtacnccgtaccgacggtcgtacccgggtanaccgtacgacgcgtacgtaccgttacgttcgtaccggtggtacccgggg

SEQ ID NO: 207167 - DNA, 799 bp, Homo sapiens
  misc_feature: GYAE6OF01DB2C6.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccgaggtgcagctggtgctagtcgtgggctggaggtgaagagccgtggggcctcgagtaggaggtcctcgtgacgaggcttcgtggtatttaccgtaccgttttacctacctagttaacgtacttaccgtaacggttcggggtacgccggccgaccgggtcccgtaccggtacggaaacccgaaaccggtacccgttagggaacgggtaggggtaaggttacgggggtaacgtaccgggggtaacccctaaaaccccgttaaacgtacggttacgggttacgtaccgaacgttaacgggtttcttcccttacccaaccccgtacgttccccggtaccggggaacttacggtaacctttaccgactaccggtaacccaacgtaccctccctaaccaactaaaccacaacgtacctaacgtagtcgggtaagttcgggaacggtacgtccgtacgacttacgtcgtacggaaccggaccggtacccggttccgtaacgttacgtttacgtacggtaccggaccggtaccggtacccgtaccgtaccggtacggttacccgggtagtcccgtaccgggtacgaccgtacgggttacccgtttaccgttacgtcccggtttcgggacccggggg

SEQ ID NO: 207168 - DNA, 746 bp, Homo sapiens
  misc_feature: GYAE6OF01CNET4.17.25.C03.1.454.CMB.1.raw
  modified_base (222)..(222): a, c, t, g, unknown or other
  misc_feature (222)..(222): n is a, c, g, or t
  modified_base (246)..(246): a, c, t, g, unknown or other
  misc_feature (246)..(246): n is a, c, g, or t
tcagcgtagactagcacgaccggtgctcgatttagtagtgtagatttgggtttggggactcaaacaaccacatcctgtcctctagagaaaaccctgtgagcacagctcctcaccatggactggacctggaggatcctcttcttggtggcagcagctacaagtgcccactcccaggtgcagctggtagcagtcgtgggctgaggtgaagagccgtggggcctnagtgaggtctctgacaggcttcgnggattctaccgtttacctcctatagtatactaagtgggtagccgccgacggcccgtcgtacggaccaaccgtaccgtagaacgtggaggtgggtacgtcggggaaccgtaaaccccgtaacgtacggttcggtacgttaccgaacgttagttcgttcccttacctacccctacgtccccggtacccgggactaacgtaaccctttaaccgacgttaccgaaccctaaccggtaaccctaccctacccgtaaactaaaccaacccacgtaccctaaacgtacggttagggtagttagggaacggacgtccgtacgtactacgttccgtacggaaccgtaaccggtacccgttaccgtacctttacgttaccgttggtacgaccggtaggtaccccggtacccgtaaccgtaccggtaccggttacgaaccgggtacccgtacgggaccctaccggggtcccgtttaccgttttaccggtaccgttcggggtaccccggggg

SEQ ID NO: 207169 - DNA, 777 bp, Homo sapiens
  misc_feature: GYAE6OF01BCS5J.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctctttcttggtggcagcagctacaagtgcccactcccaggtgcagctggtgcagtcgtgggctgaggtgaagaagccgtggggcctcgagtgagtctcctgcgaggcttctggtattctacgtttacctcctatagtatacaacgttgggtgcggccgacgggcccgtcgtacgggtaaccaacggtaccgtaggacggttagggaaggttggggaacgtacgggggacccgaaaccccgtaacgtaccggttagggtcgttaccgaacgtacgttcgttaccgttcccaacccgtacgtcccggtaccggggtaaccaacggtacctttaacccgaagtaccgaaacccgtaaccgtaacccttccccgtaacctaaaccgttaaaaccacccgtaaccgtacccgtaaacgtaacggttacgggtaacgtttaacgggacgggtacgtacccgttagaacctagttaccgtacggaaccgtaccgacccgggtacccgttacttaacgttacgtacggtacgacggtaacggtacccgtacccggtaaccggtaccgttaccgggtacggaccggttcccggtaacgggtaccgtacggttcccgggttaccgtttcggtaccgtttcggggtaccggggg

SEQ ID NO: 207170 - DNA, 549 bp, Homo sapiens
  misc_feature: GYAE6OF01EBDO5.17.25.C03.1.454.CMB.1.raw
  modified_base (281)..(281): a, c, t, g, unknown or other
  misc_feature (281)..(281): n is a, c, g, or t
  modified_base (406)..(406): a, c, t, g, unknown or other
  misc_feature (406)..(406): n is a, c, g, or t
tcagcgtagactagcacgaccggtgctcgatttagtagtgtagatttgggtttggggggagtcagtctcagtcaggacacagcatggacatgagggtccccgctcagctcctggggctcctgctactctggctccgagctgccagatgtgacatccagatgacccagtctccatccctccctgtctgcctctggtgggggtcagagtcaccatcacttgccggacaagtcacggacgttaaaacctatttaaattggtatcagcaagaaacctggaaaacncccagacctctgatctcgtggtgctactccactctgcgaagtggcctccagtcgaggttcagtggcaggtggatcgtagggacagtatttcaatctacacatccaccactctgactaactgagtnttgtgacaatctaactactgacaacgagtagttacctacgttccctcgtcttacgtttcggacccgtaagggaaccctaagttggaacgtaactaacgaaacgtacgtggtacggctacgaccaaccgtattcgttacgttcc

SEQ ID NO: 207171 - DNA, 583 bp, Homo sapiens
  misc_feature: GYAE6OF01BGN7R.17.25.C03.1.454.CMB.1.raw
  modified_base (243)..(243): a, c, t, g, unknown or other
  misc_feature (243)..(243): n is a, c, g, or t
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
  modified_base (441)..(441): a, c, t, g, unknown or other
  misc_feature (441)..(441): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaggtctcctgcaaggcttcgnggtacttcacgtttacctcctatacgtatcaacgtgggtncgccaggccnctggacaacgcctgagtggatgggatgggaccgaacctaacgcgtggtgtcacgagtgtctcaccctatcccgaccgggacagtactaccatcgacccacgaacctcctaccaactaaaccacacgccctaacagtgacgttgacggngtcccgtagactagtctacgacgacgaccggtccgttactaagttccgtgtcgacggacgtaccggtcccacggtatcccgggagtcgacccgtacgggacctacgggtccggttaccgtttcgtcgttcgggtacccgggg

SEQ ID NO: 207172 - DNA, 927 bp, Homo sapiens
  misc_feature: GYAE6OF01DS1IN.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttgggtggcagcagctacaagtcgcccactcccaggtgcagctggtgcagtcgtggggctggaggtagaagacgccgtggggcctgagtagtaacggtcctccgtgacgaaggtcttacgtggtactttaccgtaccggtttaacccttactaagttacgtactaacgtaaacggttggggtacgaccggaccgacggtcccgtacgtaccggaaccgaaccggtaccgtgggaaggtcgggaaggtcgggaacggttacgggaaacccgtaacccgtaaacgtcggttacggtacgtacctaacggtcggtttaccgtacccgttaacccgtaaccccgttaccggttaccccgggtaaccccggggtaaccgtaaacccgggtttaaacccttaaaccccggttaaccggtaaacccggtaacccccggtaaaacccggttacccccttaacccccggttaaacctaaaacccgtttaaacccggaaaccccggttacccgtaaacccccgttaaagtacccgggtttaaggggtaaccggtttaacgggaaccgggtaccggttaccgtaacgttaaccgtacggttaccggtaaaccggtaacccggacccggtacccggtttaccgttaaccggtttacgtttaaccggtgggtaaccgaacggttaccggtacccggtaaccgtacgggtacggtacccggttacgggtaccctaccccgggttaggaacccggtcggtaccccggttaccgttaacggtcccggttcgggggaacccgggg

SEQ ID NO: 207173 - DNA, 738 bp, Homo sapiens
  misc_feature: GYAE6OF01A1S09.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctggaggtagaagagccgtggggcctcagtgaacggtcctcctgacaaggtcttgtcggtattccgtaacgtttcctcctagtagtactacgtaacgtggggtacgtccggcccgacgggtcccggcgttacgggaaccaaccggtaccgttaggacgggtagggtaggtcgggggtaagttccgggggaacccgtaaaaccccgtaacgtaccgttgggttacgtaccgaacgtacgttcggtaccctttaccgacccctacgttcccggtacccgggaactacgtaccttacgactacggaacccacgtaacctcctacctaactaaacactaccggtaccctaagacggttagggtacgttaggacgggtactccgtaacgactacgtcgtaacgaccggaccgtaccgggtaccgttattaacgttcgtaggtcggacggaacgtccgtacccgtaacggtccggttccggaggtacccgtacccgggtacggacgtccgggtaccgtttccttacggaccgggtttccggaccggggg

SEQ ID NO: 207174 - DNA, 916 bp, Homo sapiens
  misc_feature: GYAE6OF01EKWTC.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctaacaagtcgcccactcccgaggtgcagcgtggtgcagtcgtggggctggaggtagaagacgccgtgggcctgagtagaacggtcctccgtgacgtaaggtccttacgtaggtactttaccgtaacccgtttttaccctaccgttaagttaacgttaactaccgtaaacggttggggttaccgcccggacccgtaacggggcccgtacggtaacgggaacccgtaaaaccggtaccgttagggaaggtacggggtaaggtcggggtaaacgggttaccggggaaacccgtaaaaacccccgttaaggtaaccggttcgggttaacgtaccgtaaacgtacgggtttaccgtttaccccttaacccgaccccctaaccggttccccggtaacccgggtaaactaccggttaaacccctttaaccgacgttaacccggaaccctaaaccgtaaccccttcccgtaacctaaacctaaaaccgacctaaccgtacccgtaacgtaacggtttacgggaacggtttaacgggacggtaaccgtacccgttaggtaaaccgttacgtaccggttaaccggaacccggaacccggtacccgggttacccgtttaacgttaacgttaccggttacgggtaacggaaccgtaaccggtacccgtaaccccggtaacggtacgttacccgggtacgacccggtacccggttaacggacccgtaccgggtcccgtttaaccgtttcggttacccggtccgggtacccggggg

SEQ ID NO: 207175 - DNA, 853 bp, Homo sapiens
  misc_feature: GYAE6OF01BQNKS.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagaagccgtggggcctgagtgaacggtctcctgcaaggtcttcgtggtacttctaccgtttacctaccttatagtatccgaacgttggggtacgccgtccgacgggcccgtcgtacgggaaccaaccggtacccgtgggaaggttacggggagttcgggggagtcgggggaacccgtaaaccccttaaccgaccgttcgggttacgtaccctaacggtaacggttccggttacccttacccgaacccccgtacgttacccccggttaaccccggggtaaccgtaaacggttaacccctttaacccgaacgtttacccggaaccctaacccggtaacccttaccccgtaaccctaaacctaaaaccacccgtaaccgtaccctaacgtaacgggttaggtaacgggtttacgggaacggtacgtacccgtaacgtaaccgtattaccgtaacggtaacccggaaccggtaaccgggttacccgttaccgtttaacgttaccgttacggtaccggtacggtaacggttaaccccgtacccgtaaccggtacccggttaccggggacggtaacccggttaccccggaccgggaccgtacccgggttacccggttcccgttttacggtcccggtttcgggtaaccccgggggg

SEQ ID NO: 207176 - DNA, 1077 bp, Homo sapiens
  misc_feature: GYAE6OF01CMI2L.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctgagtgaaggtctcctgcaaggcttcgtggacttctacgtttacctccgtatagtatacaacgtggggtcgacgcccgtagggcccgtacgtacgggaaccaaccggtaccgttggacggttacggggaagttggggggaagttaccggggggaaccccgtaaaacccccgttaaacgtaacccggtttaggggttaccggttaccgaaaccgttaacgggtttccggttaccccttttaaccccgaaacccccgtttaaaccggttcccccgggtttaaacccccggggggaaacccttaaaaccggggttaaaccccctttttaaaaccccgaaacggttttaacccccgggaaaaccccccgtaaaacccccgggttaaaacccccgttttaaccccccccgttaacccccgtaaaaaaaccgtttaaaaaaaccccccaaaccccggttaaacccgggttaacccccctttaaaaaacccggtaacgggtttaaccggggggtttaaacggggtttttaaccgggggaaaaccggggtacccggttaccccggtttaaacggtaaaccccgttaaccggttttaccccgggtaaacgggtaaacccccggggaaacccgtaacccccggggggtttccccgtttaacgttttaaaccgtttaaccggttcggttaaccgggacccggtaaacgggtaccccggttacccccggtaaacgggtcccggtttaccccggggtacggtaaaccccgggtccccgggttaaacccgggccggttaacccggggtacccgggttttacccgtttttaaccgggttaaccccgggttttcccgggggtaacccggggggg

SEQ ID NO: 207177 - DNA, 777 bp, Homo sapiens
  misc_feature: GYAE6OF01CGKZ6.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttggtggcagcagctacaagtcgcccactcccaggtgcagctggtgcagtcgtgggctggaggtgaagacgccgtggggcctcgagtggaaggtcctccgtgcgaaggtcttcgtggtattcctacgttttacctacctaatagtactcgaacgttggcgccgccgacggccgtcgtacggaccaaccgccgtggaggtggagtggggacgtcgggaaccctaaaccctaacgacgttggtcgtacgaacgtggttcgttacccttaccgacccgtacgtcccgtacccggggaactacgtaccttaacccgagtacaacccacgtaaccctcccgtaaccaaacttaaacccacgtaccgtacctaacgtagttacgggtaagttcggaacggtactacccgttaagacctagttccgtaacggaacccggtaacccgaccgggttacccgtttacgttaacgtttaccggttcggtaccgggtacggtaaacccgtacccgggttaacccccgtaagggtaacccggttacccgggaaccgggttaccccggtacccgggtaaacccggtccggttaaccgggttcccggtttacccgttttaccgggttacccgggttccgggtaacccggggg

SEQ ID NO: 207178 - DNA, 816 bp, Homo sapiens
  misc_feature: GYAE6OF01DOIPK.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaacgccgtggggcctcgaggtgaacggttcctaccgtgacgaacggtctttcgtaggactttccgtaaccgtttttaccctccttaattaacggttactaccgtaaacggttggggttacgccggacccgaagggcccgtacgtacgggaaccaaaccggtacctggacggttgggaacgtggggagtacgggaccgtaaaccccgtaacgacgttgggtcgtaccgaacgtacgttcggttccttaccgaaccctacgttccccggtacgggaactacggtaacctttaccgagtaccgaaccaaccgtaaccttccctaaccaaattaaaacccacctaacggtaccctaacgtaaggttcgggtaacggtttacggaacgggtaccgtacccgttagaacctacgttacgtaccggaaaccgtaccggtacccgggttacccgttactttaacttaccggtacggtacggaccggtaacgtaacccggtaccccgaacggttacccggttaccgggtagtaccccggttacccgtaaccggggaccctaccggggttacccggttacccggttttacggtaccggtttcccggggtaaccgggggg

SEQ ID NO: 207179 - DNA, 800 bp, Homo sapiens
  misc_feature: GYAE6OF01DX3HJ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtagaaggaacgccgtggggcctcgaggtgaaggtcctccgtgcaaggtcttcgtaggtacttccgttaaccgttttacctccttaagttaagtaacttaccgtaacggttggggtcgaccggtacccgacgggcccgtcgtacgggaaccgaaccggtacctggaggtacggaggtggggagtacggggaaccgtaaacccgtaacgtacgtgggtacgtacaacgtagttcgttaccttacccaacccgtacgttcccggtacccggggaactaacggtaacctttacccgaacgttaccgaaacccgtaaccgtaaacccttacccctaaaccgtaaacttaaaacccgaacccgtaaaccggtaacccttaacgtaacggttacgggttaacggtttacgggaaacggtacgtacccgtacgaactacgttacgtacggaacccgtaaccgaccggggttaccttaacgttacttaccggtgtacggacgaacggtaccgttacccgaacggttacggtcccggaggaccggtacccggtacggaccgtacgggttacccggttccgtttacggtccggttcgggtaccggggg

SEQ ID NO: 207180 - DNA, 776 bp, Homo sapiens
  misc_feature: GYAE6OF01EKIFY.17.25.C03.1.454.CMB.1.raw
  modified_base (177)..(177): a, c, t, g, unknown or other
  misc_feature (177)..(177): n is a, c, g, or t
  modified_base (555)..(555): a, c, t, g, unknown or other
  misc_feature (555)..(555): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttggtggcagcagctacaagtcgcccacctccaggtncagctggtgcagtcgtggggctaggaggtagaagacggccgtggggcctcgagtgaacggtctccgtgacgtacggtcttcgtaggtattcctaaccgtttaccctccttaagtactactacgtaacgttgggacgtccgccgaggtcccgacgtacggaaccaaccggtcgtagggtaggtcggtaagggtcggggtagtaccgggaaccgtaaacccgtacgacggttggtctacacgtagtcgtcctaccgacctacgtcccgacgtacaacgtacttacgactacgaccaacgtacctaccgaaccaaacgtaaccacgtaaccgacctaaagtagtacggggtcgtaggaacggtcttacccacgtaacgttntaaccggtaccggaacccgtaaccgggtacgggttcccttaaacgtttacgttaactacgggccgttaaaccgggtaacccacccgtttaaccccggaacgggttaaccccttccgggtaacggtacccggtaccccgggttaaacgggcccgttaaacccggggtttcccggtttaaacccgtttaacgggttcccccggttaggggggacccccggggg

SEQ ID NO: 207181 - DNA, 601 bp, Homo sapiens
  misc_feature: GYAE6OF01D3FW1.17.25.C03.1.454.CMB.1.raw
  modified_base (288)..(288): a, c, t, g, unknown or other
  misc_feature (288)..(288): n is a, c, g, or t
  modified_base (298)..(298): a, c, t, g, unknown or other
  misc_feature (298)..(298): n is a, c, g, or t
  modified_base (459)..(459): a, c, t, g, unknown or other
  misc_feature (459)..(459): n is a, c, g, or t
  modified_base (479)..(479): a, c, t, g, unknown or other
  misc_feature (479)..(479): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttggtggcagcagctacaagtcgcccactcccaggtgcagctggtgcagtcgtgggctgaggtgaagaagcgtgggcctgagtgacgtctcctgcaaggtcttcgtggtacttctaccgtttacctctatacgtatcgaacgtggtcncgccaggccncgtggacaacgcctaggacggtggagtgggtagtcgggacctaacctaacgcgttggtacgtacacgtgtctccttaccaccacgttcccgaccgggactacgtaacttaccagtacgaaccctacgtaacctacccataacctaaaccacgtacacctanagtacgggtagttcgacggngtcctaggctacgtcgtacgaccaccggtcgtaccttacttagtcgtgtacggacgtacggtaccaccgagtccgtggctacggccgtacgcgcggttacgtcgttactcgtacgggtcggg

SEQ ID NO: 207182 - DNA, 777 bp, Homo sapiens
  misc_feature: GYAE6OF01ANWU4.17.25.C03.1.454.CMB.1.raw
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtcgcccactcccgaggtgcagctggtgcctagtccgtggggctggaggtgaagagccgtggggcctcgagtgaacggtcctccgtgcaaggtcttcgtggactttccgtaccgttttacctccttatagtactacctaacgtgggtcgccgaccgacggcccgcgtacgggaaccaaccggtaccgtggaacggtggtaagtgggaacgttcgggacccgtaaaccccgttagtacggtcggtaccgtacgacgtacggttcgttccctaccgtacccctacgtcccgtaccggaactacgtaaccttaccacgtacggaacccctaaccggtaaccccttcccgtaccaaacgtaaacccacgtacccgtacctaaacgtacggtacggttacggttaacggaacgggtactacccgttagaacccgtacgtacgtaccggaaccgtacccggtaaccgggtcccttttacgtacgtttaccggtggtccggaaccggtaccgttaacccggcccctaacggacccgtttaccgggccgtaacccggtcccgtaaaccgggccgttaccgggtacccgtttaccgtttacggtacccggttcggggtaacccgggg

SEQ ID NO: 207183 - DNA, 791 bp, Homo sapiens
  misc_feature: GYAE6OF01C2OLW.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaacgccgtggggcctcgagtgaaggtctccgtgacgaaggcttcgtggattcctaccgtttacctccgtatagtactcaacgtgggtcgccgccgagggcccgcgtcggaaccgaaccgtaccgtggaggtcgggaggtggggagttacggggaccgtaaaccccgtaacgtacgttgggtacgtacgacgtacgttcgtcccttaccaccctacgtcccgtaccgggactacgtaccttacctagtaccgaccctaaccgtaacccttccctaaccgtaaactaaacccgacctaaccggtaacccttaaaccgtacggttacgggtacgggtttacgggaacgggtaccggtcccgtaacgtaacccttacgttaccgtaaccggaacccggtaacccggtacccgggttacccgttaacgtttaacgttaccgttggtaaccggacgtaacggtacccgtaccccgtaacgggtaccggttacccgggtacggacccggttaaccccggtaccgggtaccgtacccgggttacccggtttacccgttttaccgggtaaccggttttccgggaacccgggggg

SEQ ID NO: 207184 - DNA, 785 bp, Homo sapiens
  misc_feature: GYAE6OF01BV73M.17.25.C03.1.454.CMB.1.raw
  modified_base (504)..(504): a, c, t, g, unknown or other
  misc_feature (504)..(504): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcgagtgaaggtcctccgtgaccgaggtcttcgtggtattcctaccgtttccctaccttaataagtatacctaacgttggggtagcccgccgacggtcccggcgtcgggaaccaaccggtaacctgggtaaggtagggtacggttcgggggaaggtacgggggtaacccccgtaaaacccccgtaaacggtacggttcgggtaccgtacctaacggtaagggttccttacccgtttaccaaccccgtaccgtccccggtaccggggaaaccacgtaccttaaccncgtacgaaacccgaacgtaaccccttacctaacccgaacttaaaccgaaacccacggtaccccttaacgaacgttacgggtaacggtttgggaacggtaccgtacccgttaggaaccctaacggttcccgtagggaaccccgtaacgacccgggttccgtttaaccttacttaacgtcggtacgtacgaccggtaccgtaccccgaggtacccgttacggacggtccgaccggtacggcgtacggtacccggttccgtttaacgtgttccgggtacggggg

SEQ ID NO: 207185 - DNA, 915 bp, Homo sapiens
  misc_feature: GYAE6OF01C6OZO.17.25.C03.1.454.CMB.1.raw
  modified_base (179)..(179): a, c, t, g, unknown or other
  misc_feature (179)..(179): n is a, c, g, or t
  modified_base (190)..(190): a, c, t, g, unknown or other
  misc_feature (190)..(190): n is a, c, g, or t
  modified_base (830)..(830): a, c, t, g, unknown or other
  misc_feature (830)..(830): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcgttggtggtagcagctacaagtcgcccactcccgaggtncgagcgtggtncagtcgtgggctggaggtagaagacgccgtcggggcctgaggtaggaacggttcctccgtagacgtaacggtccttcggtaggtacctttaccgttaaccggttttaccctcgttaataagttaacgtacgtaacggttggggtccgccggtacccggacgggcccgtacgtacggaaccaaaccggtaccgtggacggttggaggtacggggacgttaccggggaacccgtaaaccctaacggtacggttcgggtacgtccaaacgggtcggtttaccgttaccccttaacccgaacccgtacccggttaccccggtaacccggggaaactaaccgttaacccgttaaccgaacgttaacccggaacccgtaacccggtaccccttaaccccttaaccaaaaaccgttaaaccccgaacccgtaacccgttaaaccgttaaccgtaaagggttaccggggtaacggtttaacgggtaaccgggaaccgtaccccgttaagtaacccgtacgttaaaccccggtacggaaaccccggtaacccgtacccggtttaaacccgtttgttaaaccggtttacgagttaccgggaacgtaccggtaacccgttacccccgggaagttaccggtacccggggtanaacccggttcccgggtaacgacccggtacggttcccgggtttactttaccgggaccggtttcccggggtaccggggaaccccggg

SEQ ID NO: 207186 - DNA, 600 bp, Homo sapiens
  misc_feature: GYAE6OF01AK7YH.17.25.C03.1.454.CMB.1.raw
  modified_base (280)..(280): a, c, t, g, unknown or other
  misc_feature (280)..(280): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatcgacccagtctccatcctccctgtctgcctcgtggtgggggtcagagtcaccatcacttgccgacagtcacggtacgttaaacctatttaaagtggtatcagacaagaaccgtggaaaacncccagccctctgatctcgtggtgcatccactcgtgacgtaacgtcggccgtccagtcgtaggttcaggtcggacaggtggatcgagggacagtatttacatcctaccaactctaccacctacgtcctgaaccaaccgttggaacgttattgtcgtaactaactacctaactacgtcgtaaccaacgtaacgtacgttacctacccgttaccctcgttacttaccggtttacggacccggtaacggggtaaccttaaaggttgaacgtaactaaccggtaaagtacggtgacgtctacgacctaactcgttcgttgttacc

SEQ ID NO: 207187 - DNA, 831 bp, Homo sapiens
  misc_feature: GYAE6OF01EMIVV.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagcgtggtgcagtcgtggggctggaggtgaagaacgccgtggggcctacgagtagaaggtctccgtgacaacggtcttcgtggtactttaccgtaccgttttaaccctccttaagtacggttaacttaccaaacggtttcggggtacgacccggaccccgtaacggggtccccgtacgttacggggaaaccctaaaccgggtaccccgtagggtaagggttccggggtaaggtttacgggggaacgttaccggggggtaaccccgtaaaaacccccgttaacggtaccggttacggggttacgttacccgaaccgttaagggttaccgttcccgttaacccgaaccccgttaacgttacccccggtaacccgggtacctaacggttaaccccttaaccgaccgtaccgaaccccgtaacgtaacccttccccgtaacgtaaactaaacccgactaacgaccctaacgtagtagggtaacggtggaacgacgtccgtaaggaacctcgttacaccggtaaccgacgaaccgggttccgtattacggttaccgtggacggaccgagttaccgccccgaagggtacgtccgggtaacgtacggtaccccgaggccgtaaccgggtcgttacccgttagtcccggttcggacccggggg

SEQ ID NO: 207188 - DNA, 615 bp, Homo sapiens
  misc_feature: GYAE6OF01AZ802.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggcttcacgtttacctctatagtatcaactgggtgcgccgaggccgctcggaccaacgacccgtggacgtaggagtggggatcggggaccgaacccctaacgacgtggttcgtcgaacgagtcgtcgttccaacccgacgttcccgtacccgggacacgtaccttaaccacgtacgaccaaccgtaactaccctccaataaaccaccaacgtcctaacagtagggtagttacggaggacgccttagacctatacgtcgaaccgacgaccgggtccttattacgttacgtgcggacgacgtacgtcccgaacgtcgtcccggacggcgacccgtacggcgtcggcggtcctttcggaccgttcggacgggg

SEQ ID NO: 207189 - DNA, 685 bp, Homo sapiens
  misc_feature: GYAE6OF01A792Y.17.25.C03.1.454.CMB.1.raw
  modified_base (314)..(314): a, c, t, g, unknown or other
  misc_feature (314)..(314): n is a, c, g, or t
  modified_base (510)..(510): a, c, t, g, unknown or other
  misc_feature (510)..(510): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctggaggtgaagacgccgtggggcctcgaggtggaacggtcctccgtgaccgaagggtccttcgtggtactttccgtacgttttacctccttaataagttactacgtaacgttgggtcnccggtccgaggcccgtacgtacgggaaccaaccggtaccgtggaaggtggaggtagggacgtcggggaaccgtaaccctaacgacggttggtacgtactacgtagttctccgttaccgaccctacgtcccgtacggactacgacctacagtacgaaccgaccgtactcccgactaactaaacacgtacgcctaagnggtacgtacgttggaacgcgtaccacggcttacgtcgacgaacgtaccgacggttcccttagttaactcgtggtcaccggtagtcccggtaacccgtagtaccggtcggacggtaccggcccgtacgggacgtcggttacccgttacccgttagtacccggtcgggtacccgggg

SEQ ID NO: 207190 - DNA, 670 bp, Homo sapiens
  misc_feature: GYAE6OF01EJ8VU.17.25.C03.1.454.CMB.1.raw
  modified_base (214)..(214): a, c, t, g, unknown or other
  misc_feature (214)..(214): n is a, c, g, or t
  modified_base (262)..(262): a, c, t, g, unknown or other
  misc_feature (262)..(262): n is a, c, g, or t
  modified_base (316)..(316): a, c, t, g, unknown or other
  misc_feature (316)..(316): n is a, c, g, or t
tcagcgtagactagcacgaccggtgctcgattttagtagtgtagatttgggtttgggggggagtcagtctcagtcaggacacagcatggacatgagggtccccgctcagctcctggggctcctgctactctggctccgagctgcctagattgtgacatccgagactcgacccagttctccactcctccctgtctgccgtgtggtggggtcaggntcacatcactgccgacagtcacggtacttaaaactatttaattggtancagtcaacgtaaaccgtaggaaaaccgccccagacctctgagtcgtcgtggtcncactccactcgtggacgacggtcgccgtccagtcggtaggttcaggtggactaggtggtactcggtaggactagttactttacaacgttcctaccaacgtactaccctaacctacttccgtaaccgtaacccgtaaccggttaggaacggtttacgttggtaaccgtaacttaacgttaccttaaccgtaacgttacgtaccgaaacgttaaggttaacccgttaccgtaacccgtttccccgttacgtacctttaacggtttccgggaacggtaacgggtaacctaggtacgaagtacctaaacggaacggtcgtacggtcgaccgttacgaaccctattcgtcgttctaccg

SEQ ID NO: 207191 - DNA, 647 bp, Homo sapiens
  misc_feature: GYAE6OF01B2SDC.17.25.C03.1.454.CMB.1.raw
  modified_base (481)..(481): a, c, t, g, unknown or other
  misc_feature (481)..(481): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctccgtgcaaggcttcgtggattctacgtttacctctatagtatacaacgtgggtgcgccgaggccgcgtacggacaacggacctggacggtgggagtcggggagtcggggaccgtaaaccccgtaactaccgttcgggtacgtaccgaactacggttcgttccttaccaccctactacccggtaccgggaccacgtaccttaccagtcgaaccaaccgtaacctcccttaaccaactaaaccacacgacctanagtaggtagttaggacgtcgctacgacacgtctacggaccgaccggaccggtaccgttacttacgttacgtgtacgcgtacgaccgtacccgacggtacgtaccggtagaccgaccgtacggacgtacgggtccggttacctttcggccgtttcgggtaccggggg

SEQ ID NO: 207192 - DNA, 711 bp, Homo sapiens
  misc_feature: GYAE6OF01EUU8L.17.25.C03.1.454.CMB.1.raw
  modified_base (470)..(470): a, c, t, g, unknown or other
  misc_feature (470)..(470): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcaggtcgtgggctggaggtgaagagccgtgggcctgagtgaggtctccgtgacgaggtcttcgtggacttctaccgtttacctaccttatagttactcgaacgtgggtacgccgccgagggcccgcgtacggaccgaaccgtaccgtaggaggtgggaggtgggaggtcggggaaccgtaacccgtaacgacgtggtagtaccagtagtcgttcctcaccctcgtcccgcggacacgtacttacacgtaccgaacctacgaacccttacccacctaactaaaccncaaccgtacctacgtacgtagggtacgttagggaacggtacgaccgtagacccgtacgtacgtacgggaaccgtaccggacccgggttcccgtttacgttaacttacggttacggtacggaaccggtacgtaacccggtaccccgtaaacgggtccggtacccggggttaggacccgttacgggtaccggaccgttacggggtccgtttaccctttacgggtccgttccgggtaccggggg

SEQ ID NO: 207193 - DNA, 709 bp, Homo sapiens
  misc_feature: GYAE6OF01A1Q3O.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaggtctcctgcaggcttctggattcacgtttacctcctatagtatcaacgtggtgcgccaggccgcgtcggacaacgcctgagtggagtgggatcgggaccaaccctaacacgtggtgtacacgtgtcgtccttacaccctatcccgtacccgggacacggtaccttaccacgtcgaacccaaccgtaacctccctaccaaacgttaaacccaccgaaccgtccctaaacgtacgttagggtaacggtttggaacggtaccgtcccgttaggaacctacgttacgtacgggaaacccgaccggtacccgggtacccgtttaacttactttaaccggtgtacggtaccggtaacggtacccgttaccccgaacggtaccggttacccgggtacgggtaacccgtaccccggtaacccggggtaccgtaccgggttccccgggttaccccgtttttaacgggccccgttttccggggtaccccgggggg

SEQ ID NO: 207194 - DNA, 750 bp, Homo sapiens
  misc_feature: GYAE6OF01B2LE9.17.25.C03.1.454.CMB.1.raw
tcagcgtagactagcacgaccggtgctcgatttagtagtgtagatttgggtttgggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagccgtggggcctcgagtgaaggtcctccgtgacgaaggtcttcgtggtacttcctaccgtttacctcctaagtagtactctaacgtgggtcgccgccgacggcccgtcgtacggaaccgaaccgaccgtggacggtgggagtggggacgtcggggacctaaacccgtaacgtcgtaggtcgtacgacgtacgttcggtaccttccacccctacgtcccgtaccggactaacgtacctacccagtaccggacctaacgtaacccttcctaaccaaactaaaccgaccgtaaccgtacctaacgtaggtagggtaacgttacgggaacggtacccgtacctgggaaacctacggtttaccgaacgggaaaccccgaacccggttacccgggtaccctttaacgtttaaacgtttccgaggttaccggaccggtaaggtaccccgtaacccggtaaccgtacgggttcccggaacggtaccggccccgttaagggcccgtacgggcccgttttaccgtttagggtccccggtttgggaaccccggggg

SEQ ID NO: 207195 - DNA, 836 bp, Homo sapiens
  misc_feature: GYAE6OF01A0L47.17.25.C03.1.454.CMB.1.raw
tcagcgtagactagcacgaccggtgctcgatttagtagtgtagatttgggtttggggactcaacaaccacatctgtcctctagagaaaccctgtgagcacagctcctcaccatggactcggacctggaggatcctcttcttggtggcagcagctacaagtcgcccactcccaggtgcagctggtgcagtctggggctggaggtgaagaagcctggggcctacagtggaaggtcctaccgtgccgaaggctttcgtggtacttctaccgttttacctccttattaagtacttacgaacctggggtacgccggtacccgagggcccgcgttacgggaaccaaaccggacccgttggtaggtgggtaacgttaggggacgttcggggacccgtaaaaccccgttaacgaaccttcgggtcggtaccaccgtaacggttcgttaccctttcccgaccccttaacgttccccggttacccggggaactaaccggttaaccctttaacccgactttacccggaaccccgtaaccggtaacccctttaccctaaccccgtaaacctaaaaccccgtacctaaacccggtccccttaaccgaacggttaccggggtaaggtttaaccgggaacgggtaaccggtccccgtaaggtaacccacgtttacgtacggaacccgtaacgtaccccgggtacccgttactttaacgttacgtcggtacggtccgtaacgtacccgtacccgaacggttccggttacccgggacggtacccgcccgttacgggccgtaaccgggttcccgggtacccttttcggggtacccgtttcggggtacccggggg

SEQ ID NO: 207196 - DNA, 844 bp, Homo sapiens
  misc_feature: GYAE6OF01CQN7V.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttgggtggcagcagctacaagtcgcccactcccgaggtgcagctggtgcagtcgtgggggctggaggtgaaaggaaggtccgtggggcctcgagtggaacggttctccgtgaccgtaacgggtctttcgtaggtactttaccgttaccgttttacctccttattacgtactacgaacgttgggtacgccgccgacggcccgcgtacggaaccaaccggtacctggaggtgggagtcgggatcggggacctaaacccgtaacgtacggtgggtacgttaccgacgtacgtcgttacctttcccgaacccttaccgtcccggttacccggggaacctacgtaaacccgtttaacccgagtaccggtaaccctaacccggttaaaccccttcccttaaacccgtaaccgtaaaaacccgacccgtaaaccgtacccgtttaaacgtaacggttacgggtaaggttacgggtaaacgggtacgtcccggttaacgtaaccgtaaccgtttaccgttaacgaacccggtaccggtacccgggtaccgtttaccttacgtttaccgttcggttaacggaccggttaacggtaacccggtacccgtaacgggtccggtacccgggttacgggtaaccggtccccgtaaggggtcccgtaacgggttacccggttccggttttaccggtaccggtttcggggtacccgggggg

SEQ ID NO: 207197 - DNA, 609 bp, Homo sapiens
  misc_feature: GYAE6OF01BQOZ9.17.25.C03.1.454.CMB.1.raw
  modified_base (280)..(280): a, c, t, g, unknown or other
  misc_feature (280)..(280): n is a, c, g, or t
  modified_base (292)..(292): a, c, t, g, unknown or other
  misc_feature (292)..(292): n is a, c, g, or t
  modified_base (331)..(331): a, c, t, g, unknown or other
  misc_feature (331)..(331): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggcccgntggacacgacctgagtggatgggatgggacaaaccctanacgtggtctcacgagtgtcttcaccctatcccgtcgggacacgtacttaccgatcgaaccacgaacctccctaccaactaaaccacacgacctaacagtagggagtttaggaggacgcccgtagacctacgttcgtcggaaccgaccgacgggtcccgttacttaacgttacgtcgtaggaccgtagaccggtccccaacggtaccgttccgggacggacgcccgttacgggccgtacgggtcccgggttaccttttcggaccgttccggtacggggg

SEQ ID NO: 207198 - DNA, 752 bp, Homo sapiens
  misc_feature: GYAE6OF01CSNIA.17.25.C03.1.454.CMB.1.raw
  modified_base (179)..(179): a, c, t, g, unknown or other
  misc_feature (179)..(179): n is a, c, g, or t
  modified_base (189)..(189): a, c, t, g, unknown or other
  misc_feature (189)..(189): n is a, c, g, or t
tcagcgtagactagcacgaccggtgctcgatttagtagtgtagatttgggtttgggactcaacaaccacatctgtcctctagagaaaccctgtgagcacagctcctcaccatggactggacctggagacttcctcttcgttggtggcagcagtctacgacgtcgcccactccgaggtcncagcgttggngccgtaggtcggtggggctggtaggaggaagacggtccgtcggggtacccttgaaggttagaacggttcctccgtacgacgtacggtccttgtcgtattccgttaccgtttaccttaccgtaagttacgtctacgtacggttcgggacgcggaccgacggccgtacgtacggaaccacggtaccgtgtaacggtcggtaggtcgggtacggtaccggaaccgaaacccttagacggtcgggttaacgtacgacgtacgttcgttccgtaacccgtaaccctcggtacccggtaaccggtactaacgttaccttaacgacgtacctacccgtaaccgtaaccctccctaaactaactaaacctacgtaccgtaccgtaaacgtggttacgggtacggtacggtacgtaccgtacgtacggtactcgtaccgtaacgaccgtacggtaaccggtcttacgttacttacggtcgaacggtcgaccgtcgtacccgacggttccgaggtaccgacggtaccggacgtcggtacggcgttaccgttactccggggtacggtaccgggg

SEQ ID NO: 207199 - DNA, 670 bp, Homo sapiens
  misc_feature: GYAE6OF01APC9T.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcagtgaaggtctcctgcaaggcttcgtggattcacgtttacctctatagtactcaacgtgggtgccgccgaggccgcgtcggaacaacgacctggaggtggatgggatcgggaccaaaccctacgacgtggtctacgacgtaggttcgtccttccaccctacgtcccgtaccgggacagtaccttaccatcggaaccctaacgaacctcccgtaaccaactaaaccacctacgtaccctaactagtagggtacgttacggaacggtacgacccgtagaacctacgttacgtacgaaccggtacccgaaccggtcccgttacttaacgtttacgtacggtgaaccggagtacccgtacccgaacggtacggttacccgggaggtaccggcccgtacggaccggtacggtacccgggttcccgtttggtacccggtttcgggtacccggggg

SEQ ID NO: 207200 - DNA, 626 bp, Homo sapiens
  misc_feature: GYAE6OF01A1TPR.17.25.C03.1.454.CMB.1.raw
  modified_base (281)..(281): a, c, t, g, unknown or other
  misc_feature (281)..(281): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaacgtgggtncgccaggccgcgtggacaacgacctggagtggagtgggagtcggggaccgaaaccctaaacgacgtcgggtcgtccaacgtaggttcgttccttaccgacccctacttcccgtaccggggaacacggtaaccttaccgagttacgaacccacgtaacctccctaccgaactaaaccacacgtaccctaacgagtcggtagttggaggtactccgtagacactctacgaccgaccgaccggtccgttacttattacgtcgtcgacgagtaccgtcccgacgacgttccggtacggcgtacccgtacggcgtacggtccggttccctttaggccgttcggtccgggg

SEQ ID NO: 207201 - DNA, 644 bp, Homo sapiens
  misc_feature: GYAE6OF01DNG9N.17.25.C03.1.454.CMB.1.raw
  modified_base (494)..(494): a, c, t, g, unknown or other
  misc_feature (494)..(494): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcgagtgaaggtctccgtgcgaaggcttcgtggtattctaccgtttacctcctaatagtatcaacgtgggtcgcgccagggcccgcgtacggaccaacggacctggaggtggagtgggagtcgggacctaaccctaacgtcgtaggtgtcacgtagttcgtccttaccgacccctatcccggtaccgggacacgtacctaccatcgaaccacgtaacctcctaccaactaaacacacgtacctacgagtggtagttggacggtacgcctagaactntcgtgaaccggaccgaccgggtcctacgttacttaccgtggtacggaccggtagtacccgtacccgaacggtaccgtccgggtacggaaccggtcccggtacggccgtaacgggtcccgttccgtttaggtcccgttcgggtaccggggg

SEQ ID NO: 207202 - DNA, 683 bp, Homo sapiens
  misc_feature: GYAE6OF01C55N6.17.25.C03.1.454.CMB.1.raw
  modified_base (349)..(349): a, c, t, g, unknown or other
  misc_feature (349)..(349): n is a, c, g, or t
  modified_base (634)..(634): a, c, t, g, unknown or other
  misc_feature (634)..(634): n is a, c, g, or t
  modified_base (672)..(672): a, c, t, g, unknown or other
  misc_feature (672)..(672): n is a, c, g, or t
tcagcgtagactagcacgaccggtgctcgatttagtagtgtagatttgggtttgggagtcagtctcagtcaggacacagcatggacatgagggtccccgctcagctccgtggggctcctgctactctggctccgagctgccagatgtgacatccagatcgacccagtcctccactccctccctgtcctcgcctcgtgggtgggggtcagacgtcacctatcacgttcgaccggacaagtccgaacggtaccgttaaaaaccttattttaaagttggtactacagacaacgaaaacgtaggaaaaccgccccaagtaccctctagtacttccgtcgtacggtagacctanccctactccgacggacggtaacggtccggtcccgtacctacgtaccgggttaggtttaccgaagggttcgggacgtacgggtgggtaacttccgggaggggtaactaggtttaactttacaaattccgtaccctaacacctacctaccacgtactacgacctaaccgtaggtacgtagttgtactcaaacttccttaacgtactaggaaccaacgtacgttaacgttaccgttaccgttaccctcgtacgttacgtttccggaacgtaacgggtaacaaggttanaacgaacgtacaacgtagtcggacgtcgacacaacttntcgttcgtacc

SEQ ID NO: 207203 - DNA, 747 bp, Homo sapiens
  misc_feature: GYAE6OF01CXXTV.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtgcagcagctacaagtgcccactcccaggtgcagctggtgcagtcgtgggctgaggtgaagagccgtggggcctcgagtgaaggtcctccgtgcgaaggtcttcgtggactttcgtaccgttttacctccgtaatagtactaccgtaagtgggtacgccgccgacgggccgcgtacggaaccaaccgccgttaggacggtaggtagtgggagtcggggaacctaaaccccgtaagaccgttgggtcgtacgaacgtagttcgtacccttaccgaacccctagtccccggtaccgggaaccgtaacgttaaaccctttaccaaacgtaccgaacccgtaaacccgtaaccttcccctaaacctaaactaaaaccgtacgtaaccgtacctaaccgtaggtacggtaacggttacgggaacgggacgtaccgtacggacctagttccggttaaccggaccgtaacccggtaccgggtccttaacgttacgttacggtagtccggaacggtacgacccgtacccggaactccgggtcccggtagaccggtcccgtaaggcccgttacggtcccggttaccgtttcgtacccgttgggtaacccgggg

SEQ ID NO: 207204 - DNA, 862 bp, Homo sapiens
  misc_feature: GYAE6OF01DANDX.17.25.C03.1.454.CMB.1.raw
  modified_base (165)..(165): a, c, t, g, unknown or other
  misc_feature (165)..(165): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatccttctttcgttggtggcagcagctacaagtcncccactccaggtgcagtcgtggtgacgtagtcggtggggcgtaggaggtaggaaggaacgtccggtcgggggcctacgtaggtacgtaacggtcctccgtaggacgtaacggtcgtttacgtggtacctttaccgtaccgttttaccctcgttaacttaagttacttacgtaacggttgggtccgccgtccggacgggcccgtacggtaccggaacctaaaccggccgtaggtagggtcgggtacggtacggggtacgttaccgggaaacccgtaaaaccccgttaaccggtacgggttcggtaggtaccgaaacggttaacggttccgttacccgttacccgaaacccgttccgttaaccccgggtacgggtaaaccgttaccggtaaaacccttaccgtaaccgtaacggtaacccccggtaacgttaaccccttaccctaaaccgtaaaaccttaaaacccaacccgtaccgtaacccgttaacgttaggtaacgggttacgggtagggtaaccgtaccgcgttaacgactacgtacgtaccgaacgtacgtcccgggtacttacgttagttccgtacggtacgtaccgaggtacccgacccgtaacgggtaccgttccgggaacgtccggtaccccggtacgaccggtaccggtacggtttacccgtttaaggtccggttccgggaaccgggg

SEQ ID NO: 207205 - DNA, 699 bp, Homo sapiens
  misc_feature: GYAE6OF01BBF6T.17.25.C03.1.454.CMB.1.raw
  modified_base (685)..(685): a, c, t, g, unknown or other
  misc_feature (685)..(685): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgccactccgaggtgcagcgtggtgcagtcgtgggctggaggtagaacgaacgccgtgggcctcgagtgaacgtctccgtgacgaggtcttcgtagggtatttctaacgtttacctcttaatagtatcctacgtgggtcgccgccgtacgggcccgtcgtaacggaacctaaccgtaccgtggaggtcggtaggtgggagtacgggaacccaaccgtaacgtacgttcggtacgttacgacgtagttcgttaccgttaccaccccgttaagtccccggtaccggaacgtacgttaaccgttaccaagtaccgaacctaacccgtacccttacccgaacctaaacgaaacctacgacccgtacctaaacgacgtagggtaacgttacgggacgcgtaccgtagtaactcgttacgacgaaccggtaccgccgtacgttacttacgttacgcggtacgtacgacgtccgtacccgagtacggttccggagaccgaccgcggtacgacggttaccgtcgtttaaccgnggtttccggacggg

SEQ ID NO: 207206 - DNA, 731 bp, Homo sapiens
  misc_feature: GYAE6OF01CZ4PA.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagaagcgtggggcctcagtgaaggtctcctgcagcttcgtggattctacgtttacctctatagtatcaacgtggtgcgcaggccgcgtaggacacgcctggaggtggagtgggagtcgggacaacccgtaactacgtggtcgtacacgtagttcgtccttccaacctacttacccggtaccgggactaacgtaaccttaacctacgtaccgtaacccgtaaccggtaacctaccccgttaaccgaaacttaaaaaccacccgtaaacggtaccctaaacgtaacggttacgggtaacgtttacggaaacgggtactacccgtacggaacctaacgtttctaacggaacggtaaacccgtaccgggtccctttaacttaccgtttaacgttggtaccgtacggtaacggaccgttaccccggacggtaccgttaccgggttacggaacccggttacccggtaacccgggtacgacccgggtttaccggtcccgttttacggtacccgtttccggggtacccggggg

SEQ ID NO: 207207 - DNA, 620 bp, Homo sapiens
  misc_feature: GYAE6OF01AMNYU.17.25.C03.1.454.CMB.1.raw
  modified_base (443)..(443): a, c, t, g, unknown or other
  misc_feature (443)..(443): n is a, c, g, or t
  modified_base (576)..(576): a, c, t, g, unknown or other
  misc_feature (576)..(576): n is a, c, g, or t
tcagcgtagactagcacgaccggtgctcgatttagtagtgtagatttgggtttggggactcaacaaccacatctgtcctctagagaaaaccctagtgagcacagctcctcaccatggactggacctggaggatcctcttcttggtggcagcagctacaagtgcccactcccaggtgcagctggtgcagtcgtggggctggaggtggaagaagccgtggggcctcagtgaaggtcctcctgtcaaggctttcgtaggtattctaccgttttacctccttataagtatccaagtgggtcgcgccgaggccgctggaacaacgacctgagtggatgggatgggacgaaccctaactacgtggtgtacacgagtgtcttcacccatcccgcgggacacgtacttacatcgaaccacgtaacctcctacgaactaacacacgacctanacgtagggtattagggaacgagtacccgtagactatactcggaacctacggaccggttccgtacttacttaaccgtgcgtacggagtaccggtcccgaaccgtattcccggggtagacggtccgtaacccggngtaaccggtccggtccctttaggtcccggttgggtacccggggg

SEQ ID NO: 207208 - DNA, 882 bp, Homo sapiens
  misc_feature: GYAE6OF01AS63P.17.25.C03.1.454.CMB.1.raw
tcagcgtagactagcacgaccggtgctcgatttagtagtgtagatttgggtttggggactcaacaaccacatctgtcctctagagaaaaccctgtcgagcacagctcctcaccagtggactggacctggagactccttcttcgttgggtggacagcgtagctaacaagtcgaccccactcccgaggtgtcgagtccgtgggtacgacgtaggttcggtcgggggcctaggtaacgggttacggaaaacggaccggtcccgggttcgggggtacccttacggaagggttacggtaaacgggttcccttcccgtaggtaaccggtaaagggttcccgttttccggtacgggttaaccgtttacccgttaacccggtttttaacccttacccgttaacgttaacggttaaccgttaccggtaacggttcggggttacgccggtaccggtacggtcccggtacggtacggaaacccgtaacccggtaccgtaggtacggtaggacgggttacgggacggtaccgggacccgtaaacccgtaacgtcggttacgggtccgtacgtacggtacgttcgtacccgttacctaacccgtaccgttcccgtaccgggactaacgtacccttaacgcgtaccgaaccctacccgtaaccctaccgtaacctaaactaaccgacgtaccgtaaccttacggtaggtacggttacggttaggaaccgtacgtccgttaacggaacttaccggttacgaccggtacccggtaccggtaccggttacgttacgttacgttacggtacggtacggacggtaccgacccggtaacgcgtacggtgacgtccggaccgaggtacgtcggtacgttccggttcgtacgttcgggtaccgg

SEQ ID NO: 207209 - DNA, 852 bp, Homo sapiens
  misc_feature: GYAE6OF01EWVDT.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcgagtcgtggggctggaggtgaagacgccgtggggcctcgagtgaaggtcctccgtgacgaaggtcttcgtggtacttcgtaaccgttttaccctaccttaattacgtacttaccaacggttggggtcgccggcccctaacggggtccccgtcgttacgggaaccctaaccggtacccgtgggaacggttagggacggttagggggtaacgtacggggtaccccgtaaaaccccgttaacgtaccggttagggtacgtaccgtaacgttaacggtcccgtttaccgttaacccacccccgttaacgtccccggttacgggaaccgtaacggtaacccttacccgaagtacccgaacccgtaaccgtaaccccttacccctaacctaaacgtaaaacccaccgtaaccggtaccctaacgtagttacgggtaggtttacggaacgggtacgtacccgttagtaaccgtacgttccgtaacgggaacccgtacccggtaccgggtacccgtttaccgttaacgtttacggtaggtccggtaaccgggtaccgaacccggttaccccgaagggttacccggttaccgggtacggtacccgggtacccgtacggccggtacccgggtcccgggttttaccgttccggttaccggttccggggtaccggggg

SEQ ID NO: 207210 - DNA, 724 bp, Homo sapiens
  misc_feature: GYAE6OF01CCI6J.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggcctcgagtgaaggtctcctgacaaggtcttcgtggattcgtacgtttacctccgttatagttatacaacgttgggtagccgccgaggccgtactacgggaccaacgcctggacggtggagtggggagttcggggacctaaacccgtaactaacgttgggtactaccacgtaggttacgtcctttaccgaacccctagtccccgtacggggaaactacggtaaccttacccgataccggtaacccaaccgtaaccctaccctaaccgtaaactaaacccaacgtaacgacccttaaccgtagttacgggtaacgtttggaacggtacgtacccggttacgacctaacgtccgtaacggaaccgtaccggaccggtacccgttacttaacgttacgtacgtacgtacggtacgtacgtacccgtaacgtcgttacccgggtacgtaccgtacccgtaaccggcccgtacgggtcccgttacgtttccggtacgttcccgggtaccggggg

SEQ ID NO: 207211 - DNA, 714 bp, Homo sapiens
  misc_feature: GYAE6OF01BL3T6.17.25.C03.1.454.CMB.1.raw
  modified_base (247)..(247): a, c, t, g, unknown or other
  misc_feature (247)..(247): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcagtgaaggtctcctgcaaggcttcgnggattcacgtttacctctatagtatcaactgggtgcgccaggccgctggacaacgacctgaggtggagtgggagtggggaccgaacccgtaaatacgtagggtcgtacgacgtaggtcgttcctccaccctactccgtccgggacacgtaccttacatcgaaccacgtaacctcctaccaataaaccacgacgcctaacagtagggtacgttagggaacggtcggacccttggaacctcggtttcgaccgggaaacccggaccggtaacccgggtcccggtttaactttaaccgtttacgtcgggttacggaaccggtcgggtaaaacccggttacccccaacggggttaaccgtttccccggggggtactacccgggtaccccggttaacccgggggacgtaacccgggttcccgggtttaccccttttaccgggtaaccccggtttccggggtaacccggggggg

SEQ ID NO: 207212 - DNA, 679 bp, Homo sapiens
  misc_feature: GYAE6OF01C3LM2.17.25.C03.1.454.CMB.1.raw
  modified_base (296)..(296): a, c, t, g, unknown or other
  misc_feature (296)..(296): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctggaggtgaagagccgtgggcctcgagtgaggtcctcctgcgaaggtcttcgtggtacttcctacgttttaccctctattaagtatcgaacgttggggtnccggccgaggccgcgtaggaccaaccgacctggaggtggagtggggagtcggggacctaaacccgtagacggtggtcgtacacgtagttcgttccttaccaccctacgtcccggtaccgggaactacgtaacctttaccagtacgaacccgtaccgtaaccctccctaacctaaactaaaccacctaacgaccctaactaagttacgggtaagtttcgaagttcgaccgtacctagaacctacgttacgtacggacccgaaccgtacccggtaccgttacttacgttacgtcggtacgacgaaccgtaccgtaccccgtacgtacgttccgggtcgaccggtcccgtacggccgtaggtcccgttcgtttgtccgttacgggg

SEQ ID NO: 207213 - DNA, 834 bp, Homo sapiens
  misc_feature: GYAE6OF01DGTM1.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgctagtcgtggggctggaggtagaagaacgccgtggggccctcgaggtagtaacggtcctccgtgacgaaggtcttcgtggtattaccgtacgttttaccctactaattacgtactacgaacggttgggtacgccgccgacggtccgtcgtacggaaccgaccgtaccgtggacggtgggagtggggtaagtcggggaacccaaacccgtaacgtcggttgggtacctacgtaacgtacggtttcgttacccttacccaacccgtaccggttaccccggtaccggggaactaaccgtaaccctttaccgacgtaaccgaaccccgtaaccgtaacccttccctaaaccgtaaactaaaacccgacccgtaacgtaccctaaacgtaggttaacgggtaggtttaccgggaacggtaccgtaccgttaacgaccttaacggttaccgtaaccggaacccggtaacccggttacccgggttacccgtttacgtttaaccgtttaccgtcgggtacggtaccggtaaaccggtaccccgtacccgtaaccgggttaccggtaccccgggttacggaacccggttacccgggaccggtacggtacccggttccggtttcccggtttacgtcccgggtttccgggaacccggggg

SEQ ID NO: 207214 - DNA, 742 bp, Homo sapiens
  misc_feature: GYAE6OF01BTATX.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttcgtggattcacgtttacctcctatagtatcaactgggtgcgccaggccgcgtggaccaacgacctgagtggatgggatggggaccgaaaccctaacgacgtggtgtacacgaggttgtccttccaacccctacgtcccgtaccggggaacctaacgtaacccttaccaacgttaccgaaccctaacggtaaacccttcccctaccaaacttaaaacccaccaaaccggtacccttaaacgaacgttgggtaacgtttacggagggtaaccgtcccgttaggaaccctagttcccgtacggaacccgtaaccggacccggggttacccgttaactttaacgttaaccggttcggtacggtaccggtaaaggtacccggttaacccccgaacggttaccggttacccgggtaggaacccggaccccggttaaccgggaccgtaaccggggtccccggtttacccggttttcggtaacccggttttccggggtaacccgggggg

SEQ ID NO: 207215 - DNA, 542 bp, Homo sapiens
  misc_feature: GYAE6OF01C7S25.17.25.C03.1.454.CMB.1.raw
  modified_base (360)..(360): a, c, t, g, unknown or other
  misc_feature (360)..(360): n is a, c, g, or t
  modified_base (446)..(446): a, c, t, g, unknown or other
  misc_feature (446)..(446): n is a, c, g, or t
  modified_base (477)..(477): a, c, t, g, unknown or other
  misc_feature (477)..(477): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggggcctcagtgaaggtctcctgcaaggcttctggattcacgtttacctcctatagtatcaactggtgcgccaggccgctggacaacgacctgagtggatgggatggggcgaacccctaacactgggtgtcacgagtgtcttcacccntcccgtccgggacagacttaccatcgaccacgaactccctccataaaccacacgcctaacatgggattggaggacgcctgacatcnggaccgacaccgggcctctattactgtgcgngacgtcccacgctccgggtgcgccgtacgggctacggtcggtcctttcgaccgtttggtccgggg

SEQ ID NO: 207216 - DNA, 792 bp, Homo sapiens
  misc_feature: GYAE6OF01AQ7I6.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagagcgtggggcctcagtgaggtctcctgcgaggcttcgtggtattctacgtttacctcctatagtatcaacgtgggtgccgccgaggccgcgtaggaccaacgacctgaggtggagtgggagtgggaccgaaaccctaacgacgttggtgtccacgtagttcgttccttaccaccccacgtcccggtaccgggactaacgtaaccttaacccagttaccgaacccgaaccgtaacccttccctaacctaaactaaaaccacccgtaacgtaccccttaaacgaagttcggggtaagtttagggaacggaccgtaccgtacggaactacggttaccgtacgggaaacccggaccggtaacccggggttccccgtttacgttttaaaccgtttaccggttagggaaccggtaccgggtaaaccgggttaaaccccgggtacccccgtaaaacgggttccggtttaaccccgggggttggaacccccgggtaacccgggtttaccccggggaccggtaacgggggttccccccggtttaccgggttttttaaacccggtcccgggttttacccgggggtacccggggggg

SEQ ID NO: 207217 - DNA, 705 bp, Homo sapiens
  misc_feature: GYAE6OF01DBQ7Z.17.25.C03.1.454.CMB.1.raw
  modified_base (175)..(175): a, c, t, g, unknown or other
  misc_feature (175)..(175): n is a, c, g, or t
  modified_base (252)..(252): a, c, t, g, unknown or other
  misc_feature (252)..(252): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtncagctggtgcagtcgtggggctgaggtgaagaacgccgtcggggccccagtgaggtctcctgcaggtcttcgtggtntctacgttacctctactagtatcgtaatgggtgcgcgacggccgcgtacggacaaccgacctggacgtggagtgggagtcgggaccgaaacctaacgacgttggtcgtacgacgtacgtcgtccttaccgacccgtacgttcccgtaccggaactacgtaaccttaccgacgtaccgaaccctaacgaacccttaccctaaccgtaaacctaacccgaacctaacgtaccctaacgtaacggtcgggttaggttacggtaacggtcgggtacctacggtaacctacgtaccgttacggaccggtaaccggaacccggttccgttaaccgtttacttaacgtcgttacgggaccggtaagaaccgtccccggaacggtccggtacggtacggtccggtaccgtacggcgtacccgggtacggttccgttagccgtttccgggcgggtacccggg

SEQ ID NO: 207218 - DNA, 871 bp, Homo sapiens
  misc_feature: GYAE6OF01C5NJK.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatgactggacctggaggatcctcttcgttggtggcagcagctacaagtcgcccactcccaggtgcagctggtgctagtcgtggggctggaggtgaagacgcgtggggcctcgagtggaggtctccgtgcgtaaggtcttcgtggacttctaccgtttacctctaatacgtatcaacgtgggtagccgtcgacggcccgtcgtacggaacctaaccgaccgttgaacggtcggtagttggggacgttcgggaacctaacccctaaaggtaccgttggtactccgaaaccgtaggtttcggtaccctttccgaaaccccgtacttccccggtaaccccggggtacgtaaaccggtttaaccttaacccgtaacggttacccggaaaacccgtaacccggttaaacccttaccccgttaaacccaaacgttaaaacccaacctaaaccgggtaccctaaacgtacgggtaacggttaacggtttagggaaaccgtacggtacccgttacgggtaaccctaacggttacccgttaacggaacccggtaacccgtaccggggtaacccgtttcgtttaacgtttaaccggtcggttaacggacccgggttaaaccggtccggttaaacccccggtaacgttaaacccgggttcccgggttaacgggtacccggttaacccccgggttaccggacccgggttaaccgggtaccccgggtttaccccgttttaagggtccccggtttccggggtaaacccgggggg

SEQ ID NO: 207219 - DNA, 770 bp, Homo sapiens
  misc_feature: GYAE6OF01DBDRL.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttggtggcagcagctacaagtcgcccactcccaggtgcagctggtgcagtcgtggggctggaggtagaagagccgtggggcctcgagtgtaacggtctcgtgacgaaggtcttacgtcggtacttaccgtaaccgttttaacccttaccttagtaacgttattacgaacgttggggtacgccgccgacgggccgacgtacggaacaaccggacctggtaggtcggtagtgggacggtcggggaaccgaacccgtaacgacggttggtcgtaccgtacgtacggttacgtccttcccaacccgtacgtcccgtaaccgggacgtaacgtaccttaacacgtaccgacccgaaccgtaaccctaccctaacctaaacttaaaaccgaccctaaccgtacgtaaccgtaaggttacgggttaacggttacggaagggaccgtccgtaacgtacctacgttaccgaggtaacccgtaacccggtaccggttaccggttaccgttaacgttacgttcggtaccggtacgtaccgggtaccctaccgaacggtaccggtaccggtcggtaacccgtccggtaacggccggtccggttaccggttccgtttaacggtcccgttcggggtacccgggg

SEQ ID NO: 207220 - DNA, 817 bp, Homo sapiens
  misc_feature: GYAE6OF01BQH7V.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtagaagaagccgtggggcctcaggtgaaggtcctcctgacgaaggtcttcgtaggtacttctaccggtttacctccttattacgtattacctaaacgttggggtcgccgccgtaacgggcccgtcgtacggggaaccaaaccggtccgtggaacggttgggaacgtggggagtcgggaccgaacccgtaacgcgtggtcggttacaacgtaggtcgttaccttacccaccctacgttcccggtacccggggaactaccgtaacccttaaccgtacgtacccgaacccgtaaccgtaacccttcccttaacccgaaacgttaaaccaaccgtaaaccgacccttaaacacggtttacgggtaacgtttacggggaaacgggtacctacccggtaaggtaaccaccgttaccgtaaggaaccccggacggtaccccggggtactttaaccggttacctttacgtacgggttacggaacccggtaggtaccggtaacccccgacgggttacccggtacccggggttacgggtaccctaaccccgggtacggacccggttaccgggaccccggtttacccggtttaccccggtacgggttcccgggttaacccggggggg

SEQ ID NO: 207221 - DNA, 813 bp, Homo sapiens
  misc_feature: GYAE6OF01D0S0G.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactccaggtgcagctggtgcagtcgtgggctggaggtgaagaagccgtggggcctcgagtggaaggttctccgtgacgaaggtctttcgtggtaactttccgtaaccgtttttaccctaccgttaattaacggttaacttacgtaaaccgttgggggttacgacccggtacccgacgggtcccgtacgtacgggaaccgtaaaccggtaccgttggaacggttcgggaagtggggaacgttacgggggaaccctaaacccgttaacgtaacgttcggggtacgtacgaacgtacggtttcggtcccttaccgaacccctacggttccccggtaacggggacaaacggtttaacccctaacgtaattacccggaaacccgtaacgtaaccccttacccgttaacccaaacgtaaaaccgaaccaacgtacccttaacgaacggttacgggttaaggttacggaggtaaccgtccgtttaacggaacgtacttacggtaacggtaacccggaccggtaccgggtaccgtaacttaacgtttaaccgtggtacgacggtaagtcccgtacccggaacgttacggtccgtagaacggtccgtaacggaccgtacggttaccggttccctttaggacccgttgggtacccgggg

SEQ ID NO: 207222 - DNA, 790 bp, Homo sapiens
  misc_feature: GYAE6OF01A6VY4.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggcctcgagtgaaggtctccgtgcaaggcttcgtggtattcgtaccgtttacctcctatagtactacaacgttgggtgccgtcccgagggtcccgcgtacggaccgaaaccggacccgtagggtacggtcgggaggtaggggaacggtcggggacccgtaaaacccctaacgtacggttagggtccggtacgaccgtaagttcggttaccttacccaacccccgtacgttccccggtacccgggggactaacggtaaccccgtttaacccgaagttaccggaaccccgtaaccgtaaaccccgttccccgttaacccctaaacttaaaacccgacgtaaaccgacccttaacgtaacggtacgggtaagtttaccgggaaggtacggtacccgtaggaaccgtacgttacgtaccggaaccggtaacccggcccgggttaccgttaccgttaacgtttaccgtggttaaccggacggtaacggtacccgtaccccgtacggaccgttcggttacggacgtcccgtacgggacgtaccggtccgttacccgtttcgtaccggttcgggtacccgggg

SEQ ID NO: 207223 - DNA, 806 bp, Homo sapiens
  misc_feature: GYAE6OF01DAB4A.17.25.C03.1.454.CMB.1.raw
  modified_base (253)..(253): a, c, t, g, unknown or other
  misc_feature (253)..(253): n is a, c, g, or t
tcagcgtagactagcacgaccggtgctcgatttagtagtgtagatttgggtttggggactcaaacaaccacatctgtcctctagagaaaaccctgtgagcacagctccctcaccatggactggacctggaggatcctcttcgttggtggcagcagctaacaagtcgcccactcccaggtgcagcgtggtgcagtcgtggggctggaggtagaagagccgtggggcctgagtgaaggtctcctgcaaggcttgnggattctacgtttacctccgtaatagtatcgtaacgtgggtacgcgcgacggtccggcgtacggaaaccgaaccgtccgtaggtaggtgggtaggtcggggaagttcggggaacctaaacccctaagtaccgtggtacgtacacgtacgttcgttcctaccaccctacgtcccgtaccgggactaacggtaaccttaccgaagtaccgaaccctaacccggtaacctcccgtaaccaactaaaaccgacctaaccgtacctaaacgacggttacgggtaacggtttagggacggtaacgtacccgtacgtaaccgtaacgtaccgtaacggaaccggaacccgtacccgggtacccggttaaccgtttaaaccgtttaccggttacggtacgggtaaccggtaacggtacccggttaccccggaaaccggttaaccggtaccccggggtttacggaacccgggtaccccggttaccgggtaaccccggtaccgggttaccccgggtttacccgtttttaccgggtacccggttttaccgggggaccccggggg

SEQ ID NO: 207224 - DNA, 771 bp, Homo sapiens
  misc_feature: GYAE6OF01BBN44.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggcctgagtgaacggtctccgtgacgaaggtcttcgtggtattcgtaccgtttacctcctatagtactacaacgtgggtcgccgccgacggcccgcgtaggaaccaaccgtaccgtggtaggtggagtggggagtcgggaccgaacccgtaacgtacgtggtcgtacacgtagtcgttccttaccaccctacgtcccgtaccgggactacgtaccttaccagtacgaacccgaaccgtaaccctaccctaccgtaaactaaaaccaaccgtacgtaacccgtaacgtaacggtacggggttaacgttagggaaacgggtacgtacccgttacgaaccttaacgttaccgtacgggtaaacccggtaaccggacccggggttacccgtttaactttaacgtttacggttcggtacggtaaccggaacggttacccgtacccccggtaaacggttaccggttacccggggtaacggtacccggtaccccggtaccgggaccggtaccgggttcccgggttacccgttttacggtacccggtttccggggtacccggggg

SEQ ID NO: 207225 - DNA, 657 bp, Homo sapiens
  misc_feature: GYAE6OF01ANYYE.17.25.C03.1.454.CMB.1.raw
  modified_base (235)..(235): a, c, t, g, unknown or other
  misc_feature (235)..(235): n is a, c, g, or t
  modified_base (281)..(281): a, c, t, g, unknown or other
  misc_feature (281)..(281): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaaagaaggccgtggggcctcgagtgaggtcncctgcaaggctctggattcacgttacctctatagtatcaagtgggncgccgtaggccgcgtgacacgacctggagtggatgggagtcgggaccaaaccctaacgacgtggtcgtacgactggtctcctaccaccacgtcccgtaccgggacgtacgtaaccttaccgataccgaaccctaacgtaaccctcccgtaaccaaactaaaaccgactaaccgaccctaagtagtacgggtagttacggaaggaccgcctaggaccagtcctggaacccggacgcccgggtacccttaagtactttaccgtggtccggacggtacgtaccggtacccccagggtaccgttcccgggtagacccgggtacccctagggcccgtacgtcccgggtttaccgtttggtaccccgttgggtacccggggg

SEQ ID NO: 207226 - DNA, 713 bp, Homo sapiens
  misc_feature: GYAE6OF01CCH5A.17.25.C03.1.454.CMB.1.raw
  modified_base (307)..(307): a, c, t, g, unknown or other
  misc_feature (307)..(307): n is a, c, g, or t
  modified_base (388)..(388): a, c, t, g, unknown or other
  misc_feature (388)..(388): n is a, c, g, or t
  modified_base (602)..(602): a, c, t, g, unknown or other
  misc_feature (602)..(602): n is a, c, g, or t
tcagcgtagactagcacgaccggtgctcgatttagtagtgtagatttgggtttggggactcaacaaccacatctgtcctctagaagaaaaccctgtgagcacagctcctcaccatggactggacctggaggatcctcttcttggtggcagcagctaacgaagtcgcccactccaggtcgcagcgtggtgcagtcgtgggctggaggtagaagagccgtggggcctgagtagaaggtcctccgtgacgtaacggtcttcgagtattacctaacgtttaccctcttaatagtaactcgaacgtgggtcnccgaccgcggccggtgaggaaccgaacgtaccgttaggaaggtggagtacggggaagttacggggaccctaaacccgtaanaccgttgggtacgtcacgtagttcgttactaccgtacccgacgtcccggtaccggaacgtaactaaccttacgaacgtacaacccgtaacgaacccttacctaccaaacgttaaaacccagtaaccgtaacgtaactaggtaggtaggttaacggacgtcgacgtagtacagtacgtcgaaccggtacgaccggtaccgttattagttaccggngttacgcgttaaaccgtcccgtaccctaaaggtcccgtagggcgaaccggttaccggaccggaacgtaccggtcccggtttaccgtcggtagtttcccggggaaccggggg

SEQ ID NO: 207227 - DNA, 627 bp, Homo sapiens
  misc_feature: GYAE6OF01EPXK6.17.25.C03.1.454.CMB.1.raw
  modified_base (248)..(248): a, c, t, g, unknown or other
  misc_feature (248)..(248): n is a, c, g, or t
  modified_base (507)..(507): a, c, t, g, unknown or other
  misc_feature (507)..(507): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctggaggtgaagagccgtggggcctcgagtgaaggtctcctgcaggtcttcgnggtattccgtaccgttacctctatagtactacgagtggtcgccgccgacggccgcgtacggaaccgaccgacgtggtaggtggaggtgggacgtcgggaacccgtaaacccgtacgacgttcggtcgtacacgtcgtcgttcctaccgaccctacgtcccgtacggactaccgtacctacgacgaccgaacctacgtaccctaccctaacctaacaaccacactacctaagagtaggtacgtagacggtacgtccgtanactacgtcgacgaccgaccgtaccgtacttacttacttcgtgacggacgacgtccgaccgtacggtccgtcggacgcccgaccgtaccgcgtcggtccgttacgttcgtccgtcggcggg

SEQ ID NO: 207228 - DNA, 700 bp, Homo sapiens
  misc_feature: GYAE6OF01EEEZD.17.25.C03.1.454.CMB.1.raw
  modified_base (290)..(290): a, c, t, g, unknown or other
  misc_feature (290)..(290): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagccgtgggcctcagtgaagtctcctgcaggcttcgtggtattctacgtttacctctatagtatcaacgtggtgcgccaggccgntacggacaacgccgtaggaggtggagtagggagtcgggacctaacccgtaacgacgtgggtcgtaccgacgtacgttcttaccttccgacccctacgttacccgacgggaacctacgtaacccttaaccgtattacggaaccctaaccgtaaccttccccgtaaccaaacgttaaaacccgaccgtaaccgacccttaacgaacgttacgggtaaggttacggacggtacgaccgttagaacgtcgttaccgaacggaaccgaccgtaccggtaccgtttacttaacgttacgtcgggtacgtaccggtagtacccgtacccgtaggtacccgttccgggtacggaccgtacccggtacgggccgtacgggtccccggtttaccgtttggtaccggttcccggtacgggg

SEQ ID NO: 207229 - DNA, 677 bp, Homo sapiens
  misc_feature: GYAE6OF01DRUI1.17.25.C03.1.454.CMB.1.raw
  modified_base (177)..(177): a, c, t, g, unknown or other
  misc_feature (177)..(177): n is a, c, g, or t
  modified_base (238)..(238): a, c, t, g, unknown or other
  misc_feature (238)..(238): n is a, c, g, or t
  modified_base (248)..(248): a, c, t, g, unknown or other
  misc_feature (248)..(248): n is a, c, g, or t
  modified_base (251)..(251): a, c, t, g, unknown or other
  misc_feature (251)..(251): n is a, c, g, or t
  modified_base (293)..(293): a, c, t, g, unknown or other
  misc_feature (293)..(293): n is a, c, g, or t
  modified_base (380)..(380): a, c, t, g, unknown or other
  misc_feature (380)..(380): n is a, c, g, or t
  modified_base (577)..(577): a, c, t, g, unknown or other
  misc_feature (577)..(577): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtcgcccactcccaggtncagtcgtggtgcagtcgtggggctggaggtgaagagccgtgggcctacagtgacgtcctcngcgagtctgngtntctacgttcctctatagtactcagtggtcgcgccgacggccngtacggaccaaccgaccgtggaggtcggaggtgggacgtcgggaccgtaaccccgtaacgacggttggtacaccgtactaggtttcnccgttacccaccgtaccgtacccggtacggtaacaccgttaaccttaccgacgtaccgaaaccctacgtaaccctaacctacccgaaataaccgaacccaccgtaccgtactacgtagggtacgttagggacggtacgtcctacgacttacgtacgtaccgaacgtaccggacccggttccgacttttacgtaacgngtacggacggtacgtaccgaccgttaaccggcgggtcgtacgccggggacctaccgggacgtcgtccggttaccggttacgtcggtttccgggacccggg

SEQ ID NO: 207230 - DNA, 783 bp, Homo sapiens
  misc_feature: GYAE6OF01CB0AP.17.25.C03.1.454.CMB.1.raw
  modified_base (256)..(256): a, c, t, g, unknown or other
  misc_feature (256)..(256): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttgggtggcagcagctacaagtcgcccactcccaggtgcagctggtgcagtcgtggggctggaggtgaagaagccgtggggcctcaggtgaaggtctccgtgaccgaaggtctttcnggtacttcgtaaccgttttacctaccttatagtactacgtaacgttgggtcgccggccgacgggccccgacgtacgggaacgtaaacccggtccgtagggaggttagggaggttcggggtagtaccgggggaaccctaaacccctaacgcgttggtacgtacgacgtagttcggttccttaccaccctacgttcccggtaccgggactaacgtacctttacagtaccgtaacccaaccgtaacctccccgttaaccaaacgtaaacctacccgtaaacgtcccttaaaccgtagtacggggttagttaagggaacggtaccgtacccgtagacccgtacttaccgtaacggaaccgaaccccggtaaccggggtcccctttaagttaccgtttaacggttcggtaacgacgggtacggtaacccgtacccggaacggtccggttacccgggtaggaccccggtacgtaacccggcggtaccggggtccgtttaccgttaccgggtcccgttttgggggaccccgggg

SEQ ID NO: 207231 - DNA, 694 bp, Homo sapiens
  misc_feature: GYAE6OF01CTVIH.17.25.C03.1.454.CMB.1.raw
  modified_base (286)..(286): a, c, t, g, unknown or other
  misc_feature (286)..(286): n is a, c, g, or t
  modified_base (297)..(297): a, c, t, g, unknown or other
  misc_feature (297)..(297): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctgagtgaaggtcctcgtgacgaggtcttgtggtattcgacgtttacctctattagtactcaacgtgggtncgccgaggccncgtgaactaaccgctaggagtgggatcggggagtcgggaccgtaacccgtagaccgtggtcgtcacgtaggttctacgttacaccccgtactcccggtaccgggactacgtaaccttacacgtacgacccgtaacgaacctccgtaaccaaactaaaccactacgaacctaccgagtacggtaggttaggacggaacgtccgtaacgacgtacgttacgtaacggaacccgaacccggtaccgggtccccgttagttaacgttaccgttcggtacggtccggtaaaccggtccgtacccgtaccggtacggttacccgggtcggaaccggttaccccgtaagggcccgtacggtaccccggttagtttaccggtaccgtttccggggaacccggggg

SEQ ID NO: 207232 - DNA, 725 bp, Homo sapiens
  misc_feature: GYAE6OF01D6CN7.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtagaagagccgtcgggcctcaggtgagtcctccgtgcaggtcttcgtggtacttctaccgtttacctcctaagtagtactcgaacgtgggtcgccgccgacggccgtcgtacggaaccaaccgaccgtggacggtggaggtgggagtcgggaaccgtaaacccgtaacgacgtgggtcgtaccgacgtacggttcgtacccttacccaccccgtacgtccccgtaccggggacctaacgtaccgttaaccctacgtaccgaaccccgtaaccgtaacccttacccgtaaccctaaacgtaaacccaccgaaccggtacccttaacgtacgttaggggtaagttacgggacggtaccgtaccgtacgactacgtccggtacgaaccgaccggtaccggtcccgttaattaccgttacgtggtacgacggtacgtaccggtacccgtacgtaccggttcggcggacccggtacccgtaccggccgacggtcccggttcgtttcggtccggttccgggtacccgggg

SEQ ID NO: 207233 - DNA, 769 bp, Homo sapiens
  misc_feature: GYAE6OF01AU7JO.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctgaggtgaagacgcgtggggcctcgagtgaacggtctccgtgacgaggtcttcgtggtacttccgtaccgtttacctcctaatacgtactacgaacgtgggtacgccgaccgaggcccgcgttacggaaccaaccggtccgtaggaggtggagtgggagtcgggacctaaacccgtagcgttggtcgacacgtagttcgtaccttaccgaccctacgtacccggtaccggaactacgttaacccttaaccgacgttacccgaaacccgtaacccgtaaccttaccccgtaaccgtaaaccttaaacccgaacgtaacccggtacccgttaacgtaaacgggtttacggggtaaacggtttacgggaaccggttaccggacccgttaaggaaccctaaccggttacggaacccggtaaccggaacccggtaccggggttacccttacgttaacgttacggtcgtacgggaccgtaacgtaccccgtacccgaacggtaccgtacccgggtagacccgttacccgacggaccgtacgggtccccgttacgtttcggaccgttccggggtaccggg

SEQ ID NO: 207234 - DNA, 772 bp, Homo sapiens
  misc_feature: GYAE6OF01DWAPR.17.25.C03.1.454.CMB.1.raw
  modified_base (248)..(248): a, c, t, g, unknown or other
  misc_feature (248)..(248): n is a, c, g, or t
  modified_base (293)..(293): a, c, t, g, unknown or other
  misc_feature (293)..(293): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggagatcctcttcttggtggcagcagctacaagtcgcccactcccgaggtgcagctggtgcagtcgtggggctggaggtgaagagccgtgggcctcagtgacgtctcctgacgaggcttcgnggtattcaccgtttaccacctatacgtattacgaacgttggggcnccgaccacgggtcccgcgttaggaaccaaaccgggtcctgggaagttgggaggtggggactcggggtaacccgaacccttaacgacggttgggtacgtcaccggtaggttcgttacccttacccaacccgtacctttccccggaccggggtaacctaacggtaccctttaaccgagtacccggaacccgaaacccggtaacccttaccccgttaaccaacttaaaaacccgtacccgtaaccggtacccttaaacgtacggttacgggtacggtttacggaacggaccgtacccgttgtaaccgtaccgttacgtaaccggaccggaaccgaccgggttccgttacttaacgttatacgggtcgtaccggaacggtacctaccccggaacggtaccggtcccggggtacaccgggtacccgtaccggaccggtacggtccccgggttaccgtttcggcccggttcgggtaacccggggg

SEQ ID NO: 207235 - DNA, 666 bp, Homo sapiens
  misc_feature: GYAE6OF01DNHMX.17.25.C03.1.454.CMB.1.raw
  modified_base (269)..(269): a, c, t, g, unknown or other
  misc_feature (269)..(269): n is a, c, g, or t
  modified_base (298)..(298): a, c, t, g, unknown or other
  misc_feature (298)..(298): n is a, c, g, or t
  modified_base (372)..(372): a, c, t, g, unknown or other
  misc_feature (372)..(372): n is a, c, g, or t
  modified_base (475)..(475): a, c, t, g, unknown or other
  misc_feature (475)..(475): n is a, c, g, or t
  modified_base (490)..(490): a, c, t, g, unknown or other
  misc_feature (490)..(490): n is a, c, g, or t
  modified_base (562)..(562): a, c, t, g, unknown or other
  misc_feature (562)..(562): n is a, c, g, or t
tcagcgtagactagcacgaccggtgctcgatttagtagtgtagatttgggtttggggactcaacaaccacatctgtcctctagagaaaaccctgtgagcaacagctcctcaccatggactggactggagatcctcttcttggtggcagcagctacaagtgcccactccgaggtgcagctggtgcagtcgtgggctggaggtagaagacgccgtggggcctcagtgaaggtctccgtgacgaaggtcttcgtgattccgtacgtttaccnccgtaattagtactcaacggtggggtacnccggcccgaggtccgtacgtacgggaacaaccggtctggagttcggagtgggtaactcgggacctaaccctaancggttggctacgaagtcgtacgtccttccaccctacgtacccgtaccgggactacgtaccttacgataccggaccaacgtaccctccgtaaccaactaaaccncgactacccgttaanggttacggtagttaggaaggtcgcgttaacggacttagtctagggaccacggcggtccttacgtacttacgngtaacggcctagggtaccctcccgaaggtccgtaccgggtacgacccggtacccgtacggtcgaccggttcccggttgtttaccgacgtttcggggacccgggg

SEQ ID NO: 207236 - DNA, 609 bp, Homo sapiens
  misc_feature: GYAE6OF01B78P1.17.25.C03.1.454.CMB.1.raw
  modified_base (242)..(242): a, c, t, g, unknown or other
  misc_feature (242)..(242): n is a, c, g, or t
  modified_base (403)..(403): a, c, t, g, unknown or other
  misc_feature (403)..(403): n is a, c, g, or t
  modified_base (464)..(464): a, c, t, g, unknown or other
  misc_feature (464)..(464): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctgaggtgaagagccgtggggcctcagtgaagtctctgcgagcttnggattcacgtttacctctatagtatcaacgtgggtgcgccaggccgcgtggaccaccgaccgtgaggtggagtgggagtcggggaccgaaccccgtaacgacgttggtcgtacgacgtagttgtccttccacccctactccgtccggacacgtaccttacntacgtacccacgtaacctccctacaactaaaccacacgcctactagtggtagttggagacnccgtagacatctacgaaccgcgtaccggtccgtattactacgttacgtcgtacgacgtacccggacccgtacggtccgtccgggtagccggtacccgtaccgggactcgggtaccgttaccgtttcgtccgttcgggtaccgggg

SEQ ID NO: 207237 - DNA, 1173 bp, Homo sapiens
  misc_feature: GYAE6OF01A4LC6.17.25.C03.1.454.CMB.1.raw
tcagcgtagactagcacgaccggtgctcgatttagtagtgtagatttggggtttgggggactcaacaaccacatcgtgtccgtctagagaaaaccctgtgagcacagctcctcaccatggactggacctggaggactcctcttcttggtggcagcagctacagtcgcccactcccgaggtgcagcgtggtgcagttcgtggggctagggaggtagaacgaacgtccgtaggggtcctacgaggttacggaacggttccttaccgtaggtaccgttaaggtcctttcgtacggtactttaccttaaccggtttacccttaccttaattacgttagttacccgtaagttcggggtacaccggtacccgtaacgggccccgacgtttacgggaacctaaaacccggtcccgttagggtaaccggttaggtaacggttacggggggtacgttacccgggggtaaaccccggtaaaaaccccccggtttaaaagggtcccggtttacgggttaacccgttacccgtaacgtttaaccgggttacggtttcccccgttaaaccccgtaacccccgtttaacgggttttacccccccggggaacccggggttaaaacccgttaaacgggttttaaaccccccttttaaaccccggaaccggtttttaccccggtaaaaaccccccggttaaaacccccggtttaaacccccgtttaacccccgttaaaaccccgtaaaaccccgttttaaaaaccccgaaaccccggtaaaccccgttaaccccgttaaaccgtttaaaccggtttaacggggtaaacgggttttacgggaaacggggttaccggttaacccggttaacggtttaacccgttaaccgttttaaccgggaaacccggtaaacccggttaaaccccgggtaaccccggggttttaacccggttttaacccgtttttaacccggtttaacccgggttaccgggttaaccggggttaaaccgggtaaaccccggttaccggtaaacccccccggttaaagggttaccccgggttaacccggggttaacccggtaacccggggtaaccccgttaaccgggggttaacccgttacccggggttacccgggtttacccggtttttaacccgggttaccgggtttcccccggggtttaaacccggggg

SEQ ID NO: 207238 - DNA, 687 bp, Homo sapiens
  misc_feature: GYAE6OF01CZ10H.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagaagcctggggcctcagtgaaggtctcctgcaggcttcgtggattctaccgtttacctcctatagtatacaacgtgggtgcgccgacggccgcgtacggaacaaccgtaccgtaggacggtgggtagtgggacgtcgggaccgaaaccctaacgacgtggtcgtcaacgtagttcgttccttacaccctacgtcccgtacccggggactacggtaaccttaccagtaccgaccgaaccgtaacctccctaaccgaactaaacgactaccgtacctaacgagttagggacgttggaacggccgtaccttacggacctaacgttcgtacggaaccggtaaccgtacccgggtccgttacgttaactttacgtgtaggtaaccggacgtaccgtcccggaacgtacggttacccgggacggtacggacccgtacgggtacgtaccgggtaccgttcccgtttacggccgtttcgggacccggggg

SEQ ID NO: 207239 - DNA, 948 bp, Homo sapiens
  misc_feature: GYAE6OF01AQEQ1.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccgaggtgcagctggcgcagtcgtggggctggaggtgaagaagccgtggggcctcgagtggaacggtctccgtgacgaaggtcctttcgtagggtactttaccgtaaccggtttttaaccctaccttaagttaaggttaactaccgtaaacgttggggttcgacccggccgaacgggtcccggtacgttacgggaaccaaaccggtaacccgtagggtaacgggttaggggtaacggtacgggggtaaggttaccgggggaacccgtaaaaacccccgttaaaccgtaaccgttcggggtttacgtaccgtaaacgttacggggtttcttaccccgtttaacccaaccccgtaaccgtttaccccggtacccggggtaactaaaccggttacccttaacccgaagttacccggtaaacccgaaccgttaaccccttaccccgtaacctaaaccgttaaaaacccaacccggaaccgtacccgttaaacgtaacggtttaggggtaaccgtttacggaacgggaaccgttcccgtaaggtaacccgtactttaccgtaaccggaacccggtaacccggtaccccgggttacccttacggtttaaacctttaaccgggtaggttaccggaaaccggttaacggtaccccgttaaccccgggaaggttccccggttacccggggtaagggtaaccccgtaccccgggttaaccggaccggtaacggggtccccggttttaacccgtttacgggtacccgggttttcggggaaccccgggggg

SEQ ID NO: 207240 - DNA, 925 bp, Homo sapiens
  misc_feature: GYAE6OF01C7O2P.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatgactggacctggagatctcttctggtgcagcagctacaagtcgcccactcccaggtgcagtctggtgctagtcgtggggctggaggtagaagaacgtccgtcggggcctcgtaggtagtaacggttcctaccgtgtacgtaacggtcttcgtacggtactttaccgttaccgtttaccctacctattaacgtactaccgtaacggtgggtacgccgtaccaacgggtccgacgtaccggtaaacctaaccgaccgttggacggtcggtaacggttacggggaaccgtccggggaaaccccgtaaaccccgtaaacgtaccggttcgggtaccgtaccgtaaacgtcggttaccgttaccccttacccgtaaaccccgttacccggtaccccggtacccgggaaccgttaaaccggtaaccccgttttaaaccgtacggttaacccgtaaccccgtaaacccgttaaccccgttaccccgttaaacccgtaaacttaaaaccccgaccccgtaaaccgtaacccgttaaacgtacgggtttaccggggttaaacgggtttacggaaaccgggttacgttaccccggtaagtaaccgttaccgtaaccgggtaacccgtaacccgggtaaccccgtaggggttaccccccttaacgttaacgtttaccgtaccgggtaccggtaaaccggtaaccgtacccggtaaccccgtacggttacccggtacccgggtacgtaaccccgtcccggttaaccggaccgtacccgggttacccgtttcccgttacggtcccggtttcggggaacccgggg

SEQ ID NO: 207241 - DNA, 705 bp, Homo sapiens
  misc_feature: GYAE6OF01C9R2V.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtcgcccactcccaggtgcagctggtgcagtcgtgggctgaggtgaagaagccgtggggcctcgaggtgaaggtctccgtgcaggcttctggattctacgtttacctccgtatagtatcaacgtgggtacgcgccgacggccgcgtacggaaccaaccgacctggaaggtgggaagtcggggtagtacggggacccgaaaccctaacgaccgttggtcgtacaacgagtttcgtcctttaccgaccctacgtcccggtaccgggacaacggtaccttaccataccggaaccctaccgtaaccctccctaacctaaactaaaccacgtaaccgtacctacaaggtcgggtacgttacggaaggtacgaccttaggaactagttcgaacgtaacgtaacgtaacccgggtcctatttaacgttcgtacgttcggaccggtaacggtacccgttccgaaaccgggttcgttcccgggtaacggaccgtacccggtaacggccgtaacggttccggttacccttttcggcccggtttccgggaccggggg

SEQ ID NO: 207242 - DNA, 646 bp, Homo sapiens
  misc_feature: GYAE6OF01ANYDW.17.25.C03.1.454.CMB.1.raw
  modified_base (512)..(512): a, c, t, g, unknown or other
  misc_feature (512)..(512): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtgcccactcccaggtgcagctggtgcagtcgtggggctgaggtgaagaagcctggggcctcagtgaggtctcctgcaaggtcttctggtattctacgttacctctatagtatcactgggtgcgccaggccgctggaccacgaccgtggagtggagtgggagtcgggaccgtaacccgtaacgcgtaggtcgtaccacgtacggttcgttcccttacaccccgtacttcccggtacccgggaccaacgtaaccctttaaccgagtaccgaacccgtaccgtaactccccctacaaactaaacctccgaacgacccctagagttcgggaagttagacgggctccgtggaacctntcgtacggaccgaccgtaccggtcccttattacttcgtggcgtacgacgtacccgcccgtagtacgtccgggtagccggtaccccgtaggccgtacggtcccggttacctttggtaccgttcggggaaccgggg

SEQ ID NO: 207243 - DNA, 804 bp, Homo sapiens
  misc_feature: GYAE6OF01BXT3E.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctggaggtagaagagccgtgggcctcgaggtagaacggtcctccgtgacgtaacggtcttcgttaggtactttaccgtaaccgtttaccctaccttaatacgttactacgtaacgtgggtcgccgtccgacgggccgacgtacggaaccgaaccggtaccgtggtaggtaggtacggtaggggagtaccggggaacgtaaaccccgtaacgtacggttacggtacgtaccgtaagtacgttacgttcccttaccgaccctaccgttacccggacccgggactaacgtaacctttaacccgacgtaccgaaccctaaccggtacccctaccccgtaacgtaaactaaacccgtaccaaccgtacctaacgtacgtagggtaaggttacggaacggtaccaccgtacgtaaccgacgttaactacggaacccgtaaccggtacccggtaccgttacctttaacgttcggtaccgtacggtaccgggtaccgtacccgggtacccgtaaccggtaccgggtaccgtaccgggtacccggtacccggtaccggaccggtacccgggtccggtttacccggttccgggttaaccggttgggggtaaccccgggg

SEQ ID NO: 207244 - DNA, 640 bp, Homo sapiens
  misc_feature: GYAE6OF01BPRUJ.17.25.C03.1.454.CMB.1.raw
  modified_base (376)..(376): a, c, t, g, unknown or other
  misc_feature (376)..(376): n is a, c, g, or t
  modified_base (429)..(429): a, c, t, g, unknown or other
  misc_feature (429)..(429): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctccgtgcaaggcttgtggtattctacgtttacctcctatagtactcaacgtgggtgcgccacggccgcgtcggacaacgacctggagtggagtgggagtcgggacgaacccgtaacacgtggtcgtcactagtgtctcaccctntccgcgacagtactacagtcgacacaactccctacaataacgacacgacctanacgtgggacgttggaggtcgcctaggaacacgttcgaacggtaacgtacgttaaccgggacccgtttacttaacgttcgttcgggtacgtaccggaacgtaccggtacccgtaccggtaacgttccccggggtaggtacccggtccggtaaacccgggcgtacgggtcccggttaccggtttacggtaaccgtttccgggtaaccgggggg

SEQ ID NO: 207245 - DNA, 784 bp, Homo sapiens
  misc_feature: GYAE6OF01CA4X8.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtagaagaacgccgtaggggcctcgagtgaacggtctcctgacaaggtcttcgtagtacttcacgtttacctacttatagtactctaacgtggggtcgtcggccgtacgggccgcgtaggaaccaaccggtacctagggacgttgggacgtaggggacttacgggggacccgtaaaacccccgtaacgaccgttcgggttacgtacctaccgtaaggttcggtttacccttacccaaccccgtacttaccccggtacccggggtaacctaaggtaccctttaaccgacgttaccgaacccaaccggtaacccttccccgtaaccgtaactaaacctaaccgtacgtacccctaatacggttacgggtaaggtttacgggacgggtacgtaccgtacggaacctacgttaccgtacgacccggtacctaccgggttacccgtacttaacgtttacgtcggtacggtacggtaccgtaccgtaccccgtaacggtcgttacccggggtaacgtccggacccggtacggacccgggtaacggccccggtttaccgtttacgggttaccgttcgggtacccgggggg

SEQ ID NO: 207246 - DNA, 711 bp, Homo sapiens
  misc_feature: GYAE6OF01CPS18.17.25.C03.1.454.CMB.1.raw
  modified_base (285)..(285): a, c, t, g, unknown or other
  misc_feature (285)..(285): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtgcagcagctacaagtcgccccactcccaggtgcagcgtggtgcagtcgtggggctggaggtgaagaagccgtggggcctcagtgacggtctccgtgcaggtcttgtggattctacgtttacctctatagtatacagtggtnccgccgacggccgcgtacggaaccgaccgaccgtggaggtaggtaggtgggacgtcgggacccgtaaacccgttaagacgttcggtcgtcgacgtagttcgtacttacccaccctaccgtcccgtccgggacctaacggtacccttaccgactacgacccgaacgtaccctaccctaacctaaactaaaccctaccgaaccgtacccttaaactacggttacgggtacggttaagggacggtaccgtcccgtaagtacgtacgttaccgtacgaacccgtaccggtacccgggttacccgttacttaacgtttcgtacggtcgaccggagtacccgtacccgacggtaccgttccgggacggtcccgtacccgtaaccggcgtaccggtcccgttaccgtttacggtccgttacgggtaccggggg

SEQ ID NO: 207247 - DNA, 1200 bp, Homo sapiens
  misc_feature: GYAE6OF01DF3K3.17.25.C03.1.454.CMB.1.raw
tcagcgtagactagcacgaccggtgctcgatttagtagtgtagatttgggtttgggggagtcagtctcagtcaggacacagcatggacatgagggtcccccgctcagctccgtgggctcctgctactctggctccgagctgccagatgtgacatccagatcgaccctagtcctccactccctccctgtcctcgtcctcgtgggtcggggtcagtacgtccacctatcctaccgtttcggacccggtaactaaacggtcccgtaaaccgggtaacccgttttaaaaacctttaagtttttaaaaagtttcgggttaacttaccgaacggaaccgtaaaaccggtaaaaaacccggttaacgggaaaaaacccgccccccgtaaacggttaacccccttaccgtacgttaaccgtttacccgttccggttagggttaaccggtaccctaaccgttacccgtaacccgtttccggtaacgggtaaccggttaaaccggggttccggggtacccccttaacccccgtaacggtttaccggggtaacggggttttacccggaaggggtttcggggaaccggttaaccggggtttagggtaaccggttttaccggggtacggggggtaaacttaacgggttttaaccttttaacccgtaaaccttccctttaaaccccgaaaccccgttaacccgttaaaccccctaaccccggtttaacccctttaaccccggttacccgggtaaaacccccggttaaaccggtttaacggggttaaaccgggtttaacgttttaccgggtaaaccggtaaaccctttaaaaccggttttaacccctttaaaccgtttaacccggttttaacccggtaaaccgttaaaacccgggttaaaaccggttttaacccccggttttaaacccccgtttacccccgggttttttaaccccccccggtacggggttttaaaccccgttttttaaacccccggggttttacccgggggggaaacccccggggtttaaaaaaacccgggggtttaaaacccccgtttaaaaggggggttttaaccccgggaaaaaacgtttaaaaccccccggtttaaaacggggaaaaaacccccgggtttacgggggttttaaaccccgggtcccggtttaaaccccggtaaacccggttaaaccccgttaaaacccgggttttcccgttt

SEQ ID NO: 207248 - DNA, 533 bp, Homo sapiens
  misc_feature: GYAE6OF01AK421.17.25.C03.1.454.CMB.1.raw
  modified_base (280)..(280): a, c, t, g, unknown or other
  misc_feature (280)..(280): n is a, c, g, or t
  modified_base (330)..(330): a, c, t, g, unknown or other
  misc_feature (330)..(330): n is a, c, g, or t
  modified_base (450)..(450): a, c, t, g, unknown or other
  misc_feature (450)..(450): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgttttacctcctatagtatcaactgggtncgccaggcccgctggacaacgacctgagtggatgggatgggcaaccctanactggtgtcacagtgtcttcacccatcctccgggacagaccttaccatcgaccacgactcctacataaaccacacgcctacatggagttgaggagcctgacatctgacgacacgggcctntattacgtgtcgcgagcgtcccacggtactcccgggtgcggccctacggcaggcccggtacctttcgacgtttcggtcggggg

SEQ ID NO: 207249 - DNA, 712 bp, Homo sapiens
  misc_feature: GYAE6OF01DOJKG.17.25.C03.1.454.CMB.1.raw
  modified_base (670)..(670): a, c, t, g, unknown or other
  misc_feature (670)..(670): n is a, c, g, or t
  modified_base (681)..(681): a, c, t, g, unknown or other
  misc_feature (681)..(681): n is a, c, g, or t
  modified_base (704)..(704): a, c, t, g, unknown or other
  misc_feature (704)..(704): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccgaggtgcagctggtgcgaggtcgggggctggaggtgaaggaagccgtggggcctgagtgaaggtctcctgcaaggtcttcgtggtacttctaccgttttaccctccttaataagttactaccgtaagtggggtcgccgccgacgggccgtcgtacggaaccgaaaccggaccgttaggacggttgggtagtagggggtacgttacgggggacccgtaaaaccccgtaacgacggttcgggtacgttacctaacggtaacggtttcgtttacccttaccccaacccgttaccgttccccggtacccggggtaaaccacggttaaccctttaacccgaacgttaccggaacccgtaaccgtaacccttacccctaacctaaactaaacccaacgtaccgtaactaacgtagtaggtacgtaggacgtacgctagtacactcgtacgacgaccggtcgtaccgtattacgttacgtgtcgacgacgtaccgccgagcgtcgngacgtcgacgngacgtcggtacttgtacgtcggngggaccgg

SEQ ID NO: 207250 - DNA, 811 bp, Homo sapiens
  misc_feature: GYAE6OF01BI88S.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcgagtcgtgggctggaggtagaagaggccgtggggcctcgagtggaaggtcctccgtgacgaaggtcttcgtaggtactttccgtaccgtttaccttaccttaataacgttatacgtaacgttgggtacgccgccgacggccgtacgtacggaaccaacgaccgtaggaggtaggaggtgggagtacgggaccgtaaacccgtaacgtacggttcggtacgtacgtacgtacggttacgttccttacccgacccgtacgtaccggtaccgggaactacggtaccttacgactaccggacctaacgtaacccttaccctaaccgaaaacttaaccactaaccggtaccctaagtaacgttaggtagttacgggaacggtacgtacctacggtaacgactttaccggaaaccggtaccggaacccggtaacccgggttaccgtttacgtttaacccgtttacgggtacggttaacccgggaacggttaccggtaaacccgtaccccggttaacgggtacccggttcccggggaaccggtacccggtacccggttaacccgggtacggtacccgggttacccggtttacccccgtttagggtaccccgggtttcggggtaaccccggggg

SEQ ID NO: 207251 - DNA, 677 bp, Homo sapiens
  misc_feature: GYAE6OF01C1QBA.17.25.C03.1.454.CMB.1.raw
  modified_base (508)..(508): a, c, t, g, unknown or other
  misc_feature (508)..(508): n is a, c, g, or t
  modified_base (544)..(544): a, c, t, g, unknown or other
  misc_feature (544)..(544): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtcgcccactcccaggtgcagctggtgcagtcgtggggctggaggtagaagaacgccgtgggggccttcgagtgaaggtcctccgtgacgaaggtctttacgtggtactttacctaaccggtttaccttaccgttaattaacggtacttacgtaaaccggttggggtcgaccggcccgacggcccgtacgtacggaaccaaccgtaccgtggaggtggtaaggtagggagtcgggaacctaaaccctaagtcgtgggtctacgtacgtaggttcttaccttccgacctacgtcccggtaccgggatacgtacttaccagtaccgaccaacgacctcctaacaacaaccnacgtactaagagtaggagttaggaacgctaccgtanaactactcgaacgaccgaccgtcggtaccttattactacgtgaccgacggaccgaccgtcccgaagtaccgtacggacgtaccgacccggtcgacgtaccggtccgttaccgtttacgcgttcgggaccgggg

SEQ ID NO: 207252 - DNA, 835 bp, Homo sapiens
  misc_feature: GYAE6OF01DQMOI.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctggaggtagaagaacggccgtcggggcctacgaggtaggaacggtcctccgtgaccgaacggtcttcgtaggtacttaccgttaccgtttacctccttaagttacgttactaccgaacggtcgggtcgccggaccgacgggccgtacggtacggaaaccgaaccggtaccgttagggaggtagggagttacggggtacgtacggggaacccgtaaaccctaacgtacgttggtcgtaccgtacgtaggttccgtaccttaccaacccgtaccgttcccggaccgggaactaacgtaaccttacctaacgtaccgaacctaaccgtaacctacccgtaacctaaactaaaacccgaaacccgtaacgtaacccgtaacgaacggttacgggtaacggtttacggaacgggtacgtaccgttacgaacttacgtacggttaccgaaaccggaaccggtaacccgggttccgtttaaccgtttaacgttaccggttcgggtaccggtacgtaacggtacccgtaaacccggtaccggtaaccggttacccgggacgggtaacccggtacccggtacggtacccgtaccgggtttcccggttaccggttttaccggttaccgggtttccggggtacccggggg

SEQ ID NO: 207253 - DNA, 803 bp, Homo sapiens
  misc_feature: GYAE6OF01CT25K.17.25.C03.1.454.CMB.1.raw
tcagcgtagactagcacgaccggtgctcgatttagtagtgtagatttgggtttgggggactcaaacaaccacatctgtcctctagaagaaaaccctgtgagcacagctcctcaccatggactggacctggaggatcctcttcttggtggcagcagctaacaagtcgcccactcccaggtgcagctggtgcagtcgtggggctggagggtagaagagccgtggggcctcgagtgaacggttctccgtgcgaaggcttcgtggtattcctaccgtttacctcctaatagtactactaacgtggggtcgccggccgtacgggccgtacgtacgggaaccaaccggtaccgtggtaagtgggaaggtgggaacgtcggggaccgtaaaacccgtaaacgtcgtaggtcgtacgaacgtaggttcgtccttaccgaaccccgtagttaccccgtacccggggaacctaacggttaacccttaacccgacgttacccggaaacccgtaaccccgtaaacccgttccccctaaacctaaataaaaaccccgtaccgtaaaccggtacccttaaaccgaaggtttacggggtaaccggtttagggaaccgggtactacccgtaagaccctagtactaccgggaaccgaaccggtacccggtaccgtttactaacgtttaacggtcgtacggacggtaacgtacccggttaccgaacccgggttggtaccccgggtaggtaccggtccccggtaaggtaccgtaccgggtcccgtttacgtttaccggtaccggttcgggtaacccgggggg

SEQ ID NO: 207254 - DNA, 826 bp, Homo sapiens
  misc_feature: GYAE6OF01EBIP9.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtagaagacgccgtggggcctcgagtgaagtcctcgtgacaaggtcttcgtggtactttccgtaacgtttaccgtacttaagtaacgtactactaacggttgggtcgaccgtaccgacggtcccgacgtacgggaaccaaaccggtccgtaggacggtggtaacggtgggtacgtacgggacctaaaccccgtatacggttcgtgtaccacgttaggttcttacctaccgtaaccccgtactacccgggtaccggaaccgtacgttaaccctttaaccgagttaacccgaacccgtaaccgtaacccttacccccgtaactaaacgtaaacccgtaaccgtaaccgtacctaacgtaaggttacgggttaaacggttacgggaacggtaaccgtacccgttaacggaaccttacggtaaccgtacggtaacccggtacccggtaacccgggtttaccccgttaacgttttaaccgttaacggttacggtacggtaaccggtacggtaacccgtacccggttaacccgtaccgggttacccgggtacggacccggaacccgttaccggaccggtaccggttacccggttaccgtttacccgtaccggtttcgggaaccccggggg

SEQ ID NO: 207255 - DNA, 1011 bp, Homo sapiens
  misc_feature: GYAE6OF01D85AD.17.25.C03.1.454.CMB.1.raw
  modified_base (356)..(356): a, c, t, g, unknown or other
  misc_feature (356)..(356): n is a, c, g, or t
tcagcgtagactagcacgaccggtgctcgatttagtagtgtagatttgggtttggggactcaacaaccacatctgtcctctagagaaaaccctgtgagcacagctcctcaccagtggactggacctggaggacttccttcttcgttggtggctagcagctaacaagtcgccctactcccgaggtcgacagtcgtggtgacgaggttcggtggggcttagggaaggtagaaggacgtccggtcggggcctacgtaggtaggaacggttcctccgtagcgtaacggttcttcgtaggtacctttccgttacccgtttacctacgttaagtacgttacttaccgtaacggttgggaccnccggaccgtacgggtcccgtacggtaacggaaccgtaaccgacgtggagggttaggagtggggacgttacgggaaccctaacccgtaagtcggttaggtccgtactaagtacggtttcctaccttcccgaacccggttccttacccggaccggggtaacaaccggtttaccgtaaccgacgtaacccgtaaacccgtaacccgtaaacccttaccccgtaaacccgtaaacgtaaacccctaacccgtaaccgtaacccgttaacgttaacgggtacgggtttaacggttacgggaaacgggttacccgtaacgtaccggtaaccgttacgttacccgggttaaacggaaaccccggttcccggtaaaccccggggtttcccgtttttaaaccgtttaacggtttcccggggtaacgtttacccgggggaaacccggttaaaacccgggtcccccgggtttaaaaacccccggtaacgggggtttaaccccgggttacccggggaaccccgggtaaaccccgggttaaccccgggggttaaccccgggtaacccgggttaccccggggggtttacccccgggtttttaaacccggttttttaacccgggggttaccccggggtttaccccggggggggtaaaccccccggggggg

SEQ ID NO: 207256 - DNA, 947 bp, Homo sapiens
  misc_feature: GYAE6OF01ECVUS.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatgactggacctggaggatcctcttcttggtggcagcagctacaagtcgcccactcccgaggtgcagcgtggtgcagtcgtgggctggaggtagaagacgccgtggggcctacgagtgaacggtcctccgtagacgaaggtcttcgtggtacttacgtaccgtttacctcgttaataagtactactaacggttgggtcgaccgtaccgacggtcccgtcggtacggaaaccgaaaccggtaccgtgggtaaggttaggggacggtacggggtaacgggtaccggggaaaccccgtaaaacccccgtaaacgttccggttacggggttaaccgtacgtaaacggtcggtttacggtttacccttaccccgtaaacccgttaacccggttccccggtaccggggaaactaaccgtaaccctttaaacccgagtttaaccccgaaacccgtaaccgtaaaccctttacccctaaaccgtaaaacctaaaacccgtaacgaaccgtaacccttaaacgtaacgggttacgggtaaacgggttaaggaaccgggtacgtacccgttaacggtaacctaccgttaccggtaaccggtaacccgggtaaacccgttccgggggttaaccccttttaacggttaaaccggtttaccgtagggttaccggtaaccgggtaaacccggttaccccgggtaaaccccggtaaacggtttaccccgggtttaaccggggtaaacggttaccccggaaccccggggttaacggacccggtaacccggggtttcccgggtttacccggttttaacggttcccgggtttaacccgggggaccccgggggg

SEQ ID NO: 207257 - DNA, 566 bp, Homo sapiens
  misc_feature: GYAE6OF01BQPN8.17.25.C03.1.454.CMB.1.raw
  modified_base (260)..(260): a, c, t, g, unknown or other
  misc_feature (260)..(260): n is a, c, g, or t
  modified_base (280)..(280): a, c, t, g, unknown or other
  misc_feature (280)..(280): n is a, c, g, or t
  modified_base (311)..(311): a, c, t, g, unknown or other
  misc_feature (311)..(311): n is a, c, g, or t
  modified_base (342)..(342): a, c, t, g, unknown or other
  misc_feature (342)..(342): n is a, c, g, or t
  modified_base (494)..(494): a, c, t, g, unknown or other
  misc_feature (494)..(494): n is a, c, g, or t
  modified_base (500)..(500): a, c, t, g, unknown or other
  misc_feature (500)..(500): n is a, c, g, or t
  modified_base (535)..(535): a, c, t, g, unknown or other
  misc_feature (535)..(535): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtgcccactcccaggtgcagctggtgcagtctggggctgagtgaagaagcctggggcctcagtgaaggtctctgcaaggcttctggattctacgtttaccncctatagtatcaactgggtncgccgaggccgctggacacgacctgagtggntgggatgggcaaccctaacactggtctcganaggtctcttcacccatcccgtccggggacaacggtaccttacccagttcaacccaccgtaacctcctacccaattaaacccgactaagaccctacaagtggtagttgaggagcccgtagacatctgaaccgacgacggtccgcttatacgtntgccgngacgtcccgacgtacgtccgagacggcctcggacncggccggtcctttcggacgttccggtcgggg

SEQ ID NO: 207258 - DNA, 601 bp, Homo sapiens
  misc_feature: GYAE6OF01EYQR4.17.25.C03.1.454.CMB.1.raw
  modified_base (282)..(282): a, c, t, g, unknown or other
  misc_feature (282)..(282): n is a, c, g, or t
  modified_base (337)..(337): a, c, t, g, unknown or other
  misc_feature (337)..(337): n is a, c, g, or t
  modified_base (472)..(472): a, c, t, g, unknown or other
  misc_feature (472)..(472): n is a, c, g, or t
  modified_base (486)..(486): a, c, t, g, unknown or other
  misc_feature (486)..(486): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgcaaggcttctggattcacgtttacctcctatagtatcgaactgggtncgccaggccgctggacaacgacctgaggtggatgggatggggaccaaacccctanacgtaggtcgtacacgtagtcgttactccaacccgtatcccgtaccggggacacgtaacttccgattcgaaccctaccgaactcccgtaccaataaaccgacaacgccttagaacttgggacgttaggacggacnccgtagacagtcgngaaccgacgaccgggtccgttacttattaccgtgtacgcgacgtacgtacccgacgtacgttccggtacgacgtcccgtacggccaggtcccgactttgtacgttcgtaccgggg

SEQ ID NO: 207259 - DNA, 829 bp, Homo sapiens
  misc_feature: GYAE6OF01BD2KN.17.25.C03.1.454.CMB.1.raw
tcagcgtagactagcacgaccggtgctcgatttagtagtgtagatttgggtttggggactcaacaaccacatctgtcctctagagaaaccctgtgagcacagctcctcaccatggactggacctggaggtatcctcttcttggtggcagcagctacaagtcgcccactcccaggtgcagctggtgctagtctggggcctggaggtagaagaagccgtggggcctcgagtgacggtctctagcgaagtcttagtggtacttctacgtttacctctatagtacttcaacgtgggtcaccgccacggtccgcgtacggaaccaacggtacccttggaacgttgggagttacggggtatacgggggaccctaaaaccccgttaagtaacccggtggttaccggtaccgaaacgtaggttaccgttaccgttaccaaaccccgtacgttccccggtacccggggactaacggtaacctttaacccgagtaccgtaacccaaccgtaacctcccctacaaaccgttaaacaaccacgacccttaacaaggttcgggtaacgttaggaacggtcgtaacccgaagggtacttaaccgttcgtaaccggtactaacccggaaccgggtttacccgaactttaaccgtttacgtcgggttaaccgaccgggtaacggtaaccgtttacccccccggaaaggttacccggggtttaccgggttaccggaaaccccggtttacccgggtaacccccgggtacggttaaaccccggggtcccgggttaaccccctttttaacccgggttaacccggtttccggggtttaaccccggggggg

SEQ ID NO: 207260 - DNA, 730 bp, Homo sapiens
  misc_feature: GYAE6OF01DS1C4.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctccgtgacaaggcttcgtggattctacgtttacctcctatagtatcaagtgggtgcgccgacggccgcgtaggaccaacgtaccgtggaggtggagtgggagtcggggacctaacccctaagacgtggtacgtacacgtagtgtccttaccacccctagtcccgtaccggggactacgtaaccttaaccagttaccgaacccaaccgtaacctccctaaccgtaaactaaaaccacgtaacgtaccctaaacgacggttagggtaacggtttacgggacgggtaacgtcccgttaacggaacctagtttccgaacggtaacccggaaacccggtaccggggtacccgtttacgttaactttacggtcggttcggaaccgtaacggtacccggtaccccgaacgggtaccggttacgggtacggtaccgggtaccccgtacgggaccggtacggtcccggtttaccgttttcggaacccgttttcggggacccgggggg

SEQ ID NO: 207261 - DNA, 846 bp, Homo sapiens
  misc_feature: GYAE6OF01C86KM.17.25.C03.1.454.CMB.1.raw
  modified_base (199)..(199): a, c, t, g, unknown or other
  misc_feature (199)..(199): n is a, c, g, or t
  modified_base (730)..(730): a, c, t, g, unknown or other
  misc_feature (730)..(730): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttgggtggcagcagctacaagtcgcccactcccaggtgcagctggtgctagtcgtggggntggaggtagaagacgccgtcggggcctacgagtgtaacggtcctcctggacgaacggtcttcgtaggtacttaccgtaccgttttaccctactaagttaacggtacttacctaacggttgggggtccgaccggtaccccggacggggtcccgtacggtaaccgggaaacccgtaacccgggtacccgttaggggaagggttggggtagggtcgggggtaacgggtacccggggtaaacctaaaccccggtaaacgttccgggttgggttaaccgtacgacggttacgtttcgttcccgttacccaaccccgttaccgtcccggtaaccgggactaaaccgtacccgttactacgtaaccgacccgtaaacccgtaccctaccccgttaaacctaaacgaaaccctacccgtaccgtaacctaaccgtaggttacggtagttaacgggacgacgttacccgtagaactacccgtacggtaaccgaaccgggtaaccgttacccggggtcctttaacgttaacgtttacccgngggtaccggtaccgtaacggtacccgtaccgaaaccggttccgtacgggttacggccgtacccggtcggaccggtccgtacggtttcccgtttacggcccggtttgggccccgggg

SEQ ID NO: 207262 - DNA, 755 bp, Homo sapiens
  misc_feature: GYAE6OF01A9WOD.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcctggggcctcagtgaaggtctcctgcaaggcttctggtattctacgtttacctcctatagtatcaacgtgggtgccgccgaggccgcgtggaccaaccgaccgtggaggtggagtgggagtcgggaccgtaaacccctaagacgtcgggttgtcgacgtaggttcgtccttaccgacccctacgtcccgtacccggggactaacgtacctttaacccgactaccggaacccaaccgtaacccttccccgttaaccaaacgttaaaacccaccgtaacgtacccttaacgaacgttacgggtaagtttacggacgggtaacgcccgtttaaggaacccgtagtccgtacggaaccggaaccggtaccccgggtaccgtttaccgtttaacttttacggtcggttaccgacgggtacggtaacccgttacccccgtaaacggtccggttaccccggggtggaaccccggttaccccggtaccggggccgtaacgggtccccggttttacccgtttacggtaaccggtttcccggggtacccgggggg

SEQ ID NO: 207263 - DNA, 765 bp, Homo sapiens
  misc_feature: GYAE6OF01DMJ8R.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccaatcccaggtgcagctggtgcagtctggggctggaggtgaagagcctggggcctcagtgaaggtctcctgcaaggctctggattcacgtttacctctatagtatctaacgtgggtgccgccgagggcccgtcgaggaccgaaacgaccctggagttgggagtaggggagttcggggaccgaaaaccctaaacgaaccgtgggttacgttacgaaccgtaaggtcggttctttacccaacccctaacgtccccgttacccggggaactaacggtaacctttaaccgaacgttacggaacccctaaccggtaacctacccttaccaaattaaaaccacaaccggtacccttaacgaagttaggggaagtttacgggaacgggtaacgtcccgttaggaacctagttaccgttaggaacccgtaccgtaaccgggttaccgtttaacgttaacgtttacttcgggtacgtaaccggacggtacccggtacccccgtaaagggtaaccgtttccgggtaacggtaccgtacccgggttaaaccgggccgtaacgggtaccccggttacgttttcccggtaacggtttcccgggtacccggggggg

SEQ ID NO: 207264 - DNA, 746 bp, Homo sapiens
  misc_feature: GYAE6OF01CQXKN.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtcgcccactcccaggtgcagctggtgccagtcgtggggctggagggtgaacgaaggccgtggggcctcgagtgaacgtctccgtgacgaaggtctcgtggtacttacgtaccgtttacctccttaatagtactaccgaacgtgggtcaccgcgacggccgtcgtcggaacacgacgtgaggtggagtgggagtcgggaccaaaccctacgcgtaggtctacgacgtagtcgttacctccacccgtacgtcccggaccgggactacgtaccttaccgagtacccgaaccaaccgtaacctaccccgtaacctaaactaaacccgaaccacgtacccgttaacaggtttacgggtaagggttcggaaacggaccgttacccgtaagtaaccctacgttaacggacgaaaccggtacccggtaacccggggttcctttaacgttaacgtttccggtaggtccgtaacgggtaccgtacccgtacccggtacgttaccggttaccggggcgtaacccggtccccggtaacgggcgtacccggggttaccccggttcgttttaacccgggtcggttcccggggtaccgggg

SEQ ID NO: 207265 - DNA, 673 bp, Homo sapiens
  misc_feature: GYAE6OF01A0RHT.17.25.C03.1.454.CMB.1.raw
  modified_base (654)..(654): a, c, t, g, unknown or other
  misc_feature (654)..(654): n is a, c, g, or t
tcagcgtagactagcacgaccggtgctcgatttagtagtgtagatttgggtttggggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacagtcacggacttaaaacctatttaattgtatcagcaagaaacctggaaaacgccccagaccctcctgactctctggtcgacctatccactctcgcgaagtcggcctccatcggaggttcaggtggcagtggactcgtaggactagtactttcaatctacacctactccaccctacttccgtacgacctaaccgtggaaggtagtttgtacgtactaacgtttcctaacctttacgtacgtaaccgaaacgtaacgggttaaccgtttacccgtacccggttttaccccccgttaccgttaacccgtttaccggtttttacccggggacccggtaaaccggggggtaacccttaaaagggttacggtaaacggtaacttaaaccggaaaaccggttaccgttagggtaccggcgtacgaccctaaacccgtnttaccgttcgtttaccccg

SEQ ID NO: 207266 - DNA, 839 bp, Homo sapiens
  misc_feature: GYAE6OF01BIMMB.17.25.C03.1.454.CMB.1.raw
tcagcgtagactagcacgaccggtgctcgatttagtagtgtagatttgggtttggggactcaacaaccacatctgtcctctagagaaaaccctgtgagcacagctccctcaccagtggactggacctggaggactcctcttcttggtggcagcagctacgaagtcgcccactccgaggtgcagcgtggtgcagtcgtgggctggaggtagaagacgccgtggggcctcgagtgagtctcgtgacgaaggtcttcgtaggtacttctaccgttttacctcctagttacgtatcgtaacgttgggtcgaccgccggacggtcccggtacggtacggaaccgtaacgtacccggttaggaggtaggtacgtaggggtacggtacgggacccggtaaaacccgtaacgtacggtacggtcgtaccgtacgtacgttcggttaccttacccgacccgtcgtacccgtaccgggaaccttacgtaccgttaccgaaccgtacgtaacccgaaccctaaccgttacccctaacctaaaccgtaaaccctaaccgtaaccgtaacccgttaaccgtacggttacgttaaggggtttacgaaccgggtaccgtcccggttaaacaccgtaccgtttaaccggaaccggaccgggttaacccgaacccgggttacccgtttacttaacgttaccggtggtacccggtacgggtaaccgtcccgtaccccggtaagggttaccccggtaacggttcggacccgggtacccccggttacgggtaccccggtacggggttttcccgtttaacccgggttaccgttaccccgggtttcgggggtaacccgggg

SEQ ID NO: 207267 - DNA, 763 bp, Homo sapiens
  misc_feature: GYAE6OF01EEEZ2.17.25.C03.1.454.CMB.1.raw
tcagcgtagactagcacgaccggtgctcgatttagtagtgtagatttggggtttgggggggagtcagtctcagtcaggacacagcatggacatgacgggtccccgctcagctccgtggggctcctgctactctggctccgagctcgccagatgtacgactatccgagactcggaacctacgtcctcctacttccctcccttgtctcgtccttcggttgggtcggggtacaggtacgtaccaccgtactcgtaccgttcggaccggtaacgaccggtaccgtaaccggttaacgtttaaaaacctttagttttaaagttcggtaactacgaacgacgaaaccgtaaaccgtaacggaaaccgcccctaaggtaccccttcgtacgtactcgttacggtcggttacacctacgtccctacgtaccggtcggacggtaccggttacgcccgtacccgtagtacgggttacggttacgacgggttacggagtacgggtacggtaccgttggtaacgggtaataacgtttactttaaacgcttaccctacgtaaacctcgtacccaacttaccgtcgacgtaacccgtacgtaggtacgtacgtggtactacgtaacctcgtactacgtactaacgtagtactaccttacgttccccgtacttcggtaccttaccggggtacgaacgggtaacggttaactaacggttagaaccgtaacgtaaccaaggtcgttagccgattaccgactagttcttccgttgtaaccc

SEQ ID NO: 207268 - DNA, 759 bp, Homo sapiens
  misc_feature: GYAE6OF01DQ6S8.17.25.C03.1.454.CMB.1.raw
  modified_base (177)..(177): a, c, t, g, unknown or other
  misc_feature (177)..(177): n is a, c, g, or t
  modified_base (560)..(560): a, c, t, g, unknown or other
  misc_feature (560)..(560): n is a, c, g, or t
  modified_base (668)..(668): a, c, t, g, unknown or other
  misc_feature (668)..(668): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccgaggtncagctggtgcgtagtcgtgggactggaggtacgaagacgccggtgggcctgagtgaacggtcctccgtagacgtaacggtctttcgtggtactttaccttaccggttttaccctccttaattacgttactacgtaacggttggggccaccggcccgtacggcccgtacgtacgggaaaccaaccggtaccgttaggtaacgggtgggtaagttacgggggacgtaccggggaaccccgtaaacccctaacgtaccggttgggtaccgtacgacgtaggtttccgttacccttaccgacccgtacgtttccccggaccgggaactacggttaaccttaccgaatacccgaaccaaccgttaaccctccctaaccaagtaaaccnccgaacgtcccttaaagcgtaggtagttaggcggacgtccttacgacttcttacgtaacgcctaaccggccgttaccgtacttaacgttacgtggtaccgtaaccggngtacccgaacccgtggaccggttcccgggagacccgtacccgttcggaaccgtcggttcccggttacgtttacgtccgttgggtacccggg

SEQ ID NO: 207269 - DNA, 694 bp, Homo sapiens
  misc_feature: GYAE6OF01AS6GS.17.25.C03.1.454.CMB.1.raw
  modified_base (247)..(247): a, c, t, g, unknown or other
  misc_feature (247)..(247): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcagtgaaggtctcctgcaaggcttcgnggtacttctacgtttacctcctatagtatctaacgtggtgccgccgaggcccgcgtaggaaccaacggacctggacggtggagtgggatcgggaccaacccgtaacacgtggtcgtacacgtagttcgtccttaccgaccctacgtcccgtaccgggacacggtactaccagtaccgaccgactaacccgtccctaaccaactaaaccacgacgtaccctaacgtagtacgggtagttacggaaggtaccgtccgttaggaactacgttccgtaaggaacccggtaccgaaccggttacccgttacgtttaacgtttacggtaggtaccggtaaccgtacggtaccgtaccccggacgtaccgggtaccgggtacggtaccggcccgtaaccgggccgtaccgggtcccggttacccggttttcgtaccggttccgggtaccggggg

SEQ ID NO: 207270 - DNA, 662 bp, Homo sapiens
  misc_feature: GYAE6OF01BPH68.17.25.C03.1.454.CMB.1.raw
  modified_base (365)..(365): a, c, t, g, unknown or other
  misc_feature (365)..(365): n is a, c, g, or t
tcagcgtagactagcacgaccggtgctcgatttagtagtgtagatttgggtttggggggagtcagtctcagtcaggacacagcatggacatgagggtccccgctcagctcctggggcctcctgctactctggctccgagctgccagatgtgacatccagatgacccagtctccatccctcctgtctgcctcgtggtggggtcagacgtcaccatcacttgccggacaagtcacggtacttaaaacctatttaaatgtatcagacaacgaaacctggaaaacgccccaagaccctctagactcgtcgtggtcgcactccacgtctgacgaagtcgaccgtccagtcgagttcagtcgacaggtagngtcgaggacagtactttacaactcgtacacctactccacctactcgtacgtacctaacgtggtaacgtagttacgtacgtactaacgttaccttaacgtacgtacgtaacctaaacggtacgttaacgttacccgtaaccgtttcccccgtagttacccgtttaccggtttaccggaacccggtaacgggtaaaccgttaaaggttacgtaaccgtaaacgttaacccgaaaacgggttaccttagggaccggttaccgtaccggtacctaacccgttacgttccgttcgttacccg

SEQ ID NO: 207271 - DNA, 744 bp, Homo sapiens
  misc_feature: GYAE6OF01DK6DJ.17.25.C03.1.454.CMB.1.raw
  modified_base (467)..(467): a, c, t, g, unknown or other
  misc_feature (467)..(467): n is a, c, g, or t
  modified_base (702)..(702): a, c, t, g, unknown or other
  misc_feature (702)..(702): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctaacgaagtcgcccactcccgaggtgcagcgtggtcgcacggtcgtggggctggagggtagaagacgccggtcggggctacgagtaggtacgtcctccgtggacgtaacggtccttcgtacggtactttaccgtaacccgttttaacctccgttaattaacgtaagaccgttaacggtgggtcgaccgaccgtacgggcccgttgaacgaaccgaaccggtcgtaggagggtacggaacggtggggtaacgtaccgggacctaaaaccctagtacggtggttccgactacgaggttcctacgtaccacccgtntacccggtacggaactcgtaaccttcgaagtccgaacctaacgtacccttcaacgaactaaaccgatcgtaacctcgtaagtacgggtacgtagggtacgaccgttctaacggtagtacctaaccgggtacaaccgggtcccgtaaccgggtactttaacggttactaacggttcgggacgtacgaccggtaccaaccggtcgtaacggtccggttagcccgggttacaaccggnggtacccggtaccgtttcgtaaggccggtttacgggccgggg

SEQ ID NO: 207272 - DNA, 775 bp, Homo sapiens
  misc_feature: GYAE6OF01CSRF3.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttgggtggcagcagctacaagtcgcccactccaggtgcagcgtggtgcgtaggtcgtggggctggaggtagaagaacgccgtggggcctcgaggtaggaacggtcctccgtgacgtaggtcttcgtggtattccgtaccgtttacctctatacgtatctaacgttgggtcgcgtccgacggccgtcggtacggaaccgaccgtaccgtaggtacggtcgggtaaggtggggtaacggtacggggaacccgtaaaaccccgtaacggaccggttgggttacctacgtaacggtacggtttacggttaccctttacccaaccccgttaccgtcccggttaacccggggaactaacgtaacccgttacccgaacgtaacccgaacccgtaacccgtaacctaccccttaacctaaactaaacccgactaccgtacctaacgagttacgggtaggtcgggaacggctaccgtaagaccttacgtccgtacggaaccggtacccggtacccggtccgttacttacgttacgtcggtacggacgtacggtaccgcccgtaacggtaccggtcggtacgacccggtaccgtacgggaccgtacgggttccgttccgtttacgggtcgttccgggtaaccgggg

SEQ ID NO: 207273 - DNA, 676 bp, Homo sapiens
  misc_feature: GYAE6OF01EG0KE.17.25.C03.1.454.CMB.1.raw
  modified_base (239)..(239): a, c, t, g, unknown or other
  misc_feature (239)..(239): n is a, c, g, or t
  modified_base (259)..(259): a, c, t, g, unknown or other
  misc_feature (259)..(259): n is a, c, g, or t
  modified_base (512)..(512): a, c, t, g, unknown or other
  misc_feature (512)..(512): n is a, c, g, or t
tcagcgtagactagcacgaccggtgctcgatttagtagtgtagatttgggtttgggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcagtgaggtctctgcaaggnttctggattcacgtttaccnctatagtatcaacgtgggtcgccgccgacggtcccgcgtcggaaccaaacggtaccctggaggtgggagtaggggagtcggggtacccgaaaacccctgaaccgttgggtcgtacgacgtacgttcggttcctaccaccctacgtcccgtacccgggacacgtaccttaacctatacggaacccaacgtaacccttacctacccaaataaaccacaacgtaccctctaacgttgggacggtttagacgggacncccgttagacgtacgtacgtacgaaccgtacgacccggtaccggttaattaacgtttaccgtcggtacggacgacggtaccgtacccgaccgggtacgtcgggtacggaccgtcccgtaagggcccgacgtcccgggttacctttcggacgttacggtccgggg

SEQ ID NO: 207274 - DNA, 614 bp, Homo sapiens
  misc_feature: GYAE6OF01DTDOA.17.25.C03.1.454.CMB.1.raw
  modified_base (308)..(308): a, c, t, g, unknown or other
  misc_feature (308)..(308): n is a, c, g, or t
  modified_base (395)..(395): a, c, t, g, unknown or other
  misc_feature (395)..(395): n is a, c, g, or t
  modified_base (431)..(431): a, c, t, g, unknown or other
  misc_feature (431)..(431): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatccctccctgtctgcctcgtggtgggggtcagagtcaccatcacttgccgacaagtcacggacgttaaaaccttattaaattggtatcagtacaagaaaacctggaaaacgccccagaacctcctgactctcgtggtncctactccactctggacgtaaggtcgggccttaccccgattcgtaggtttcaggttggacaggtggattcgtagggacagtactttnaacttcacacactccaacctactctcgtacaaccgngtaggtattgtgtactaactctacttactatacaacgtacgtaacgttactaccgttccctcgtaccgttacgtttcggaccggtaacgggtaaaccctaaaggtttagaaacggtaaccgtaaacgtaaacgttaacggtcgtacgggacgttaccgaccaaccttacttcgtcggtttacc

SEQ ID NO: 207275 - DNA, 883 bp, Homo sapiens
  misc_feature: GYAE6OF01DGHJ3.17.25.C03.1.454.CMB.1.raw
tcagcgtagactagcacgaccggtgctcgatttagtagtgtagatttgggtttggggactcaaacaaccacatctgtcctctagagaaaaccctgtgagcacagctcctcaccatggactggacctggaggatccttcttcttggtggcagcagctaacaagtcgcccacctcccaggtgcagctggtgcagtcgtggggctggaggtagaaagacgccgtcggggccctcgaggtaggaacgtcctccgtgacgaaggtcttcgtgtacttactaccgtttacctcctaatagttactacaacgtgggtcgacgccgacggccgtacgtacggaaccgaaccgtacgtggacggtggtacggtgggacggttcgggaaccccgtaaacccgtaaactacggttcggtacgttaccgaacgttacggttacgttaccccgtttcccaaaccccgtaccgttaccccggtaccccgggggaaactaaacccgggttaaccttttaaaaccccgacgttaacccgaacccggttaaacccttaacccccttaccccgttaaacctaaaaccgtaaaacccgacctaaccggttaacccttaaaaccgtacggttttaaggggtaacgtttaaccggggtaaacggtaaccggttacccgtttaaccgaagtttacccgttacccggtaacggaacccggtaaccccgtaacccgggggtaccttttaaccgtttaacgtttaaccggtcggttaaccggacgggttaaacgtaccccggttacccgaaccggttacggtacccgggttaggtaaccccgcggttaccggaccggtacgggttacccggttacccgttttaggtacccggtttccggggaccgggg

SEQ ID NO: 207276 - DNA, 597 bp, Homo sapiens
  misc_feature: GYAE6OF01EKEJ5.17.25.C03.1.454.CMB.1.raw
  modified_base (270)..(270): a, c, t, g, unknown or other
  misc_feature (270)..(270): n is a, c, g, or t
  modified_base (289)..(289): a, c, t, g, unknown or other
  misc_feature (289)..(289): n is a, c, g, or t
  modified_base (585)..(585): a, c, t, g, unknown or other
  misc_feature (585)..(585): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatcgacccagtctccatcctccctgtctcgccgttcgtggtggggtcagacgtcaccatccacttcgaccggacaagtcaacggtacgtttaaaaacctatttaaagtgtatcanacaagaaccgtaggaaacncccagaccctctgactccgtcgtggtcgcactccacgtctgacgagtcggcctaccagtcgagtcagtgacagtgagtcgtaggactagtactttcgaacttcctacgaacctacgtaccacccgtaacctcgtacacgtaacctgtaaggtattagcgtaactaactccttaacgtactacgtaccaaacgtacgtaacgttaaccctaccgttcccctacgtacgttaccgttacggccgtaagggtaactaagtacgagtactaacgaaacgtacgtcgtacgctacgcaacncttgtcgtaccg

SEQ ID NO: 207277 - DNA, 786 bp, Homo sapiens
  misc_feature: GYAE6OF01EYINQ.17.25.C03.1.454.CMB.1.raw
  modified_base (303)..(303): a, c, t, g, unknown or other
  misc_feature (303)..(303): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccagtgcagctggtgcagtcgtggggctggaggtgaagtaagccgtcgggggcctcgagttgaaggtcctccgttgacgaaggcttcgtaggattcctacgttttacctccgtaattaggtactcaacgtgggtnaccgccgagggcccgtacgtacggggaacctaacggtacccgttaggaaggttagggaacgttaggggtacgttcgggggaaccctaaaaccccggtaaaactaccggttgggttacgtaccgaacgtagttcggttacccttaccaacccctaacgttccccgtaccggggtaaaccgtaacgtaaccctttaaccgacgttaccgggaacccctaaaccggtaacccttacccctaaccctaaaacgtaaaaccctaaccgaaccgtaaccctaaccgtaaggttacgggtaacggtttagggaacgggacgtcccgtaagaacctacgttacgacggtaaccgaacgtacccgggtccgttacttagtaccgttagggtcaccggtaaggtaccgacccgtaacggtcgtaccggttacgaccgtaccgtacggcccgtaacggtccggtaccggttttcgaccgttccgggtaccgggg

SEQ ID NO: 207278 - DNA, 661 bp, Homo sapiens
  misc_feature: GYAE6OF01DF85Z.17.25.C03.1.454.CMB.1.raw
  modified_base (177)..(177): a, c, t, g, unknown or other
  misc_feature (177)..(177): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtcgcccactcccaggtncagctggtgcagtcgtggggctggaggtagaagacgccgtggggcctcgaggtgaacggttcctccgtgaccgaacgggcctaggtaggtataagttactcttacaaaactaaaattagttaggttataggtaaggttcgggtcgacgaccgacgggacccccggagaagggtctggaggtaggggtgggtcggtcaggtcgtcggttaggacggtaagcaacgtagtacgtagaccgaacgaaagtacgagggaagggcaagggtagtaccgaacggtactaccccgacggaacccaaccccgtaacgaacactagtacctacgatacgactaacgtcgacgacgaccgtggacgacgtcgacgaacgaccgtacggtcgttactacgttatgacgacgtaaggttacttcgttttacgcgttacgtaacgttacgttaacgttaagttcgtaaggtcgttattcgttaaagcgggttaacgg

SEQ ID NO: 207279 - DNA, 863 bp, Homo sapiens
  misc_feature: GYAE6OF01DANLH.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcgagcgtggtgcagtcgtgggctgagggtgaaggaacgccgtggggcctcgaggtggaacggtccgtcctgcgaaggtcttcgtggtacttccgtaccgtttacctcctagttacgtactactaacgtgggtcgccgccgacggcccgtcgtacggaacctaaccggtacctaggtagggtacggtaggtcggggtacgtaccggggaccgtaaacccctaacggtacgttcgggtacgtacgtaccgtagttacgttccttaccgaccccgttacgttcccggtacccgggtaactaaccggtaaccttacccgtaacgtacgaacccgtaaacggtacccccttacctaaccgtaaacctaaaacccgacccgtaaccggtaacccttaacgtaacgggtacgggtttaaacggttcgggaaaccgggtaccgtaccccggtttaagaacccgttaacgttacccgggtaaccggtaacccggtaacccggtaccccgggttaccgttaccgttttaacggttacccggtagggtacccgacgggtaacccgtacccggtaccccggaaggttaaacccggtcccgggtaacgggtacccggtacccccggttaacggacccgggtacgggtttaccccggttaccgttttcccgggacccggtttcccggggtaacccgggggg

SEQ ID NO: 207280 - DNA, 853 bp, Homo sapiens
  misc_feature: GYAE6OF01D6PX2.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctacctgcaaggcttcgtggattctacgtttacctcttatacgtatccaacgtgggtacgcgtccacggccgcgtgggaaccaaccggaccgttgggaacgtggggaagttggggacgttcggggaccgaaaccccgttaaacgacgttgggtcgtaccgaacgtaggtttcgtaccttacccaaccccgtacgttccccggtacccgggggtacctaaggtacccctttaacccgattaaccgggaacccctaaccggtaaaccccttcccctaacccctaaacttaaaaccccgtaaccgtaaccgtacccttaaacgaacggttacggggttaacgtttacgggaaacgggtaccgtaccccgttagggaacccttaacgttacccgtacgggtaacccggtaaacccgtacccggggtaccccgttttaccgttaacgttttaacccgtcggttaaccggacggttaaaccgggtcccgttaaacccccggtaaccggtaacccggtttacccgggggtacggtaaaccccggtaccccggttaaccggggaccccgtaaacggggttcccccggtttaccggtttttaccgggttcccgtttaccggggttacccgggggg

SEQ ID NO: 207281 - DNA, 538 bp, Homo sapiens
  misc_feature: GYAE6OF01B88W3.17.25.C03.1.454.CMB.1.raw
  modified_base (414)..(414): a, c, t, g, unknown or other
  misc_feature (414)..(414): n is a, c, g, or t
  modified_base (472)..(472): a, c, t, g, unknown or other
  misc_feature (472)..(472): n is a, c, g, or t
  modified_base (502)..(502): a, c, t, g, unknown or other
  misc_feature (502)..(502): n is a, c, g, or t
  modified_base (527)..(527): a, c, t, g, unknown or other
  misc_feature (527)..(527): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgagaagcctggggcctcagtgaaggtctcctgcaaggcttctgggatttcacgtttacctcctatatatcaatgggtgcgccaggccgctggacaacgacctgagtggatggggatgggcgaaccctaacactggtgtcacagtgtcttcacccatcctccggggacagacttaccatcgacccacgaacctcctaccataaacacagcctanactggacgttgaggagcctagacgactcgtgaccgaccgacggtccgtctacgttacngttcgcgagacgtcccagtacgtcggtcgngccctaggcctaggccgtctttcgntttcgacgggg

SEQ ID NO: 207282 - DNA, 680 bp, Homo sapiens
  misc_feature: GYAE6OF01CQRRE.17.25.C03.1.454.CMB.1.raw
  modified_base (640)..(640): a, c, t, g, unknown or other
  misc_feature (640)..(640): n is a, c, g, or t
  modified_base (652)..(652): a, c, t, g, unknown or other
  misc_feature (652)..(652): n is a, c, g, or t
  modified_base (668)..(668): a, c, t, g, unknown or other
  misc_feature (668)..(668): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttgggtggcagcagctacaagtgcccactcccaggtgcagctggtgcgagtcgtggggctggtaggtggaaaggaacgccgtcgggggccctcgtagttggtaacggttcctccgtggacgaacgggtcctttcgtgggtactttaccgtaacccgtttttacctacccgttaagttaaggttacttaccgtaacgttggggtcgccgccgacggcccgcgtacggaaccaacggtacctggaggtcggaggtggggacgtcgggaccgtaaacccgtaacgtacgtggtcgtcaacgtgttcttacctccaccctcgtcccgtaccggactaacgtacctaccacgtaccgaccaaccgtacctaccctaccgaaaactaacgaccacgtacctaagacgtgggtaacgtggatcgtaccctgactacgtcgtacgaccgtaccgcgttacccttacgtagttccgtgacggtcgacgttaccgaccacgtcggtcgggnacccgcgtacgngtcggcgtctttacgngtcgggtacggg

SEQ ID NO: 207283 - DNA, 821 bp, Homo sapiens
  misc_feature: GYAE6OF01DHI7H.17.25.C03.1.454.CMB.1.raw
  modified_base (326)..(326): a, c, t, g, unknown or other
  misc_feature (326)..(326): n is a, c, g, or t
tcagcgtagactagcacgaccggtgctcgatttagtagtgtagatttgggtttggggactcaacaaccacatctgtcctctagagaaaaccctgtgagcacagctcctcaccagtggactggacctggaggatcctcttcgttggtggcagcagctacaagtcgcccactcccaggtgcagcgtggtgcctagtcgtggggctggaggtagaagacgccgtcgggggccctgaggtggaacggtctccgtgacgtaaggtccttcgtggtacttaccgttaccgtttaccctcctaattacgttactaccgaacggttggggtacncgaccgacggtcccgcgtacggaacaacgtaccgtggagtggagtggggacgtcgggaaccgtaaaccctaacgtacgtcggtacgtacaacgtacgttcgttccttacccacccgtacgttccccggaccgggactaaccggtacctttaacgacgttaccgacctaaccgtaaccctcccgtaacctaactaaaccgacgtaaccgtacctaaacgccggtttaggtaacggtttacggaccgggtacgtaccccgtttaggaaccgttaccgtttacggaaaccggtaacccggtaccccgggtaccgggttaccccggtttacctttaacgtttaccggtacgggttaccggtaaaccgggtacccggtacccgttacccggaccgggtaccggttaccgggttacggaaccggttaccccggtaacgggtacccggaccggtttccccgggttactttaccgggtccggtttcccgggggaaccgggggg

SEQ ID NO: 207284 - DNA, 857 bp, Homo sapiens
  misc_feature: GYAE6OF01DGW2B.17.25.C03.1.454.CMB.1.raw
  modified_base (297)..(297): a, c, t, g, unknown or other
  misc_feature (297)..(297): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtcgcccactcccaggtgcagctggtgcagtcgtggggctggaggtagaagagccgtgggcctcgagtgaacggtcctccgtgacgtaaggtcttcgtggacttctacgtttacctctaatagtatcgaacgtgggtncgccgaggccgagtcggaacaacgctgagtggagtgggatcggggacctaaaccccgtaacgacgttgggacttacaacgtacggttcgtacctttacccgaacccgtacgtccccggtacccgggactaacggtaaccctttaaccattaccggaacccgtaaccgtaacccttaccctaaccctaaactaaaaccctaaccggtacgaaccccttaacgtaagttacggggtaacggtttacggaacgggtaccgtcccgttaacggaaccgttacgttacggtaaccggtaaccggaaacccggttaacccgggtcccggttttaacctttaaccggttttaaccgttcggggtaacggttaccggtaaaaccggggttacccccgtttaacccggaaacccgggttacccgggttaaccccggggttgggtaaacccccgggttaaaccccgggttaaccccgggggaacccgtaaacccgggggttccccggggttttaccccggtttttaaacccggtccccgggtttttcccggggggtaaccccgggggggg

SEQ ID NO: 207285 - DNA, 661 bp, Homo sapiens
  misc_feature: GYAE6OF01C3DZS.17.25.C03.1.454.CMB.1.raw
  modified_base (624)..(624): a, c, t, g, unknown or other
  misc_feature (624)..(624): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagaagccgtggggcctcgagtgaaggtctcgtgcaaggcttcgtggatttcacgtttacctcctaatagtatacgaacgtgggtcgcgccacggccgcgtacggaaaaccgccgtggaggtggagtgggagtgggacccgaaaccctaacgacgttgggtcgtcgacgtaggttcgtacccttaccacccctattcccgacccgggaacaccggttaaccttaacccaagtccgaacccgtaccgtaacccgttaccctaccctaaaactaaaccaaccgacgtaccctaacgtaacgttaggagtttcggaagggtacgccgtagacctaacttcgacgtaacccgacgacccgggtcttagttacttcgtgtcgcgaacgtccgacccgagtaccgtcggcggaccgtaccgaccggngacggtccggttacttcggacttcgggcgggtaccgg

SEQ ID NO: 207286 - DNA, 743 bp, Homo sapiens
  misc_feature: GYAE6OF01CNUY0.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcgtggattctacgtttactccgtaatagtaatcaaacgtgggtagcgaccaggcccgtcgtacggaacaaccgtaccgtgaaggtggagtaggggagttcggggaaccgtaaacccctaaacgccgtagggtgtaccaacgagtacgtcctttaccaaccctacgtcccgtaccgggaacacgtaccttaccagtacgaccaaccgaacctacctacctaactaaaaccaacgaacgtaccctaacaacgtaggaacgtttacggaacggacgtaccgttacggaacctaacgttacgtaaccggtaaccgaacccgtaacccggggtacccgtttaccgttaaacgttttaccgtacggttacggacgggtaacggtaaccgggttacccccgtaacggtaaccggttacccgggttacgggaaccgtaccccggttaacccgggacggtaaccggtccgggttacccttttacggtaccgtttacgggtacccgggggg

SEQ ID NO: 207287 - DNA, 750 bp, Homo sapiens
  misc_feature: GYAE6OF01CJO0A.17.25.C03.1.454.CMB.1.raw
  modified_base (232)..(232): a, c, t, g, unknown or other
  misc_feature (232)..(232): n is a, c, g, or t
  modified_base (246)..(246): a, c, t, g, unknown or other
  misc_feature (246)..(246): n is a, c, g, or t
  modified_base (383)..(383): a, c, t, g, unknown or other
  misc_feature (383)..(383): n is a, c, g, or t
tcagcgtagactagcacgaccggtgctcgatttagtagtgtagatttgggtttggggactcaacaaccacatctgtcctctagagaaaaccctgtgagcacagctcctcaccatggactggactggaggatcctcttcgttggtggcagcagctacaagtcgccccactcccaggtgacagcgtggtgctagtcgtggggctggagggtagaagaacgtccgtggggcctanaggtggaacgttcnccgtgacgacgtcttcgtagaacttcgtaaccgtttaccactatacgtaataccgaacgtgggtacgcgccgtacggcctcgaggaacctacggactaggagtggacgtagggagtaccgggaccctaaacctaacncggttgcgtacacgtaggttctacgttaccaacccgtacttacccggaccgggtaactaacgttaacttaccgtagaaccggacccgaaccttaacctaccctaaccgtaaacttaaacccacgtaaccgtacctaagtacgtagggtacgttagggacggaccgttacgtaacgaccttagtaccgtaacggaccggtaaccggtaacccggtaccgttaccttaaacgttccggtacgtacgggtactaaacgggtccgtaaccccgtaacgggtacggttacccgggtacgaacgggtacccgtaccgggacgtcccgggaacccggtttaccggtttacgtacccggttcggtaacccggggg

SEQ ID NO: 207288 - DNA, 858 bp, Homo sapiens
  misc_feature: GYAE6OF01DVY51.17.25.C03.1.454.CMB.1.raw
  modified_base (289)..(289): a, c, t, g, unknown or other
  misc_feature (289)..(289): n is a, c, g, or t
  modified_base (300)..(300): a, c, t, g, unknown or other
  misc_feature (300)..(300): n is a, c, g, or t
tcagcgtagactagcacgaccggtgctcgatttagtagtgtagatttgggtttgggactcaacaaccacatctgtcctctagagaaaaccctgtgagcacagctcctcaccatggactggacctggaggatcctcttctggtggcagcagctacaagtcgcccactcccaggtgcagctggtgcagtcgtgggctggaggtgaagacggccgtggggcctcgagtgagtctctgacgagcttcgtgtacttctacgtttacctccgtatagtactcgtaacgttgggcncgccgaggccncgtcggaaccaaccggtaccgttggacggttagggacgtaggggacgttacgggaaccctaaaccccgtaacgaacggttggtacgtacgtaacgacggtttcgtaccttaccgaaccccgtataccccggttaccgggaactaccgttaactaccgtaacgtaccgaaccgtaccgtaaccctacccctaaccttaaaataaacccacgtaacccggtacccttaacgtaacgggttacggtaacggtttacgggaacggtaaccgtcccgtacgtaacctaaggtttcccgaacgggaaacccggtaccccggtaaccccggggtttaccttttaacccggtttaaacttacccgggtttacggttaccggggaacccgttaaacccgggtacccgtaaacccccgtaacggggttacccgggtttacccccggggacggttaaacccggggaccccccgggttaacccggaccccgggttaaacgggtttccccccggggtttaccttttaaccgggggtaacccgggttttcccccggggaaacccgggggggg

SEQ ID NO: 207289 - DNA, 663 bp, Homo sapiens
  misc_feature: GYAE6OF01CXSUF.17.25.C03.1.454.CMB.1.raw
  modified_base (190)..(190): a, c, t, g, unknown or other
  misc_feature (190)..(190): n is a, c, g, or t
  modified_base (217)..(217): a, c, t, g, unknown or other
  misc_feature (217)..(217): n is a, c, g, or t
  modified_base (289)..(289): a, c, t, g, unknown or other
  misc_feature (289)..(289): n is a, c, g, or t
  modified_base (330)..(330): a, c, t, g, unknown or other
  misc_feature (330)..(330): n is a, c, g, or t
  modified_base (426)..(426): a, c, t, g, unknown or other
  misc_feature (426)..(426): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcngggctgaggtgaagagcctggggcctnagtgaagtctctgcaggcttctggattcacgtttacctcctatagtactcaacgtggtgcgccgaggcccgntcggacaacgacctgagtggagtgggatgggacaaccctanacgtggtatcacgagttcgtcttccaccctcgtcccgtaccggactacgtaccttaccagtacgacctaaccggaacttccctaccaaataaaccncaaccgtacctaacgagttcgggagtttacgggacggtacgtccccgttaggaacctacttacggtaccgaaccggtaaccggtaccgggtccgtttacttaacgtttacccgtggttacggaccggacgtacccggtaccccaacggttccgtcccggggtaatcccggacccggtaacgggcccgaacgggttccccgttaccgtttccggtccgtttccgggtacccggggggg

SEQ ID NO: 207290 - DNA, 701 bp, Homo sapiens
  misc_feature: GYAE6OF01D9CU0.17.25.C03.1.454.CMB.1.raw
  modified_base (531)..(531): a, c, t, g, unknown or other
  misc_feature (531)..(531): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtcctccgtgcaaggcttcgtggattctacgtttacctcctaatagtatcaactggggtgccgccacggcccgcgtcgggaaccaaacggacccgttggaacggttgggaagtcgggggagttacgggggaccgtaaaacccctaacgacgtgggttcgtaccgaacgtacgtgttacctttccaacccctacgtcccgtacccggggacacggtaaccttaccgagtaccgaaccctaaccgtaaccttcccctacctaaactaaaccgacacgtaccctacaacgtgggtagttaggaggacnccgtagactcgtcgtacgaccggaaccgtacccgggtccgttacttaacgtttctagggtcgaccggtagtaccggtccccgaacggtaccggttacccgggtagacccggtacccgtacggaccgtaccggccggttacccgttttcggacccggtttcggaccggggg

SEQ ID NO: 207291 - DNA, 707 bp, Homo sapiens
  misc_feature: GYAE6OF01CPGRC.17.25.C03.1.454.CMB.1.raw
tcagcgtagactagcacgaccggtgctcgatttagtagtgtagatttgggtttggggactcaacaaccacatctgtcctctagaagaaaaccctgtgagcacagctcctcaccatggactggacctggaggatcctcttcgttggtggcagcagctacaagtcgccccactcccgaggtgcagctggtgccagtcgtggggctggaggtagaacgacgccgtggggcctcgagtagaaggtctccgtgacgaaggtcttcgtaggtactttctaccggtttacctccgtaatagtataccgaacgtgggtacgccgcgacggccgcgtaggaaccaacgacgtgaggtggagtagggacgtcgggaacctaaacctacgaggttagtcgtacgaacgtagttcgtccttaccacccgtacgtccgaacgggtacaacgtaaccttacgactacgaacccgacgtaacctcctaacaactaaccgacacgtacacgagtaggagttaggacgtacgacgtagacacgttcgaacggaccgtacggacccgttacgtacttaacgttaccgtaggtacggaaccgtacggtaacccggtaccgtaaaccggtcgtaccgggttacgaacccgggttaccggaacccggggtaccgtaccgggttaccgggttaccgtttaccgggtacggttcccgggtacccgggggg

SEQ ID NO: 207292 - DNA, 698 bp, Homo sapiens
  misc_feature: GYAE6OF01B3VSL.17.25.C03.1.454.CMB.1.raw
  modified_base (599)..(599): a, c, t, g, unknown or other
  misc_feature (599)..(599): n is a, c, g, or t
  modified_base (685)..(685): a, c, t, g, unknown or other
  misc_feature (685)..(685): n is a, c, g, or t
tcagcgtagactagcacgaccggtgctcgatttagtagtgtagatttgggtttgggggagtcagtctcagtcaggacacagcatggacatgagggtccccgctcagctccgtggggctcctgctactctggctccgagctgccagatgtgacatccagatcgacccagtcctccactccctccctgtctcgcctcgtgggtcggggtcaggacgtccacctatcctacgttcggaccggaacaacgtaccgaacggtaactttaaaaccttaatttaagttggtaatcgagacaacgaaaacctaggaaaaccgccccaacggtaccctccgtagtacttcgtcgtggtcactaccttacctactcgtacggacggtaacggtccggtacctcctaagtccggtaaggttcgaaggttcggacggtaggtaggacgttacggtacgggtaataagttacgttacaaccgttcctacctaacctacttacccaaacgtcctacgtacgaaaccttaacggaggtacggttattagtccgtaataccttactacggtactacgaactaaacgtcgttaacccttacgtacccgtttacccngtttaactcggttacggaaccggtaaggtaaaccttaggtacgaagtacaaacggaacttcggacgtacgacgtcgacctaacctnttccgtcttaccg

SEQ ID NO: 207293 - DNA, 764 bp, Homo sapiens
  misc_feature: GYAE6OF01D6MYF.17.25.C03.1.454.CMB.1.raw
tcagcgtagactagcacgaccggtgctcgatttagtagtgtagatttgggtttgggactcaacaaccacatctgtcctctagagaaaaccctgtgagcacagctcctcaccatggactggacctggaggatcctcttcttggtggcagcagctacaagtgcccacctcccaggtgcagcgtggtgcagtcgtggggctggaggtagaagacgccgtggggcctcagtgaaggtctccgtgcaggcttcgtggatttctacgtttaccctcttatagttatacaacgttgggtgccgccgacgggccgacgtcggaacgaaccgtaccgtggtacgtgggaggtggggagtacggggacccgaaaccctaacgtacgttgggtacgtaccacgttacggttcgttccttaccaacccctacgttccccgtacccggggaactaacggtaaccctttaaccgacttacggaaccctaacccgaacccgttaccctaccgtaaactaaacccaaccgtacgaccctaactaacggtagggtagttaggaacggtcgtaccctagtaacacgttaccgtacggaaccggtaaccggtacccgggttccgtttaaccttagtttacccgtggtaccggtaccggaaggtacccgttacccgaacggttacccggtttaccccgggttacgtaccccgggttaaccgcggtacccggttacccggttacccgtttaggttaccccgttggggtcccgggggtaacccggg

SEQ ID NO: 207294 - DNA, 644 bp, Homo sapiens
  misc_feature: GYAE6OF01CD3W1.17.25.C03.1.454.CMB.1.raw
  modified_base (183)..(183): a, c, t, g, unknown or other
  misc_feature (183)..(183): n is a, c, g, or t
  modified_base (290)..(290): a, c, t, g, unknown or other
  misc_feature (290)..(290): n is a, c, g, or t
  modified_base (321)..(321): a, c, t, g, unknown or other
  misc_feature (321)..(321): n is a, c, g, or t
  modified_base (549)..(549): a, c, t, g, unknown or other
  misc_feature (549)..(549): n is a, c, g, or t
  modified_base (588)..(588): a, c, t, g, unknown or other
  misc_feature (588)..(588): n is a, c, g, or t
  modified_base (635)..(635): a, c, t, g, unknown or other
  misc_feature (635)..(635): n is a, c, g, or t
tcagcgtagactagcacgaccggtgctcgatttagtagtgtagatttgggtttgggagtcagtctcagtcaggacacagcatggacatgaggtcccgctcagctcgtgggctctgctactctggctcgagctgcagatgtgacatcagatcgacccagtctccgatcctccctgtctgccctntggtacggggtcagtacgtcaccgtatccacttggacccggaactaggtcacggtaacgtttaaacctagtttaaatggtaatcgagcgtaagaaaccgtgaaaacnccccagaccttaccgtgatcgtacgtggtcncaactccagttcacgacgtacggtcgcctaccgattccgggtagtttcgacgggttcgacgacggttaggtaacgtcggtagggtaaccgagtttactttaccgacttacgtaaccaacttagcccgtaaccgtctccgtacgaacctaaccggtgtaacgtcttacggtctaacgtaactactacttacgtactaaccgaagtacgtacgttacctcgttaccccgntaacgttcgttacggacgggtaacccgtaagtacgttanaacggtactaacgtaaggtacttcggacttcgtacgaccatacggtntccggttac

SEQ ID NO: 207295 - DNA, 661 bp, Homo sapiens
  misc_feature: GYAE6OF01DC7SL.17.25.C03.1.454.CMB.1.raw
  modified_base (232)..(232): a, c, t, g, unknown or other
  misc_feature (232)..(232): n is a, c, g, or t
  modified_base (526)..(526): a, c, t, g, unknown or other
  misc_feature (526)..(526): n is a, c, g, or t
  modified_base (587)..(587): a, c, t, g, unknown or other
  misc_feature (587)..(587): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttgggtggcagcagctacaagtcgcccactcccaggtgcagctggtgcagtcgtggggctgaggtgaagagccgtggggcctcagtgaggtcnctgcgaggtcttctggattacacgtttaccgtactatagtactcgaacgtggggtgccgccgacgggccgacgtacggaacaaccggccgtaggaacggtgggtaaggtggggtaacgtcgggggaaaccctaaaccccgtaaacgacggttcgggtactaccgtagtacggttcgttccgttaccaaccctacgtcccgaccgggatacgtaccttacgactaccgaacctaccgtaacctcctaacaacaaaccgactacgacctacgtaggtacgtaggttaggacgtacncgtacactacgtacgtacgaacgtacccggaccgtacgttactacgtttactgacggtacncgtaccgccgacggaccggttcggcgacggtaccggcgcggaccggtccttcggtactccgggtggtaccgggg

SEQ ID NO: 207296 - DNA, 578 bp, Homo sapiens
  misc_feature: GYAE6OF01BRV91.17.25.C03.1.454.CMB.1.raw
  modified_base (217)..(217): a, c, t, g, unknown or other
  misc_feature (217)..(217): n is a, c, g, or t
  modified_base (240)..(240): a, c, t, g, unknown or other
  misc_feature (240)..(240): n is a, c, g, or t
  modified_base (305)..(305): a, c, t, g, unknown or other
  misc_feature (305)..(305): n is a, c, g, or t
  modified_base (468)..(468): a, c, t, g, unknown or other
  misc_feature (468)..(468): n is a, c, g, or t
  modified_base (472)..(472): a, c, t, g, unknown or other
  misc_feature (472)..(472): n is a, c, g, or t
  modified_base (493)..(493): a, c, t, g, unknown or other
  misc_feature (493)..(493): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtctgggctgaggtgaagagctggggcctngtgaaggtctcctgcaaggcttntggattcgacgtttacctcctatagtatcaactgggtgcgccgacggccgctggacaacgaccgngagtggatgggagtgggacaaccgtaacacgttggtcgtcacgagttcgtcctacaccctactcccgtcgggactacgacttaccgatacggaccacgaaccttccctaccaagtaaaccacgacgtaccctaagacgtgacgtttagacggcaccgtgaacntcgngaacacgacgcttctagttcngtacgcgagtccgtaccgagtcgtccgggtggaccgaccgtaccggacgtacgggcccttacggtttcgaggtttcgaccggggg

SEQ ID NO: 207297 - DNA, 595 bp, Homo sapiens
  misc_feature: GYAE6OF01AJQ44.17.25.C03.1.454.CMB.1.raw
  modified_base (244)..(244): a, c, t, g, unknown or other
  misc_feature (244)..(244): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcgagtgaggtctcctgcaaggcttcnggattcacgtttacctcctatagtatcaactgggtgcgccaggccgctggacacgcctgagtggatgggatggggaccgaacccctaacgactgggtgtccgacgagttgtccttccaccctctcccgtccggggactagaccttaccatcgaacccacgtaacctccctaccaataaaccacacgaccctacagtcgggagttggaggtacgccttagactactctacgaaccggaccgacggtacccgtcttattacgtgtcgcggagtacgtccccacggcgtcgggtacgacggcccgtacgggcgtacgggccggttacctttcggtaccgtttcggtaccggggg

SEQ ID NO: 207298 - DNA, 753 bp, Homo sapiens
  misc_feature: GYAE6OF01AUTLG.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtctcctgcgaaggtcttctggtattccgtaccgtttacctccttatacgtatacaacgtgggtgccgccgaggccgcgtaggaccaacgactggagtggagtgggatgggacctaacccgtaacgtacgtgggtgaccacgtacggtcgtccttacccaccctacgttcccgtacccggggactaacggtaaccctttaaacccgacttaccggaaccctaaccgtaacccgttaccccgttacccaaaactaaaaccccgaacccgtaaaccgtacccgttaaaccgtaagtacggggttaaggttacgggaaccgggtaaccgtcccggtacgaactacggtttaccgtaacgggtaaccggaccgtaaccgggtcccgtttaccttaacgtttacgtcggttcggaacgtacgtacccgtaccccgaacggttccggtaccgggtcggtacccgacccggtaccggacgtacgggtccgtttacccggtttacgttaccggttccggggtaaccggggg

SEQ ID NO: 207299 - DNA, 938 bp, Homo sapiens
  misc_feature: GYAE6OF01C6C9W.17.25.C03.1.454.CMB.1.raw
  modified_base (294)..(294): a, c, t, g, unknown or other
  misc_feature (294)..(294): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttgggtggcagcagctaacaaggtcgcccactcccgaggtcgcagcgtgggtcgcaggtccggtgggggctagggaggtacggaacggccgtccgttcggggttcccgtgggtgggtacgggttcctcccgtggacgtaagggttccgttcggngggacggcctaaccttcgacgccgtaacttagttacgttttacgaaggtttcggggtacggccgggaccgggtcccgtacggtacgggaaaccgtaacggggtccgttagggagggttaggggaagggtagggggaacgggtaccgtttacccggttacccttacggttaccggttaaccggaaccgtaaaccccaaaccgttaaaacccgaacgaacccgtaaacgtaacgggttaaccggttaacccgggacgggggtaacctaacggttaaccctaacccgtaaaacccggtaaaccgtaaccccgggaacggtaaaaacctaaaaccggttaaacccgaaaaccgtaacgttaaagttaaaccgtacgtaggtaaacgtacgtaacgaaccgtacgtaccgtgtaccgtacgttacggtacgaacgggaccggtacccgggttactttaccgttacttcggtacggtacggtacgggtaaggtttaaaccgttaaacgttaaccttaacgttaaaccgttaccgttaccgttttaaccccttttacccgttttaaccccctaccccgttttacccgtttaacggttacccggtttaccgggttacccgggtaccccgttaaccgggttaaccccccgggg

SEQ ID NO: 207300 - DNA, 558 bp, Homo sapiens
  misc_feature: GYAE6OF01ENNLD.17.25.C03.1.454.CMB.1.raw
  modified_base (280)..(280): a, c, t, g, unknown or other
  misc_feature (280)..(280): n is a, c, g, or t
  modified_base (292)..(292): a, c, t, g, unknown or other
  misc_feature (292)..(292): n is a, c, g, or t
  modified_base (332)..(332): a, c, t, g, unknown or other
  misc_feature (332)..(332): n is a, c, g, or t
  modified_base (339)..(339): a, c, t, g, unknown or other
  misc_feature (339)..(339): n is a, c, g, or t
  modified_base (343)..(343): a, c, t, g, unknown or other
  misc_feature (343)..(343): n is a, c, g, or t
  modified_base (434)..(434): a, c, t, g, unknown or other
  misc_feature (434)..(434): n is a, c, g, or t
  modified_base (469)..(469): a, c, t, g, unknown or other
  misc_feature (469)..(469): n is a, c, g, or t
  modified_base (474)..(474): a, c, t, g, unknown or other
  misc_feature (474)..(474): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccgaggccgntggacaacgcctgagtggatgggatgggacgaaccctaancgtggtntcangtgtctcaccatcccgcggacagtactaccatacgaccacgtaacctccgtaccaataaacacacgtcctacagtaggagttagagggacncctaggactatcgtagaccgacgacggtctacttnttacnggtgacgagaccgtcccgtaggacgttcgggacgacggcccgtacggaccgtcggccgttcctttaggcccgttggaccggggg

SEQ ID NO: 207301 - DNA, 720 bp, Homo sapiens
  misc_feature: GYAE6OF01EF4ZH.17.25.C03.1.454.CMB.1.raw
  modified_base (137)..(137): a, c, t, g, unknown or other
  misc_feature (137)..(137): n is a, c, g, or t
  modified_base (191)..(191): a, c, t, g, unknown or other
  misc_feature (191)..(191): n is a, c, g, or t
  modified_base (403)..(403): a, c, t, g, unknown or other
  misc_feature (403)..(403): n is a, c, g, or t
  modified_base (548)..(548): a, c, t, g, unknown or other
  misc_feature (548)..(548): n is a, c, g, or t
tcagcgtagactagcacgaccggtgctcgatttagtagtgtagatttgggtttggggactcaacaaccacatctgtcctctagaagaaaaccctgtgagcacagctcctcaccatggactggacctggaggatcctnttcttgggtggcagcagctacaagtcgccccacctcccgaggtgcagcgtggtnctagtcgtggggctggaggtgaagaacggccgtgggggtcctcaggttacggaacggtctcctgacgaagggtcttcgaggtactttcctaaccgttttacctccgtaatacgtaactcaagtcggggtgcccgccgaggtcccggcgtacggaaccaacggtcctggacggtaggaggtcgggagcgggaccgaaaccctcgaacgtggtntacgtacgtacggtcttaccttccgaaccctaccgtcccgtaccgggacacgtaccgtaaccacgtacgacctacgaaccttttccactaaactaactaacacgacctatacggtacggagttcggacgacgccgtataccgtancgtaccggaacggaccggtaccggttaccgttactttaacggttacttaggtcggtccgaggtaacccgaccccggtaacggtacccgggtacggtaccggtacccggtacccggtaacgggccgtacggtacccgggttccctttacggttcccgtcgggtacccgggggg

SEQ ID NO: 207302 - DNA, 670 bp, Homo sapiens
  misc_feature: GYAE6OF01ATN6M.17.25.C03.1.454.CMB.1.raw
  modified_base (175)..(175): a, c, t, g, unknown or other
  misc_feature (175)..(175): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtncagctggtgcagtcgtggggctgaggtgaagaagccgtggggcctcagtggaaggtctccgtgcgaaggcttcgtggacttctacgtttacctcctaatagtactcaacgtgggtcgcgccgacggccgcgtcggacaacgccgtggagtggagtgggaagtcgggaccgaaccctaacgcgtgggtacgtacgactagtcgtccttaccaccctacgtcccgtaccgggacacgtacttaaccatacgaccacgtaacctcctacaactaaacacacgcctacgagtggtacgtaggacgacgcgtgaacctactccggacgtaaccggaccgtacccgggtacccttaacttacgtttaccgtacggtacggacggtacggtacccggtacccgaacggtccgtcccggggtaacgtccgggttaaccccgaacgggtaccgtaccgggtccggtttaccccgtttacggtccgtttccggggtacccggggg

SEQ ID NO: 207303 - DNA, 784 bp, Homo sapiens
  misc_feature: GYAE6OF01BHTRY.17.25.C03.1.454.CMB.1.raw
  modified_base (253)..(253): a, c, t, g, unknown or other
  misc_feature (253)..(253): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgacggtgaagaagcctgggggcccttcgagtggaaggtctccgtgcaaggcttcgnggtattctacgtttacctcctatagtatcaactgggtgccgccgaggcccgcgtacggaacaaccggaccctgtacggtgggagttggggaactcgggggaccgtaaaaccccgtaacgtaaccgttggggttacgtaccgaacgtacggttacggttacctttacccgacccccgtaacgttccccggttacccggggtaaccaacggttaccctttaaacccgaacgttaccggaacccctaaccggaaaccccttacccgtaccctaaactaaaacccgaccgtaaccgtacccgtaaaccgtaaggttacggggtaacgtttacgggaaggtaccggtaccccgttagaacctacgtccgttaacggaaccgaccgtaccggggtacccttacgttaacgtttacccgtggttacgacggtaccgtaaccgtccccgaacggtacgtcccggggttaacgaccggtacccgtacggtacccgtacgggtcccggttacctttccggtaacgtttccgggaccggggg

SEQ ID NO: 207304 - DNA, 835 bp, Homo sapiens
  misc_feature: GYAE6OF01DMZL0.17.25.C03.1.454.CMB.1.raw
  modified_base (203)..(203): a, c, t, g, unknown or other
  misc_feature (203)..(203): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactccaggtgcagctggtgcagtcgtggggactgaggtnaagaagccgtggggctcgagtgaacggtctccgtgcgaacggtcttcgtggtactttaccgtaccgttttacctaccgttagttaacgttacttacgaaccgttggggtcgccggaccgacgggtcccgaccgttacggggaacctaaaaccggtccgtaggaacggtgggaacggttaggggaacgtcggggaaacccaaaccccgtaaacgtaccggttgggttacgtacaccgtaaggttcgttaccgttacccaaccccgtacgtccccggtaaccgggggtactacggtaaaccctttaaccgacggttaccgtaaacccggtaacaaacccgtttccctaaaccccgtaacgttaaaaaccaaccgaaccgttaccctaaaccggtagttcggggtaacgtttaagggacgggtaccgacctttcgaaccgtaccgttgaccggaacgtaacccggccggggttaccctttactcgtttaaccggtcggtacggtaccggtaggtaacccgtaaccccgtaggttaaccggtccggggttaacggccggtacccgggttaacgggaccgtacgggtaaccccgggttttccttttacgggcccgttttacgggggaccccgggggg

SEQ ID NO: 207305 - DNA, 769 bp, Homo sapiens
  misc_feature: GYAE6OF01AIJ0K.17.25.C03.1.454.CMB.1.raw
  modified_base (249)..(249): a, c, t, g, unknown or other
  misc_feature (249)..(249): n is a, c, g, or t
  modified_base (261)..(261): a, c, t, g, unknown or other
  misc_feature (261)..(261): n is a, c, g, or t
  modified_base (310)..(310): a, c, t, g, unknown or other
  misc_feature (310)..(310): n is a, c, g, or t
tcagcgtagactagcacgaccggtgctcgatttagtagtgtagatttgggtttggggtacgtcaacaaccacatctgtcctctagagaaaaccctgtgagcacagctcctcaccatcggactggacctggaggatccgtcttcgttcggtcggcgagcgagctacgaagtcgcccactcccaggtgcagcgtggtgcagtcgtaggggctggaggtaggaagacgcgcggggctcgagtgaggtctcgngcgagtcttagnggtacttcgtaccgttactcctaagtacgtactactaaggtcgggtacnccggaccgaggtcccggacgtacgggaaccacccggtaacttcggggaaaggtcggtaacggttcgggggaaggttcggggaacccggaaaccccttacggtacgttcgggtacgttaccgagtacggttcctccttaccgaaccccttagtccggtaccgggacctaacggttacctacgaatcccggaacctaccgtacctccgtacctaacaaaccgtaccacgaacctacgtaagtacgggttaacggttaggaacggtacctaccggtagtaacctagtaccgtaaccggtaaccggtacccgaccgggtaccgttacttacgttaccgtaggcggtaacggtccgtaccgttacccggaacggttacggtcccgggacgtacccggtacccggtaaccggcggtaacccgggtccggttaaccggtttcggttaccggtcccggggtacgggg

SEQ ID NO: 207306 - DNA, 840 bp, Homo sapiens
  misc_feature: GYAE6OF01EDNN2.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtctccgtgcgaaggtcttcgtggtattcgtacgtttacctccgtatagtatcgaacgtgggtacgccgaccgacggtcccgacgttacgggaaccaaccggtaccgtggaacggtgggtaacggtgggggacgtacggggaacccgtaaaaccccgttaaacgaccgttgggtacgtacgtaacgtaggttcgttccgttacccacccgtacgtcccgtaccggggaactacggtaaccttacccgagttaccgaacccgaaccgtaacccttaccctaacctaaacttaaaacccgaacccgtaaccggtaaccccttaacgtaacggttacgggttaacggtttacgggaaacgggtacccgtacccgtaacggaaccgttacgttaccgtacgggtaaacccgaacccgggtaacccggggttaccccgttttaacgttaacggtttacgtacgggttcggaaccggtaacggtacccgttaccccggtaaccgggttaccggttacccggggtacggtacccggtaccccggttaaccggggacccgtacgggtccccgggtttacccgttttcggtaacccgtttcgggggtaaccccgggggg

SEQ ID NO: 207307 - DNA, 655 bp, Homo sapiens
  misc_feature: GYAE6OF01BUS58.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagagccgtggggcctcgagtgaaggtcctccgtgcgaaggtccttgtggtacttactacgtttacctccttatagtatctaacgtggtcgcgccgaggccgcgtcggaccaacgaccgtggacgtggagtgggacgtacgggaccgtaaaccctaacgacgttggtcgtacacgtagttcgttccttccaccctacgtccgtaccggacacgttacctaccacgtaccgaaccgtaccgtaacctcccgtaacaactaaaccacgaaccgtacctaactagtcggtagttacggacgacgtccgtacgactacgtacgcggaaccgacgtaccggtccttacttacgttcgtgtacgacgtacgtaccgtacccgacggtcgttacggacggccgtaccggtaccggcgtaccggtccgttacgttcggtaccggtttcgggacccggggg

SEQ ID NO: 207308 - DNA, 814 bp, Homo sapiens
  misc_feature: GYAE6OF01DJK7W.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtcgccccactcccgaggtcgcagcgtggtgcgagtcgtgggctgaggtgaagacgccgtggggcctcgagtaggaaggtcctccgtgacgaaggtcttcgtggtaactttccgtaaccgttttaccctaccgttaagttacgtacttaccgaacgttcggggtcgcccggacccgaacgggtccccggtacgtacgggaaaccctaaccggaccgttagggtagggttacgggaagttacgggggacggttaccggggaaccccgtaaaacccccgttaacggaccggtttggggttaccgtaccgtaacgtacggtttaccggtcctttaaccccgaaccccgttacgttaccccggtaccggggtaacctaaccggttaaccctttaaccgaacgtaccgtaaccccgtaaccgtaaccctcctaaaccccgaaattaacccaaccgtaccgaccttaacgtagtacgggtagttacgacggaccgtcctaggaactacgttaccgacgtaaccgaccgtccgggttaccttaattaacgttcgttagggcgaaccgtacgacccgttaccgaacggtccggtacccgaggtcccgacccggtaccggacgtacggttacccgtttccgttaagtccggtcgggtaccgggg

SEQ ID NO: 207309 - DNA, 674 bp, Homo sapiens
  misc_feature: GYAE6OF01ECFBA.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggacctggacctggaggatcctcttcttggtggcagcagctacaagtgcccactcccaggtgcagctggtgcagtctggggctggaggtgaagaagccgtggggcctcagtcgaaggtctcctgcgaaggcttctggatttccaacgttttaccctcctatagtatctaacgtgggtgaccgcgacggcccgtacgtcggaccgaacgacctggaggtaggaggtggggacgtcggggaccgaaaccctaacgaccgtagggtcgttacgaaccgtaggttacgttaccctttaccaaccccctacgttaccccgtcccggggtaactaacggtacccttaaccagttacccgaacccgaaccgtaacccttccctaacctaactaaacccaacacgacccttaacgagttagggacggtttagacggacgtccgtagacatctagaaccgaccgaccggtccttattacgttacgtgtacgacgagtaccgtacccgacgtacgtcggacggacgtacccgcgcgtaggcccggttacgtttcggccgttgggccgggg

SEQ ID NO: 207310 - DNA, 600 bp, Homo sapiens
  misc_feature: GYAE6OF01DHR0U.17.25.C03.1.454.CMB.1.raw
  modified_base (217)..(217): a, c, t, g, unknown or other
  misc_feature (217)..(217): n is a, c, g, or t
  modified_base (282)..(282): a, c, t, g, unknown or other
  misc_feature (282)..(282): n is a, c, g, or t
  modified_base (454)..(454): a, c, t, g, unknown or other
  misc_feature (454)..(454): n is a, c, g, or t
tcagcgtagactagcacgaccggtgctcgatttagtagtgtagatttgggtttggggactcaacaaccacatctgtcctctagagaaaaccctgtgagcacagctcctcaccatgactggacctggagatcctcttcttggtgcagcagctacaagtgcccactcccaggtgcagctggtgcagtcgtggggctgaggtgaagagccgtggggcctnagtgaaggtctctgcaaggcttgtggtattcacgtttacctctatacgtatcaacgttgggtacncgccgaggccgcgtacggaacaaccgacctggacggtggacgtagggactcggggaccaaccccgtaacgtacgtggtctaccgagacgtttcgtaccttacccacctacttcccgtacggactacgaccttacagtcgaccacgtacctcctaccaataacacagacctanagtcgtagtcgagtacgcgtacgacatcacgacgaccaccgggtctacgttaacttacgtgcggtcgacgtaccgtaccacggtacgtccggtacgaccgtaccgtacggctaaccggccgtacgtttcgaccgttcgggtccggg

SEQ ID NO: 207311 - DNA, 535 bp, Homo sapiens
  misc_feature: GYAE6OF01EMYGC.17.25.C03.1.454.CMB.1.raw
  modified_base (184)..(184): a, c, t, g, unknown or other
  misc_feature (184)..(184): n is a, c, g, or t
  modified_base (248)..(248): a, c, t, g, unknown or other
  misc_feature (248)..(248): n is a, c, g, or t
  modified_base (300)..(300): a, c, t, g, unknown or other
  misc_feature (300)..(300): n is a, c, g, or t
  modified_base (346)..(346): a, c, t, g, unknown or other
  misc_feature (346)..(346): n is a, c, g, or t
  modified_base (352)..(352): a, c, t, g, unknown or other
  misc_feature (352)..(352): n is a, c, g, or t
  modified_base (427)..(427): a, c, t, g, unknown or other
  misc_feature (427)..(427): n is a, c, g, or t
  modified_base (444)..(444): a, c, t, g, unknown or other
  misc_feature (444)..(444): n is a, c, g, or t
  modified_base (450)..(450): a, c, t, g, unknown or other
  misc_feature (450)..(450): n is a, c, g, or t
  modified_base (465)..(465): a, c, t, g, unknown or other
  misc_feature (465)..(465): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtncagtcgtggggctggaggtgaagaagccgtggggcctcgagtgaaggtctcctgcaaggcttcnggtattcacgtttacctctatagtatcaacgtgggtcgcgccgaggcccgcncggacaacgtaccgtggagtggagtgggatgggccgtaaccctaancgtgtntcgactagtctcttcacctactccgtacgggacagtactacatcgaccacgacctccacaactaacacagcctanagtggagtgagagctanacatcngacgcgacggtcctntacgtacgtgtcgcgacgcgtccagcgtcggagtccgcgtaaggacgtcgttcttagcgttgcgggtacg

SEQ ID NO: 207312 - DNA, 846 bp, Homo sapiens
  misc_feature: GYAE6OF01BGSFE.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctaacgaagtcgcccactcccgaggtcgcagccgtggtgcgagtcgtgggctaggaggtaggaaagacgccgtgggccttacgaggtagtaacggtcctccgtgacgtaggtcttcgtaggtactttccgtaccgttttacctacttaagtacggttactacgtaaccggtgggtcgaccgaccggacggtcccgacgtacggaaaccgaaccggtaccgtaggtaaggtcggacggtagggacgtacgggaacccgtaaaccgtaacggtacggtacggttcgtaaccgtacgtacgtttacgttacccgtaccaccccgttacggtaccccggtacgggaactacggtaacccttaaccgacgtacccggaacccctaacgtaccccttaccaccgtaaaactaaccgaacgtacccgaactaccggtagtagggtaaccgttacggacgtaccgtacgtaacggtactaacgggtaccgtaccgggtaaaccgtaccgggtaccccgttacgtttaaccgttacgtttacccgggttacggccggttacccggaacccgttaccgtaaccccggtaacgggttacccgggttacccggtacccggtaccggtaccccggtaacgggtacccgttacgggtttacccccgttaccgttttaccgggtcccggtttaccgggggaccccgggg

SEQ ID NO: 207313 - DNA, 680 bp, Homo sapiens
  misc_feature: GYAE6OF01DD4AX.17.25.C03.1.454.CMB.1.raw
  modified_base (187)..(187): a, c, t, g, unknown or other
  misc_feature (187)..(187): n is a, c, g, or t
  modified_base (226)..(226): a, c, t, g, unknown or other
  misc_feature (226)..(226): n is a, c, g, or t
  modified_base (235)..(235): a, c, t, g, unknown or other
  misc_feature (235)..(235): n is a, c, g, or t
  modified_base (237)..(237): a, c, t, g, unknown or other
  misc_feature (237)..(237): n is a, c, g, or t
  modified_base (248)..(248): a, c, t, g, unknown or other
  misc_feature (248)..(248): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtcgcccactcccgaggtgcagctggtncgtagtcgtggggctggaggtgaagagccgtggggcctnagtgagtcncngcaggtctcgngacttctacgtttacctcgtaatagtactacaacgtggtcgcgccgaggccgacgtcggaacaacggtcctggagtggagtgggacgtggaaccaaccgtaagcgtggtagtcacgacgttcgtccttaccacctaacgttccgtaccgggactacgtaccttacgactacgaccctaacgtaaccctacccgtaacctaaactaaacccacgaaccgtaaccctaacgtacggttagggaagttacgggaacggtccgtacctacggaaacttcgtaccgtaacgtaacccggtaacccgtacggtacccgtacgttaactttccgtagggtccgtacggtaacgtacccggtaccctaggtacgtcggtacggacgtaccccgtaggacccgtacggtccggttaccgtttagacgttccgggtacgggg

SEQ ID NO: 207314 - DNA, 870 bp, Homo sapiens
  misc_feature: GYAE6OF01EIYME.17.25.C03.1.454.CMB.1.raw
  modified_base (193)..(193): a, c, t, g, unknown or other
  misc_feature (193)..(193): n is a, c, g, or t
  modified_base (203)..(203): a, c, t, g, unknown or other
  misc_feature (203)..(203): n is a, c, g, or t
tcagcgtagactagcacgaccggtgctcgatttagtagtgtagatttgggttgggactcaacaaccacatctgtcctctagagaaaaccctgtgagcacagctcctcaccagtggactggacctggaggactcctcttcgttggtggcagcagtctaacaagtcgccccactcccgaggtcgcagtcgtggcncgtaggtcgnggggctggaagggtagaaacgacggtccgtcggggtcccttagaggtaggaacggttcctaccgtcggacgtaagggttcctttacggtcggtaactttccgttaacccgttttacccgttacttaacgttaacgttaaccttaccggtaacgggttcggggtacgaccccggtaccggaacccgggggtccgtaccggtaacggggtaaccctaaaccgggtacccgttagggtaaggttaggggaacgggttggggtaacgttaccgggggaacccctaaaacccgttaaccgtacgggttcggtaccgtaaccgtaaccgttacggttccgtttccctaacccgtaaccccgtacggtaccccgtacggggaactaccgtaaccttaccgaacgtaccgtaaacctaccgtaacctacctacaaaccgtaaccacgactacccgtagacggttcggtagtacggacggtacacccgtagtaacctgtaaccgtaccgaaccggtaccgtaccgggtccttaaccgttactaacggtcgtaacgccggtaacgtccgtacccggtagtcccgggttaggaccggtaaccggttccccggaaaggttcccgtaaccgggttccgttaacgtttcccggggtaaaccgtcgggggtaaaccccgggg

SEQ ID NO: 207315 - DNA, 626 bp, Homo sapiens
  misc_feature: GYAE6OF01DRF4D.17.25.C03.1.454.CMB.1.raw
  modified_base (285)..(285): a, c, t, g, unknown or other
  misc_feature (285)..(285): n is a, c, g, or t
  modified_base (310)..(310): a, c, t, g, unknown or other
  misc_feature (310)..(310): n is a, c, g, or t
  modified_base (331)..(331): a, c, t, g, unknown or other
  misc_feature (331)..(331): n is a, c, g, or t
  modified_base (360)..(360): a, c, t, g, unknown or other
  misc_feature (360)..(360): n is a, c, g, or t
  modified_base (429)..(429): a, c, t, g, unknown or other
  misc_feature (429)..(429): n is a, c, g, or t
  modified_base (441)..(441): a, c, t, g, unknown or other
  misc_feature (441)..(441): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactccaggtgcagctggtgcagtcgtgggctgaggtgaagaagccgtcgggcctacgagtgaaggtctccgtgacaggtcttcgtggattctacgttacctcctatagtactcagtggtcncgcgaggccgcgtgacacgctgagnggatggatcggacaaccctancgtggtgcagtagtctccgttcaacccgntcccgtcgggactacgtaaccttacagtacgaccaacgtacctccctagaacaaacctacacgtaccanacgtgacgtagngtacgccgtaagctacgttcgtaagaccgaaccggtacgttccgttatttaacgttaccttgggtaccgtacggaaccgtacccgttaccccgacgggtacgtaccggggttagtccccggtacccgggtaacgccggtaacggttcccggtaccgtttggttacccgttcggggtaacccgggg

SEQ ID NO: 207316 - DNA, 831 bp, Homo sapiens
  misc_feature: GYAE6OF01EJK8F.17.25.C03.1.454.CMB.1.raw
  modified_base (389)..(389): a, c, t, g, unknown or other
  misc_feature (389)..(389): n is a, c, g, or t
  modified_base (523)..(523): a, c, t, g, unknown or other
  misc_feature (523)..(523): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtcgcccactcccgaggtgcagctggtgcagtcgtgggctggaggtagaagacgccgtcggggcctcgaggtagaacggttctccgtgacgtaaggtctttcgtaggtacttcgtaccgtttacctccttaatagtactacaaggtgggtcaccgccagggcctcgtcggaaccaaccggccgtggacggtggaggtagggtacgtacgggaccccgtaaacccgtaaancggttcggtacgtacctacgtacggttcttaccttacccgaccctacggttcccgaacggggtaacaccgttaacgttaaccacggtaccgaaccctaaccggtaacccttcccaaccgaaacttaaaaccccncgtaaccgtaaccttaagacggttacgggtaggtttacggaacggggtaccttaccgtaacgtaccgtagttcccgaagggtaaccccgaacggtacccccgggttgttaaacctttaaccgttcggtaccgggttacgaccggggtaacccgttacccggtaaccccgttaacgggttacccgggtacccgggttaacggtaaccccgggtaccccggttaaccggggacccgttacccggggttttacccccgggttaccggttttttaacccggcccggggtttacccgggtaccccgggggggg

SEQ ID NO: 207317 - DNA, 876 bp, Homo sapiens
  misc_feature: GYAE6OF01EFMNR.17.25.C03.1.454.CMB.1.raw
  modified_base (267)..(267): a, c, t, g, unknown or other
  misc_feature (267)..(267): n is a, c, g, or t
  modified_base (290)..(290): a, c, t, g, unknown or other
  misc_feature (290)..(290): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagaagcgtggggcctcgagtgaaggtctcctgcgaaggtcttcgtggacttctacgtttaccnctatagtatacaacgtgggtacncgaccgaggccgtgtaggaaccaacgacctggacgtggagtcgggagtcggaccgtaaacctaacgcgttaggtcgtaccgaagtacgggttcttaccgtacccaaccccgttacgtacccggtacccgggaactaacggtaaccgttaaccgacgttaccgaacccgtaaaccgtaacccttaccctacctaaaaactaaaacccgaccgaaccgtaccccttaagtacggttaaccggggtagtttacgggaaacggaccggtacccgttaaacggaacttaacgtaccggttaaccggaacccggggtaacccgtaacccggggttccccggtttaaacttaacgggttttaacccgtcggttaaccgggtaacccgggtaaaccgggttaaccccgtaacccccgggttaaaccgggtaccccgggtttaaccccgggggttaacgtaaacccccggggggtaacccccttttaaaccgggggggaccccgtaaccccggggggtttacccggttttaccccccgggtttttttaaacggtaacccccggggttttccccgggggggttaaaccccgggggg

SEQ ID NO: 207318 - DNA, 545 bp, Homo sapiens
  misc_feature: GYAE6OF01DR3T9.17.25.C03.1.454.CMB.1.raw
  modified_base (245)..(245): a, c, t, g, unknown or other
  misc_feature (245)..(245): n is a, c, g, or t
  modified_base (282)..(282): a, c, t, g, unknown or other
  misc_feature (282)..(282): n is a, c, g, or t
  modified_base (313)..(313): a, c, t, g, unknown or other
  misc_feature (313)..(313): n is a, c, g, or t
  modified_base (328)..(328): a, c, t, g, unknown or other
  misc_feature (328)..(328): n is a, c, g, or t
  modified_base (333)..(334): a, c, t, g, unknown or other
  misc_feature (333)..(334): n is a, c, g, or t
  modified_base (339)..(339): a, c, t, g, unknown or other
  misc_feature (339)..(339): n is a, c, g, or t
  modified_base (354)..(354): a, c, t, g, unknown or other
  misc_feature (354)..(354): n is a, c, g, or t
  modified_base (366)..(366): a, c, t, g, unknown or other
  misc_feature (366)..(366): n is a, c, g, or t
  modified_base (389)..(389): a, c, t, g, unknown or other
  misc_feature (389)..(389): n is a, c, g, or t
  modified_base (399)..(399): a, c, t, g, unknown or other
  misc_feature (399)..(399): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctctttcttggtggcagcagctacaagtgcccactcccaggtgcagctggtgcagtctggggctgaggtgaagaagcctggggcctcagtgaaggtctcctgcaaggcttcnggattcacgtttacctcctatagtatcaacgtgggtncgcagcgcgtgcgaacaccgctggaggcggngagtcggaagaccanatgtnncagtnctcacactcgcgganacgtacttacancgacacgtactctacgtacaaanacatacctanagtaggtagtgacgtcgacgtactactgtacgtacggaacgaccgacggtacctcttactagtcgacggtacgacgtacgtaccgtacgacggttacggagaccgtcggtaccgaacgtcggtccgttagttcgtcggtgggacgg

SEQ ID NO: 207319 - DNA, 622 bp, Homo sapiens
  misc_feature: GYAE6OF01AMZIC.17.25.C03.1.454.CMB.1.raw
  modified_base (448)..(448): a, c, t, g, unknown or other
  misc_feature (448)..(448): n is a, c, g, or t
  modified_base (558)..(558): a, c, t, g, unknown or other
  misc_feature (558)..(558): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgagtgaagagctggggcctcagtgagtctcctgcaaggcttctggattcacgtttacctcctatagtatcaactgggtgcgccaggccgctcggacaacgacctgagtggatgggactgggcaaaccctaacgactggtcgtcagtagtcgtcttcacccgtactcccgtccggggaacctaggtaacctttaccgattacgaacccgtacgaacctccctaacccaagttaaaaccaccacgtaccctaanaagttgggaagttggagacgtccgtacgactatcgtagacccgacgaccgggtccttacgtaacttacgtggtgaccgaggtacgtaccccgacgacgttaccccggganaccggtaccgtacgggacctacgggtcccgttaccttttcgggaccgtttcccggtaccggggg

SEQ ID NO: 207320 - DNA, 789 bp, Homo sapiens
  misc_feature: GYAE6OF01D3ADD.17.25.C03.1.454.CMB.1.raw
  modified_base (289)..(289): a, c, t, g, unknown or other
  misc_feature (289)..(289): n is a, c, g, or t
  modified_base (301)..(301): a, c, t, g, unknown or other
  misc_feature (301)..(301): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagccgtggggcctcgagtgaacggtcctccgtgcaaggtcttcgtggattcgaccgtttacctctatagtatcaacgttgggngtcgccaggccngtcggacaaccgacctggacgtggagtgggagtacgggacctaaacccgtaacgacgttggtcgtacgacgtaaggttcgtaccttaccaccccgtacgttccccgtacggggacctaacggtaaccctttaaccgacttaccggaacccctacgtaaaccccttcccgtaaccctaaacgttaaacccaaccgaccgtaaccccgttaacgtaacggtttacggggtaacggtttacgggaacgggttaccgtacccgtacgtaaccgtaacgttacggtaacggtaacccgaacccggtaccgggtacccgtttacctttaacgttaccgttagggtaccggtaccggaacggtacccggtaaccccgtaacgggttacccggtacccggggttacggaaacccgggttccccggtacccgggacccgtaccggggtaccccgttacccggtttttaccggacccggttttcgggaaccccggggg

SEQ ID NO: 207321 - DNA, 578 bp, Homo sapiens
  misc_feature: GYAE6OF01A6S79.17.25.C03.1.454.CMB.1.raw
  modified_base (307)..(307): a, c, t, g, unknown or other
  misc_feature (307)..(307): n is a, c, g, or t
  modified_base (378)..(378): a, c, t, g, unknown or other
  misc_feature (378)..(378): n is a, c, g, or t
  modified_base (398)..(398): a, c, t, g, unknown or other
  misc_feature (398)..(398): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtagaagaaggccgtggggcctcgaggtgaaggtcctccgtgacgaaggtcttcgtggtattcctacgtttacctcctatagtatcaacgtggtgcgccaggccgngtggacaacgctagagtggagtgggagtcgggaccgaaccctaacacgtggtgacagagtcgtctccaccnctccgccgacagtactacancgaccacgacctaccacaactaaacacacgtaccaacgagttaggagttacgaggactacgtagtactagtcacgaaccgacgaccgtccttacttacttcgtgtcgacgtacgtaccgtccgaacgtcgtcggagaccgtccggagacgcggtcgttaccttcgtccgttgggaccggg

SEQ ID NO: 207322 - DNA, 823 bp, Homo sapiens
  misc_feature: GYAE6OF01B3MXN.17.25.C03.1.454.CMB.1.raw
  modified_base (331)..(331): a, c, t, g, unknown or other
  misc_feature (331)..(331): n is a, c, g, or t
tcagcgtagactagcacgaccggtgctcgatttagtagtgtagatttgggtttggggactcaacaaccacatctgtcctctagagaaaaccctgtgagcacagctcctcaccatgactggacctggaggatcctcttcttggtggcagcagctacaagtcgcccactcccaggtgcagctggtgcagtcgtggggctggaggtgaagaagccgtggggcctagagtaggaacggttcctccgtgaccgtaaggtctttacgtaggtactttaccgtaaccgtttttaaccctaccgttaagtagttaacttacgaaacggttgggggtacnccggtaccgaagggtcccgacgtacgggaaccaacggtacctagggagtaggacgtaggggacgtggggaaccctaaaccctaacgaccgtggtacgtacaacgtagtcgttacctaccaacccgtacgtcccggtaccggggaactaacggttaacccttaaccgaagttacccgaaccccgtaaaccgtaacccttacccgtaaacctaaaacgttaaaacccgaaccgtaccgtaacccgtaaacgtaacggttagggtaacggtttaggaacggaccgtaccgtacgtaactacgttacgaacggaaccgtaaccgaccgggttacccgttacttaacgttactacgggtacgaccggtaaccggtaccgtaaccccgtaagggtaacccggttacccgggtaggtaacccggtcccggtaaaccgggtccgtaaccgggtcccggtttaacccgttttacggacccggtttccgggaacccgggggg

SEQ ID NO: 207323 - DNA, 725 bp, Homo sapiens
  misc_feature: GYAE6OF01BHPCR.17.25.C03.1.454.CMB.1.raw
  modified_base (220)..(220): a, c, t, g, unknown or other
  misc_feature (220)..(220): n is a, c, g, or t
  modified_base (242)..(242): a, c, t, g, unknown or other
  misc_feature (242)..(242): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagcctggggcctnagtgagtctctgcaggtcttcngtattctacgtttacctactatagtatcaacgtgggtgcgccacggccgtcgtacggaactaaccggaccgttacggaggtacgggaggttggggacgtacgggggacctaaaaccccgtaacgacgtcggtacgtaccacgtacgttcgttccgttaccaacccctagtacccggtccgggacctaaggtaaccttaccgacgtacgaacccaacgtaaccctaccctaccgtaaactaaaccgaactaacgaccctaactacgttcgggaagttacgggtacgtacggtacctaggtaaccctagttcgtaacggaaccgtaccggaacccgggttacccttacgttaacgtttcgttacggtcggtacggtacggtaaccgtacccggaaacgtcgttaccgggtacggtacggtcccggtaacggccggtaccggtccggggttaccctttacggtacccggtttcgggtacccggggg

SEQ ID NO: 207324 - DNA, 647 bp, Homo sapiens
  misc_feature: GYAE6OF01B4SST.17.25.C03.1.454.CMB.1.raw
  modified_base (343)..(343): a, c, t, g, unknown or other
  misc_feature (343)..(343): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcgagtgaaggtctcctgcaaggcttcgtggtacttcacgtttacctcctatagtatcaacgtgggtagcgccgaggccgctggacaacgcctggagtggagtgggatcgggacgaaccctaanacgtggtcgtcaacgagttgtccttaccaccctacgtcccgtacgggacctagtaccttacgacgtcgaacccaaccgtaacctacccgaccaactaaaccaccgacgaccctaacgacgtagggtacgttagaaggacgtacccgtagactagtaccgtcgacggaccgtaccggtccgttacgttaactttcgtagtcgaccggtacgtacgtccccgaagtccgtacccgggtacgccggtacccgtacgggaccgtacggttcccgggtacctttcgggtaccgttccggtaccgggggg

SEQ ID NO: 207325 - DNA, 679 bp, Homo sapiens
  misc_feature: GYAE6OF01CAEH5.17.25.C03.1.454.CMB.1.raw
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagccgtggggcctcagtgaaggtctcctgcaaggcttctggattcacgtttacctcctatagtatcaacgtgggtgcgcaggccgctggacacgcctgagtggagtgggagtcgggacgaacccgtaacgacgtggtgtcactagtcgtcttacaccctactccgtaccgggacacgtaccttaccattacgaccctaacgaaccttccctacctaaactaaaccaccacgtacctaacagttagggatttacgggaaggtcgtaccgtagacctaagttccgaaggaacccgaccgtaccggggtcccgttaacttacgtttaaccgtgggtacgaccggtaaggtacccggtaccccgaacggtaccgttcccggggtaacggtacccggaccccggtacccgggtccggaaccggggttccccggttacccgtttttcggaaccccggtttcggggtaaccccggggggg

SEQ ID NO: 207326 - DNA, 634 bp, Homo sapiens
  misc_feature: GYAE6OF01EI7JO.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagcctggggcctcagtgaggtctcctgcaaggcttcgtggactttcaccgtttacctccttatagtatacaacgtgggtcgcgccgaggccgctggaccaacgacctggagtggagtgggatgggaccgaaaccctacacgtggtcgtcacgtagtcgttcttccacccacgtccgtcgggacacgtaccttaccatcgaccaacgaacctacctccaactaaaccactaacgaccctataacgtgggaagttaggacggtacaccgtacgacctagtctaggaaccgtacccgtaaccgggtccgttaccttaagttacccgtgtacgacgacgtaccgtccccgaacggtacgtcccgggtgaccggtcccgtaacgggccgtacgggtcccggtacccttttcggtacttccgggtacggggg

SEQ ID NO: 207327 - DNA, 852 bp, Homo sapiens
  misc_feature: GYAE6OF01CUWOZ.17.25.C03.1.454.CMB.1.raw
  modified_base (241)..(241): a, c, t, g, unknown or other
  misc_feature (241)..(241): n is a, c, g, or t
  modified_base (254)..(254): a, c, t, g, unknown or other
  misc_feature (254)..(254): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcgttggtggcagcagctacaagtcgcccactcccgaggtgcagcgtggtgcagtcgtggggctggaggtgaagaagccgtgggcctcgagtgaaggtctcgngacgaaggcttgnggtattcctaaccgttttacctcctaagtaagtactacgaacgtcggggtagccggccgagggcccgacgtggaaccaacgaccgtggaggtgggacgtaggggacgttacggggaccctaaaaccccgttaagaccgttgggttcggaacctaagtaacgggttcgttaccttacccgaaaccccgtacgtttccccggtaacccgggggtaacaaacgttaacccgttttaaacccgaagttaacccggaaaccccgtaaacccggttaaacccctttccccgaaaacccttaaaacggtaaaaaaccccaaccgtaaaccgggttacccttaaaaccgaaggtttacgggggtaacgtttacggaacggggttacacccgtttaaggaacctaagttcccgaagggaacccgtaacccgtacccgggttcccgttaactttaacgtttacccggtagggtcgtaacccgggtaaaggtacccccggttaccgtaaccgggaccggtttcccgggaagtacccggtacccgttaacgggacccgtacgggtacccgtttaacccgtttttaaccgcggggtaccggggaacccggg

SEQ ID NO: 207328 - DNA, 844 bp, Homo sapiens
  misc_feature: GYAE6OF01DFYXA.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagcgtggtgcaggtcgtggggctggaggtagaaggaagccgtcggggcctcgagtagaacggtcctccgtgcgaaggtcttcgtggtactttaccgtaccgttttaccctacctaagttacgttactccgtaacgttggggtcgccggtacccgacgggtcccgccgtagggaaccaaacccggtaccgtggtaaggtgggaggttagggggtacgttacgggggaaccccgtaaacccccgtaaaccgtacggttcgggtacgttacgtaccggtaacggtttcgttcccgttacccgaaccccgtaaccgttccccggtacccggggaactaaccggtaacccttacccgtacgttacccgaacccgtaacccggtaacccttaccccttaaccaaacttaaaacccgaccctacggtaacccttaacgtaggttacgggtacggtttagggaaccgggtacgtacccgttacggaacctagtccgtaccgggaacccgaccgtaccgggtacccgtttacttaacgtttaccgtcggtacggccgaaccgtacccggtaccccgaacgggtaccgttccccggggtaggaacccggtcccgtaaccgggcccgtaaccggttcccgggttaaccttttaccggacccgttttggggaacccgggg

SEQ ID NO: 207329 - DNA, 943 bp, Homo sapiens
  misc_feature: GYAE6OF01DI2AI.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttgggtggcagcagctacaagtcgcccacctcccgaggtcgcgagtcgtggtgcgtcggtcgggtcgggtacgtagggtaagggtaggaaacggaccggtccggggtccggggtcctacggtaggtacggtaccgttccgtcgtacggacgtacggttccgttcggtacgttaccttaccgttaaccgtttaccctacgttaagttacgttaaccgttaccggtacggggttcgggtccggacccggtaccggaccgggtacccggttacggtaaccggaaacccgtaaccggtacggtagggttaagggtacggggtagggtacgggtaaccgggtaacccgggaaacccctaaacccgtaacggtcgggttacggtacgtaccgtaacgttcggttcccttaccctaaccccaccgttaaccggtacccggtaacggtaacctaaccgttaccgtaactaccggtaaaccctacccgtaaccgttaaccccttaccgtaaacctaaaacgtaacccgaactaaccccgtacgtaacggtaaggttaacggggttacggtaaccggaaccgggtctaaccggtaacgtaaccgttacggtacccgtaacggaaaccccggttaccggtacccgtttaacgtttaccgtttacgttaacgggttccgaaccgggtaaccgggttaccggaacccccgttacggtaaccggttccgggttaaccggacccggaaaccggttcccgggtaggaccggtttccgggttaccgtttaccggtaaccggttccgggacggggtcccggg

SEQ ID NO: 207330 - DNA, 707 bp, Homo sapiens
  misc_feature: GYAE6OF01CKIGR.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcgagtaggaaggtcctccgtgacgaagggtcttcgtaggtattccgtacgttttacctccgtaatacgttataccgaacgttgggtagccgccgacggccgcgtacggaccaacgaccgtggagtggagtgggagtcgggaccgaaaccctaagacgtggtcgtacacgtagtcgtaccttcacccacgttcccgtaccgggaactacgtacctttaaccgacgtaccggaaccctaacgtaacccttacccgtacctaaactaaaacccacgacgtaaccctaacacgttacgggtaagttacggaagggacgtcccgtaagactaacgttcgtacgaaccgaccgtacccgggtccgttacgttaacttacggtcgtacggaccgacggtaccgtaacccgacggtaccgttccgggtacggaccgacccgttaccgggacgtacggttccgtacccgtttcggtaccgttcccgggtaccgggg

SEQ ID NO: 207331 - DNA, 952 bp, Homo sapiens
  misc_feature: GYAE6OF01CYNLR.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccagtggacttggacctggaggatcctcttcttggtgcagcagctacaagtcgcccactcccgaggtgcagcgtggtgccagtccgtgggctgaggtcgaagaacggccgtagggggccctcgtacggtcggtaaacggtccgtacccgtaggacgtaacggtctttaccgttaggggtaacttttccgtaacccggtttttaacccttacccgttaagttaaccggttaacttaacccgtaaagttccggttaggttcggtacccgtacccgaacggggtccccggtaccgtagggaaccgtaaaaccgtacccgtaggtaggtacggggtaacgtcggggtaagtaccggggaaccctaaaaccccgtaaacgtcggttcggtacggtacctaacggtacgttcgttacccttcccgaaaccctaccgtttacccccggaccggggaaacttaaccgttaacccgttacctaaacgtaccggttaacccgaaacccgtacccgttaacccctaacgtaaaaccctaaacccgtaaacgtacccggtaacctaaccggttaacggttacggggtaacgtttacggggaacggttaccggtaaacccgtcggttaaaaccgtacggttaaccgtaaccggttaacccggaacccgggttaaccggtaccgtttaaccgtttaacgttaccggtacggtttaccgggaacggtaaacccggttaccgggtaaccccgtaacggttacggttaccgggtaccggttaaccgggtaacccgtaccgggtccgaaaccgggttcccggtttaacccggtttccgggttaacggtttaccccggggg

SEQ ID NO: 207332 - DNA, 965 bp, Homo sapiens
  misc_feature: GYAE6OF01EB75X.17.25.C03.1.454.CMB.1.raw
  modified_base (368)..(368): a, c, t, g, unknown or other
  misc_feature (368)..(368): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcgttggtggcagcagctacgaagtcgcccacctcccgaggtcgcacgtcgtggtgcgtacggtcgtcggggctaggtagggtagaaacggtaacggtcccgtacgggggcctacgaggttacggtaacggttcctacccggtggaccgtaacggttccgtttacggtacggtactttaccgtaccggtttaccctacgttaagtacgttactacgtaacgtcgggttcnccggaccgccggccgtacgtaccgggaacctaaccggtccgttagggtacggtacgggtacggtacgggttaacggtaccggggtaacccgtaaaacccgttaaccgttacggtcgggttaccgttaccgtaacggttacggtttcccgtaccgttacccgacccgttacccggttcccggtaaccgggtaacttaaccgtttacctaacccgtacgttaacccggaacccgttaaccgtaaccttacccgttaaccaaaaccgttaacgaaccccgtacgtaaccctaaggtaaccgttacgggttaacggttacgggtaaccgggtaacgttacccgtacggaacccgttaccggtaacccgtaccggtaaacccggacccggttacccggggttaacccctttagtttaacccgtacggttaccgggtaacggtacccgggtaaacccggttacccggtaaccccggttacggacccgggtttaccggggtaacccggaaccccgggttacccggtaaccgggttaccgtaacccgggggttcccggttacccgtttaccggggttaccccggttcggggttaaccccgggggg

SEQ ID NO: 207333 - DNA, 806 bp, Homo sapiens
  misc_feature: GYAE6OF01A2N3F.17.25.C03.1.454.CMB.1.raw
  modified_base (299)..(299): a, c, t, g, unknown or other
  misc_feature (299)..(299): n is a, c, g, or t
  modified_base (782)..(782): a, c, t, g, unknown or other
  misc_feature (782)..(782): n is a, c, g, or t
tcagcgtagactagcacgaccggtgctcgatttagtagtgtagatttgggtttgggggagtcagtctcagtcaggacacagcatggacatgagggtccccgctcagctcctcgggctcctgctactctggctccgagctcgccagatgtgacatccagactcgacccagtcctccactcctccctgtctcgtcctcgtggtggggtacagacgtcaccatcacttcggaccgacagtaccacggtaacttaaaaccttatttaatggtactacgagacaagtaaaccgtacgaaaaccncccagtaccctctgtactcgtcgtacgtcactacgtcctacgtcgtacggacggtacgtcggtccctacctacggttcggtacggttacgaggtcggtacgtaggtcgacgttcggtacggggaactacggttacttaacctaacgttccctaaccgaacctaaccgtaccctacccgttaccgttacgtaaccggtaccccgttaaagtacggggttaaccgtttacggttagttaaccgttaaccgtaaaccgttttacctaaccggttttaaacgttaacccgtaaaccgttaaaacgggttaccgtaaacccggtttttaacccggtaccccgttttacccccggttaaggttacccgttttaaacccgggtttccgggaaaaccgggtaaccgggttaaacgttaaacgggttaacccgaaggttaaaccctaaaccggtaaacgttggtacccgggtacctagtcccgtaaaccgtnttaacccgtttagtccgtttaccg

SEQ ID NO: 207334 - DNA, 892 bp, Homo sapiens
  misc_feature: GYAE6OF01B8DNS.17.25.C03.1.454.CMB.1.raw
  modified_base (156)..(156): a, c, t, g, unknown or other
  misc_feature (156)..(156): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctanaagtcgccccacctccgaggtgcgagcgtggtcgacgtaggtcggtggggcgtaggaaggtaggaaacgacggtccggtcggggtccctagtaggtacggtacggttccctcgtgacgtacggttcgttacgtaggttactttaccgttaccgtttacctacgtagtacgtacgtaccgtagggttcggccgccggccgtaccgggccgtacggtacggaaaccgtaccggtacgtagggtaggtacgggtaggtacgggtacggtacccggggaacctaaacccggtaacgtccgggttaggtcctaaccgtaacggtacggtttacccgttaccgtaccctaaccccggtaccgtaccccgggtaacccggaacgtaacccgttaacccgtaaccgttacggtaaccccgaacccgtaaccgttacccccttaaccgtaacccaaaacgtaaacccgtaaccgtaccgtaaccctaggttaacggtacgggttaacggttaacggaccggtaccgtccgttaacgtaaccgttacgtaccggtaaccggtaaccgacccgggttacccgtaccgtttaccgtttaacgttaccgggttacgaccggtacccggtaccggtacccgtaacccggtaaaccggtcggttaacccggtaggtaccccgtaaccggtccggaccggttaccggtccccgtttacgggttaccgttaccggggttccgggtaaccgggg

SEQ ID NO: 207335 - DNA, 606 bp, Homo sapiens
  misc_feature: GYAE6OF01ASB76.17.25.C03.1.454.CMB.1.raw
  modified_base (281)..(281): a, c, t, g, unknown or other
  misc_feature (281)..(281): n is a, c, g, or t
  modified_base (509)..(509): a, c, t, g, unknown or other
  misc_feature (509)..(509): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgcaaggcttctggattcacgtttacctcctatagtatcaactgggtncgccaggccgctggacaacgcctgagtggatgggatggggaccgaaaccctaacacgtggtcgtacacaggttcgtccttccacccctatcccgtccggggaactacggtaccttaaccagtcgaaccctaacgaaccctccctaccaactaaaccacacgtcctaacagtggagttggaggacgcctagactatcgagaccgacgaccggtccgtacttagttacgngtcgcgacgtaccgtaccccaggtcgtcccgggagaccgacccgtacggccgtacggtcccgggttacctttcggtacccgttcgggtacccggggg

SEQ ID NO: 207336 - DNA, 899 bp, Homo sapiens
  misc_feature: GYAE6OF01CBNX7.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccagtggactggacctggaggatcctcttcgttggtggcagcagctacaagtcgcccactcccaggtgcagcgtggtcgcgtagtcgtgggggactgggtaggtacggaaggtaacgccggttggggccctcgtaggtggaacggtcctccgtgacgaaggtccttgtcggtacttaccttaaccgttttacctaccgttaagtaacggttacttaaccgaacgttcgggggtacgcccggtacccggacggggtcccgtacggtacgggaaaccaacccggtaccgttaggtacgggtaggggtaagtagggggacggttacgggggaaacccctaaaccccgttaaagttaccggtgggttaccgtaaccgacgttaacgtttcggttaccctttacccgaccccgttacgttaccccgggtccggggtaaactaacggtttaacccctaaccgtacgttaaccggaaccccgtaacccggtaacccttaccccggaacctaaacctaaaaccgaccgtaccgtaaccgtaacgtaaggttacgggtaacggtttagggaacggtaccgtaccgacgtaacctacgttaccgaaccggtaaccggtaaccccgtaccggggttaccccttagtttaaaccgttcgtacggtaccggtaccggacggttaaccccgtacccggtaaaggttccgggtacccggacgggttaacccgtcccgggtaaccggtacgtacccgggttcccggtttaacgtttaccggtcccggggttcgggtacccggggg

SEQ ID NO: 207337 - DNA, 656 bp, Homo sapiens
  misc_feature: GYAE6OF01CMWEA.17.25.C03.1.454.CMB.1.raw
  modified_base (220)..(220): a, c, t, g, unknown or other
  misc_feature (220)..(220): n is a, c, g, or t
  modified_base (359)..(359): a, c, t, g, unknown or other
  misc_feature (359)..(359): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggcctnagtgaaggtctcctgcaaggcttcgtggtattcgtacgtttacctcctatagtatcaacgtgggtcgcgccgaggccgcgtcggaaccgacgaccgtggaggtggagtgggatcgggacaacctacgacgtggcgtcanagtctcttacaccctacgtccgtaccggactacgtaacgttacccagtaccgaaccgtaccgaaccttaccctaccaaacttaaaccgaacccgaacgtaccccaaagtacgtacgggtacggttacggaacggtacgtacctgtaccgtataccggtacgacggtacccgtacgggtcccttagttacgttaaccgtggtcgaccgtagaccgtccctaaacggtgtacccggggtagaccgtcccggacgtacggtaccgtccggttctttacggtacgtttccggtaccggggg

SEQ ID NO: 207338 - DNA, 699 bp, Homo sapiens
  misc_feature: GYAE6OF01CW8ZV.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccacctcccaggtgcagctgggtgcagtcgtggggctggaggtgaagaagccgtggggcctcagtgaaggtcctccgtgcgaaggcttcgtggatttcctaccgtttacctcctatagtatacaacgtgggtcgcgccgacggcccgcgtcggaacaccgaccgtggacggtggagtgggagtcgggacccgtaaacccgtaacgacgtgggtcgtcgaacgtaggttcgttccttacccacccgtactcccggttacccgggactaacgtaacccttaccgagtaccgaaccctaaccgtaacccttccctaacctaaacgtaaaaccacctaaccgtacccttaacacgttacgggtaaggttacggaacgggtacgtccgtagaccgtacgtcgtacgaaccgtaccgtaccgggtcccgttacttacttaccgtgtacgacggtacgtacccgtcccgacggtaccgtcccggtaggccggacccgtacggcgtaccggtcggttaccgtttcgtccgtttcgggaccgggg

SEQ ID NO: 207339 - DNA, 705 bp, Homo sapiens
  misc_feature: GYAE6OF01BARQ9.17.25.C03.1.454.CMB.1.raw
  modified_base (218)..(218): a, c, t, g, unknown or other
  misc_feature (218)..(218): n is a, c, g, or t
  modified_base (245)..(245): a, c, t, g, unknown or other
  misc_feature (245)..(245): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctnagtgaaggtctcctgacaggtcttcgnggattctacgtttacctctatagtactcaacgtgggtgcgccaggccgcgtcggacaacgcctgagtggagtgggagtcgggaccaaaccctaacgacgtggtacgtacgacgtaggttcgtaccttccaccctacgtcccgtacgggaccagtaaccgttaccaacgttacgaaccccgtaacgaaacccttccctaaccgtaaactaaaacctaacccgtaacgtacccgtaaacgtacgttacgggtaacggtttacgggaaggtaaccggtaccgtacgaacctacgtaccggtacgtaacccggaccgtaccgggtaccgttaccgttaacttacgtacggtcggacggtaacgtaccgtaccccgaacggtaccgttccgggtaggtaacccggccgttaccgggaccgtaacgggtacccggttaccgtttcggtcccgttgggtacccgggg

SEQ ID NO: 207340 - DNA, 768 bp, Homo sapiens
  misc_feature: GYAE6OF01DF1H8.17.25.C03.1.454.CMB.1.raw
  modified_base (194)..(194): a, c, t, g, unknown or other
  misc_feature (194)..(194): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtcgcccactcccaggtgcagctggtgctagtcgnggggctggaggtagaagacgccgtcggggcctcgagtgaacggtctccgtgcaaggtcttcgtggtactttcctaccgttttaccttcctaagttacgtactacgaacggttggggtcgccgccgtacgggccgtacgtacggaacaccggtacgtggacggtggagtgggagttcggggaacctaacccgtaacgtacgttgggtacgtaccgtacgtacggttacgtcctttacccgacccgtaaccgttcccggttaacccgggactaacggttaccccttaacgtacgtacccggaaccctaaccgtaacccttaccccgtaaccgtaaactaaaacccgaccgtaaccggttaacctaaccgtaggttacgggtaaggtttaacgggacggtaccgtccgtaacgtacgtaagttccgaacgaacccggtccgaaccgggttccgttacgttacgtttacgtcggttacgccggaacgtacccgtccggacgtaacgggtcccggtaggccgtacccgtacgggtactaccgggttccttacgtttacgccggtttcgggtaaccgggg

SEQ ID NO: 207341 - DNA, 660 bp, Homo sapiens
  misc_feature: GYAE6OF01A2T58.17.25.C03.1.454.CMB.1.raw
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtacccactcccaggtgcagctggtgcagtctggggctgaggtgaagaagcctggggcctcagtgaaggtctcctgcaaggcttcgtggattcacgttacctcctatagtatcaactgggtacgcgccgagccgctggacaacgcctagacgtggagtgggagtcgggacgaaccctaacgacgtggtgtcgacgtagtcgtactcaccctatccgacggtacacgtacttaccatcgaccacgaacctcctaccaataacacacgtaccaagtctaggtagttacggacggacgtacccgttagaacctacgttaccgaggtaaccgaaccgtacccgggtaccgttaccttaacgttaaccggttgtacggaacccggtaacgtaccggttacccccaacgggttaaccgtcccggggttaggaccggtacccgtaccgggtaccaacgggttcccggtaccgttttacgaacccgttccgggtacggggtaaccccgg

SEQ ID NO: 207342 - DNA, 710 bp, Homo sapiens
  misc_feature: GYAE6OF01DHRFI.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctggaggtagaagagccgtggggcctcgaggtagacggtcctccgtgacgaaggtcttcgtgtattcctacgtttacctctatacgtactacgacgtgggtcgccgcgacggccgctacggaaccaacgtacctggaggtggtagtgggacgtcgggaaccaaccctaagcgtggtcgtacacgtagtcgtccttaccgaccctctacccggtacggactaccgtaccttaccgagtaccgaaccgtaaccgaaccccttcctaaccgaaacctaaacgacctaaccgtacccgtaagtacggtacgggtagttagggaacgtaccgccgttacaacttacgtccgtaacgaccggtaaccgtaccgggtaccttacgtttacttacgtacggtccggtaaccgtacggtacccggtaccccgtacggtaccggtacccgggtacggaccgtaccccggtaggacccgtacgggtaccccggttcttcggttaccccggttccggacccgggggg

SEQ ID NO: 207343 - DNA, 757 bp, Homo sapiens
  misc_feature: GYAE6OF01AXR65.17.25.C03.1.454.CMB.1.raw
  modified_base (314)..(314): a, c, t, g, unknown or other
  misc_feature (314)..(314): n is a, c, g, or t
tcagcgtagactagcacgaccggtgctcgatttagtagtgtagatttggggtttgggggggagtcagtctcagtcaggacacagcatggacatgagggtccccgctcagctcctggggctcctgctactctggctccgagctgccagatgtgacatccagatcgacccagtcctccactccctccctgtctgcctcgtgggtgggggtcagacgtccaccatcctacgttcgccggacaagtccgaaccggtacgtttaaaaaccttattttaaagttggtactacgagacaacgaaaaccgtagggaaaaccnccccaagacccctcctgacttccgtcgttggtcgctactcccatcgtaggacggtaaggtccggacctcccgagtaccgggtacggttcgaagggtcgggactagggtggaacttcggtacgggaactagtacttttacaattcccgttaccaaccctactacccacctacttcgtacgacccgtaaccgtggaacgttattcgtacgtaactacttaccgttaacctaacgttcggtaaacctaacgtaacggtttaaccttaacccgttacccggtttaccccctacggttaccggtttaaccggtttcccgggaacccgggtaaacggggttaaaccctaaagggttacggaaacgtaacgtaaacccgaaaaccggttacgttcgggtacggtacccttacggtacccctaactttaccgttccgtttacgttaccccg

SEQ ID NO: 207344 - DNA, 868 bp, Homo sapiens
  misc_feature: GYAE6OF01A4Y3H.17.25.C03.1.454.CMB.1.raw
  modified_base (223)..(223): a, c, t, g, unknown or other
  misc_feature (223)..(223): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatccttcttcttggtggcagcagctacaagtcgcccactcccaggtgcagctggtgcagtcgtggggctggaggtgaagagccgtggggcctnagtgaaggtctccgtgcaaggtcttcgtggtattcctaccgttttacctccttatagttactacgtaacgttggggtcgccgccgacgggcccgacggtacgggaacccaaaccggtacccgttaggagggttaggggtacggttagggggtacgtcgggggaacccgtaaaacccccgttaacgtaaccggttgggttacgtaccgtaacgtacggtttcgttaccgttacccgaacccccgtcgttccccggtacccggggtaacctaaccggttaccttaacccgagtacccggaacccgtaacccggtaaaccccttcccctaaaccctaaaccttaaaacccaacccgtaacccgtaccctaaaacgtacggtttacgggtaacggtttacgggaacgggtaaccgtccccgtaaggaacccttaacggttaccgtaacggaaccccggtaaacccggtacccgggttaccccgtttaaccgtttaaccgtttacggtacggttaccggaccggtaaccggtaacccgtacccggaaccgggtaccggttacccgggtagtaccccgggtacccgtacccgggacgtaccgggttaccgggtttacccttttacgggtcccggttcggggtacccggggg

SEQ ID NO: 207345 - DNA, 858 bp, Homo sapiens
  misc_feature: GYAE6OF01D0YI2.17.25.C03.1.454.CMB.1.raw
tcagcgtagactagcacgaccggtgctcgatttagtagtgtagatttgggtttgggactcaacaaccacatctgtcctctagagaaaaccctgtgagcacagctcctcaccatgactggacctggaggatcctcttcttggtgcagcagctacaagtcgcccactcccaggtgcagcgtggtgcagtcgtggggctggaggtgaagacgccgtgggcctgagtagaaggtcctcctgacaggtcttcgtaggtacttcgtaccgtttacctcttaatagtactcgtaacgtggtagccgccgacgggccgtcgtacggaacctaaccgtccgaggtacggtaggtacggtagggtacgttacgggggaaccgtaaaacccctaaacgacgttcgggttagtacccgtaacgtacgtttcggtttaccttaccccgtaaccccgtaccgttaccccggttacccggggaacctaacggttaaccccttaccgacgtttaacgaaccccgtaacccggtaacccctttccctaaccctaaacgtaaacctaacccgaaccgtaccctaacgtaacgtacgggttaacggttcgggtaacggtaacgttacccgacgttaacctacgttaccggttaaccggaacccggtaaccgtaccccggggtaccgttttaaccgttaacgtttaccgtttacggcggttaaccgggaccggtaaaccccggttaccccgtaaccgggtaacccggtttaaccgggtcccggaaacccgggttccccggtaaccccggttccgggacccgggtttccccggtttccgttttaccgggtcccggtttaccgggggttaaccccggggg

SEQ ID NO: 207346 - DNA, 736 bp, Homo sapiens
  misc_feature: GYAE6OF01ASUPC.17.25.C03.1.454.CMB.1.raw
  modified_base (350)..(350): a, c, t, g, unknown or other
  misc_feature (350)..(350): n is a, c, g, or t
  modified_base (561)..(561): a, c, t, g, unknown or other
  misc_feature (561)..(561): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctaacaagtcgcccactcccaggtgcagctggtgcagtcgtgggctggaggtagaagacgcgtcggggcctcgagtgagtcctccgtgacgacggtcttcgtggtactttccgtaccgttttaccctccttaagtacgtactacgtaacgttgggtcgccggccggacggccggcgtacggaccaaccgccgtaggngtaggacggtgggacgtcgggaacccgtaaaccgtacgtacggtggtcgacgtacgtacggttcgttaccttaccacccgtacgtacccggttacccggacgtaacgtaaccttaccgaacgtacccgaacccgaccgttaaccctaccctaaccaaactaaaccaccgtaaccgtacccttagaggtacgggtacgtacggacggtaccncgtagactaccgttcgaacgaaccggccgtaccgtccttagttaacttaggtcgtacgacggtaccgtacccgtacccgtaacggtcccgtacgggtacgacccgggttaccgtcccgggaacgtccgggttcccgtttacccgttacggttccccgggttcgggaccccggggg

SEQ ID NO: 207347 - DNA, 919 bp, Homo sapiens
  misc_feature: GYAE6OF01CIBW7.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggactccttcttcgttgggtggcagcagctacaagtcgcccactcccgaggtgcagtcgtggtagcgtacgtcgtcgggctaggagggtagaaaggaacggtccgtcggggccctcgaggtacggaacgttcctcgtggaccgtaacggtcgttcgtaggtactttccgttaaccgttttaccctacttaattacgtactacctaacgttcggggtcggccgtccgacggcccgtacgtaaccggaaccgtaaccgaccgttggacggttgggaaggttaggggacggtacggggtaacccgtaaaccccgttaaacgtcggttacgggtaccgtaccgtaaacggttacgttacccgtttacctaaccccgtaaccccgtacgttacccccgggtaaccggggtaactaaacccggttaaccttaacccgaaaccgttacccggaaaccccgtaaccccgttaaacccttacccccttaaaccaaaacccttaaaaacccgacccgtaacccgtaaacccttaaacggtacggttaacggggttaaccggttagggaaccggtaaccggtaccgtaacgtaacgtacgttaccggttaaccggaacggtaacccggttaaccgggtcccgtttaaactttaacgttacgggtcgtaaaccggcgtaaccggtaaaccgtaccccgaacggttccggttaccgggtacgaacccgggttcccgtaacgggcccgttaacgggttaccccggttccgttttacggttacccggttccggggtaacccggggg

SEQ ID NO: 207348 - DNA, 682 bp, Homo sapiens
  misc_feature: GYAE6OF01BG8R5.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgccagtcgtggggctggaggtgaagaagctggggcctcagtgaaggtctcctgcaggtcttctggacttctacgtttacctctatagtactacaacgtgggtcgcgccgaggccgtcgtaggaccaacggccgtggagtggacgtgggagtcgggacctaacccgtaacacgttggtcgtacgacgtaggttcgttaccttaccgaccccgtaattccccgtccggggaactagtacccgttaaccacgttacgaacccgaacgtaaccttcccctaaccgtaaactaaaccaaccgtacgtaccctaagacgtacgggtagttgggacgtacgtccgtagaacctatacgtcgaaccggacgaccgggtcctacgttacgttactggtacgcggtacgtaccgtaccccgtacggtacgtcccggtagacccggtacccgtacgggacggtaaccggcggtttaccggttttacgtcccgtttcgggtacccgggggg

SEQ ID NO: 207349 - DNA, 757 bp, Homo sapiens
  misc_feature: GYAE6OF01CT4Z8.17.25.C03.1.454.CMB.1.raw
  modified_base (183)..(183): a, c, t, g, unknown or other
  misc_feature (183)..(183): n is a, c, g, or t
  modified_base (589)..(589): a, c, t, g, unknown or other
  misc_feature (589)..(589): n is a, c, g, or t
tcagcgtagactagcacgaccggtgctcgatttagtagtgtagatttgggtttgggggactcaacaaccacatctgtcctctagacgaaacctgtgagcacagctcctcaccatggactggacctggaggatcctcttcgttggcggcagcagctaacaacgtcgacccacctccgagggtcncgagtcgtggtgcgtagtcgtggggactggaggtagaagacgccgtggggccctgaggtagtaacggtcctccgtgacgtacggtcttagtaggtattaccgttacgtttacctcgtaatcgtaactacgaacgtgggtacgccgacgcggtccgagtacggaacgaacgtacgtagtaggtaggtagtgggacgtacgggaaccgtaaaccctaaggtccgttaggtcgtaacgtacgtacggttctaccgttaccaaaccccgttcgttacccggtaccggggaaactacggttaaccttaacgagtaccgaacccgtaacgtaacccttcctaacaaacttaaaccacgtaacctactaaccgtagtttacggaggttacgaacgggcctaacgtcgtaaacncttaacggacggaccgtacccggttggtccctttaaccgttaagtacccggtggaccggtaacggtaccacccggttaccggaagttcccggtaacgggacggtccctaacccgggtcgacggtccggtacccgtttcggtttaacacccggttttcgggggaccggg

SEQ ID NO: 207350 - DNA, 822 bp, Homo sapiens
  misc_feature: GYAE6OF01CVP2F.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctggaggtagaagagccgtggggccttcgagtagaacggtctcgtgcaaggtcttcgtggtattacctaccgttttacctcctaagttagtacttacgaacgttgggtcgccgtccgagggcccgtacgtacggaaccaaccggtaccgtggaaggttgggaagttggggaacgttaccggggaacccgtaaaaccccgtaacgtacggtagggttacgtaccgtaaccgtacggtttcgttaccctttacccgaaccccgtacggttaccccggtaccggggaacctaaaccgggttaaaccctttaaccgaacgtaaccggtaaccccgtaaacccggttaaccccttaacccctaaccgtaaaacttaaaacccgaaccgtaaccgtacccttaaacgacggttacggggtaacggtttacggaacggtaccgtacccgttaggaacttacgttaccggtaacgaaccggtaacccggtaccgggtaccgtttacgttaacgtttacgtggtaccggtacgtaaccggtaccgtaccccgacggttaccggtaccggtacggaccgtacccggtacggccgtacgggttccgttaccgtttacggtccgttcgggtacccgggg

SEQ ID NO: 207351 - DNA, 640 bp, Homo sapiens
  misc_feature: GYAE6OF01DTVTL.17.25.C03.1.454.CMB.1.raw
  modified_base (314)..(314): a, c, t, g, unknown or other
  misc_feature (314)..(314): n is a, c, g, or t
  modified_base (344)..(344): a, c, t, g, unknown or other
  misc_feature (344)..(344): n is a, c, g, or t
  modified_base (438)..(438): a, c, t, g, unknown or other
  misc_feature (438)..(438): n is a, c, g, or t
  modified_base (478)..(478): a, c, t, g, unknown or other
  misc_feature (478)..(478): n is a, c, g, or t
  modified_base (486)..(486): a, c, t, g, unknown or other
  misc_feature (486)..(486): n is a, c, g, or t
  modified_base (489)..(489): a, c, t, g, unknown or other
  misc_feature (489)..(489): n is a, c, g, or t
  modified_base (523)..(523): a, c, t, g, unknown or other
  misc_feature (523)..(523): n is a, c, g, or t
  modified_base (593)..(593): a, c, t, g, unknown or other
  misc_feature (593)..(593): n is a, c, g, or t
tcagcgtagactagcacgaccggtgctcgattttagtagtgtagatttgggtttgggggtacggtacgaacgaacccacatctcgtaccgtcgtagagtaaaccctgtggagcacagctcctcaccatggactggacctcggaggatccttcgttcttgggtggcgttcgcgtaggcttaacgtaagtcggccctactccgagtgacagctggtgcgaggtcgtgggggctggaggtacgaagtaacgcggtggggcctgaagtggaacgtctcctgcaaggtcttccgtggtactttcctaaccgttttaccnccgttaagtactacgtcctaagttcgggcnccggtccgacggccacgtcggactaacggaccgtggagggtgaggtcggagtcgggacctaaccagacgttggagtcaagtgttagtccgttanaccctatccgtcgggactacgacgtacgatcgacactacnctacgaanaanacagactaatactagattacgagtacgctagacntcgtacgacgacgacgtcgacttagttacgtacgtaggacgtagaccgggtacgacgacggtacgggtancggaccgttagacgtggcccgtccgtttcggtaccgttcgggccggg

SEQ ID NO: 207352 - DNA, 867 bp, Homo sapiens
  misc_feature: GYAE6OF01CTMM7.17.25.C03.1.454.CMB.1.raw
tcagcgtagactagcacgaccggtgctcgatttagtagtgtagatttgggtttggggactcaaacaaccacatctgtcctctagagaaaaccctgtgagcacagctcctcaccatggactggacctggaggatcctcttcgttggtggcagcagctacaagtcgcccactccaggtgcagctggtgcagtcgtggggctggaggtagaagaacgccgtggggcctgagtgaaggtctcgtgacaaggtcttgtggattactaccgtttacctcctaatacgtatacaacgttgggtcgaccggtccagggtcccgtcgtacggaaccaacccggtacctagggacgtggaggtgggaagtcggggaacctaaccccgtaagtaccgtggtaccgacgtacgtacggttcgtaccttaccgaccccgtaaccgttcccggtaacccgggaaacgtaccggttaaaccctttaacccgaagtaaccggtaacccctaaccggtaaaccctaccctaaccgtaaactaaaaccgacctaaccggtaccctaaacgtaggttacgggtaacgtttacgggaacgggtaccgtcccgttaaggaaccctacggttaacccgtaacgggtaacccggtaacccggtaacccggggttaccccgttaacgtttaacgttaaccgttgggttaccggaaccggtaaaccgggttaccccggtaccccggtaaaccgggttacccgggttacccggggttaaaccgggtaacccggtaacccccgggttaccgggaaccccggttaccggggttacccccggtttacgggtttttacccgggtaccggtttttccccggggggtaacccggggggg

SEQ ID NO: 207353 - DNA, 786 bp, Homo sapiens
  misc_feature: GYAE6OF01C8ARO.17.25.C03.1.454.CMB.1.raw
tcagcgtagactagcacgaccggtgctcgatttagtagtgtagatttgggtttggggactcaaacaaccacatctgtcctctagagaaaaccctgtgagcacagctcctcaccatggactggacctggaggatcctcttcttggtggcagcagctacaagtcgcccactcccgaggtgcagctggtgcgagtccgtggggctggaggtaggaaagaacggccggtcggggccctacgtaggtaggtaacggttcctcccgtgaccgtaaggtctttcgtggtactttaccgttaccgttttaccctaccgttattaacgttaactacctaacggtggggtacgccgacccggacgggcccgtacggtacggaacctaaaccggaccgtaggaggtgggacgtgggacgtcgggaaccaaaccctaacgacgttggtacgtacgtaacgtagttcgttaccttacccaacccgtaccgtcccggtaccgggtactaccgtaacctttaaccgacgtacccgtaaccgaaccgtaaccctccccgtaaacctaaactaaaaccgtaccaaccgtacttaaaccgaggttacgggtaacggtttacggaacgggtaccgtacgttacgaacgtacttacggtaacgaaccggaccgtacccggtccgttacttacgttacgtcggacgtacggacgtaccggtaccctacggtacggttaccggagacccgtaccggtacggccgtaacggttccggttccgtttacggtccggttcgggtacccgggg

SEQ ID NO: 207354 - DNA, 601 bp, Homo sapiens
  misc_feature: GYAE6OF01D5HD2.17.25.C03.1.454.CMB.1.raw
  modified_base (280)..(280): a, c, t, g, unknown or other
  misc_feature (280)..(280): n is a, c, g, or t
  modified_base (429)..(429): a, c, t, g, unknown or other
  misc_feature (429)..(429): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaacgtgggtncgccaggccgctaggaccaacggacctggagtggagtgggatggggaccaaccctaacacgtggtgtcacgtagtcgtcttcaccctatcccgtacgggacacgaccttaccatacgaccacgaactcccacaactaaacacagcctanagtggagttgaggactcctagactagtcgtgaacgaccgaccggtcccgttacttacttaacgtgttcggaccggtaagtaccggtaccccgaagtccggtaccgggtacggaccgccccggttacggaccgacggtcccggtaccgtttcggtcgttccgggtaccggggg

SEQ ID NO: 207355 - DNA, 705 bp, Homo sapiens
  misc_feature: GYAE6OF01AY3XP.17.25.C03.1.454.CMB.1.raw
  modified_base (282)..(282): a, c, t, g, unknown or other
  misc_feature (282)..(282): n is a, c, g, or t
tcagcgtagactagcacgaccggtgctcgatttagtagtgtagatttggggtttgggggagtcagtctcagtcaggacacagcatggacatgagggtcccccgctcagctcctggggctcctgctactctggctccgagctgccagatgtgacatccagatcgacccagtctccatccctccctgtctgcctcgtgtgggggtcagagtcaccatcacttgccgacagtcacggtacgttaaaacctatttaaagtggtatcagacagaaacctggaaaacncccagacctcctgatcctacgtgtcgctacgtcccactcgtgacgtaaggtcgccgtacccgtaagtcggtaggttcaggtcggactaggtggactcgtagggactagtactttcaatctacactactaccaccactctacgacctaacgtcgtaacggttcttacgtagacctaactaccgttaacctaacgtttacgtaaccgtaaaccttaggtaaccgttttacccgtacccgtttacccccgttacggttaccctttaacccgggttttaccgggaacccgggtaacggggttaaccccgtaaaagttaccggaaaggttacccgtaaaccggtaaaacccgggtacgttaccgggtaacggttacccgtacgtaccccgttaaaccgttacgtttcccggtttaccgtttaaccccg

SEQ ID NO: 207356 - DNA, 848 bp, Homo sapiens
  misc_feature: GYAE6OF01DVAEY.17.25.C03.1.454.CMB.1.raw
  modified_base (285)..(285): a, c, t, g, unknown or other
  misc_feature (285)..(285): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcgagtgaagtctcctgcaaggcttgtgattctacgtttacctcgtatagtatcgaacgtgggtcnccgccgacggtcccgcgtcggaaccaaccggtaccgtaggaggtgggaggtaggggacgtacggggaaccccgtaaaccctaacgacggttgggttacgtaccgtaacgtaggttcgttacccgttaccgaaccccgtaacgttccccggtaacccggggaacctaacggtaacctttaacccgtacgttaccggaaccctaacccggtaaacccttccctaaccctaaacgtaaaaccctaaccgtaaccggtaccccttaaactacgggttacgggttaacggtttaacgggaacgggtaacccggtaccccttaggaacccttacgttaaccggtaccgggaaacccggtaaccggtaaccccggggtttcccgtttaaccgtttaaacgtttacccggttacgggtaccggaccgggttaaacggtcccggttaaccccggaaccgggttaccggtttcccggggaacggtaccccgggtacccgtaccggggaacccgtcgggtaccccgggtttacccgtttttcgggtaccccgttttggggaaaccccggggggg

SEQ ID NO: 207357 - DNA, 671 bp, Homo sapiens
  misc_feature: GYAE6OF01BWCVX.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagaagccgtgggcctcgagtgaacggtctcctgcgaggtctcgtggacttcaccgtttacctctacttagtactcaacgtgggtagccgtccgacggtcccgcgtaggaccaacgtaccgtggacggtggagtcgggagttcggggacctaaacccgtaacacggttggtacgtccacgtagttcgttccgttacccacccgtacgttcccggaccgggacaacgtacccttacataccgacctaacgaacctcccacctaactaaaccactacgaccctaagtacgtagggtacgttaggacgacgaccttagacctatccggagtaaccgacggtacccggtccgttattaacgttacgtagtcgaccggagtaccgtacccgacgtacggtcccggagtacccggaccgtccgggaacgtcccggtaccgggttccctttacggtcgtttccgggacccggggg

SEQ ID NO: 207358 - DNA, 762 bp, Homo sapiens
  misc_feature: GYAE6OF01CLIJA.17.25.C03.1.454.CMB.1.raw
  modified_base (375)..(375): a, c, t, g, unknown or other
  misc_feature (375)..(375): n is a, c, g, or t
tcagcgtagactagcacgaccggtgctcgatttagtagtgtagatttggggtttggggggagtcagtctcagtcaggacacagcatggacatgacgggtccccgctcagctccgtggggctcctgctactctggctccgagctgccagatgtgacatccagactcgacccagtcctccactcctccctgtctcgtcctcggtgggtcgggggtacagacgtacaccactcgtacgtcggaccggaacaacgtaccgaaccggtaacgtttaaaacttaagttttaaagttggtaatacgaagaccgaaaacggtaaaccgaacgggaaaaccgcccgtaacgtaaccctcgtacgtctttccgtcgttcgggtanacctaacctacctaaccttcgtacgggacgtaacggggtccggtaccgtacctaggtacgttacggttacgaggtcggacgaggtcggtagtcggtacggtaatagttacttaacacttacacctacctacaccctactaccgtctaacgactaacgtagagttagtacgactactaccttctaaccgtatactaacgaactacgttaacgttcccgttaacccgtcccgttacgtacgtttaaccgggttcgggaaacccgggttaacgggttaaaccgtaaaaggtacgtaacggtaaaccgtaaaaccggtaaacggttaaggtccgggtaccgttaacccgtaccgtaacctaacccgttctttaaccggttcttttaacccc

SEQ ID NO: 207359 - DNA, 788 bp, Homo sapiens
  misc_feature: GYAE6OF01DCUX0.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtagaagaagccgtgggggcctgaggtgaaggtcctccgtgcgaaggtcttctggattccacgtttacctcctatagtatacaacgtgggtcgcgccgacggcccgtcgtacggaaccaaccggtaccgtaggaacggtgggaagtcggggaagttcggggaaccgtaaacccctaacgaccgttagggtcggtacaacgtagttcgttaccttaccgaacccctagttcccgtacccggggactaacggtaacccttaccgacgtaccggaaccctaacccggtaaccctacccgtaaccctaaactaaaacctaacctaccggttaacttaaaccgacggttacgggtaacgggtttaacggaacggggtaccgtacccgtacggaacctacggttaccgttaacggaacccggtaacccgtaccgggtaccggttaccttaacgtttacgtggttacgaccggtaacggtaccgttaccccgaacggtaccgtaccggggtacggtaacccggtacccgtaaccgggaccggtaaccggttcccgggttacttttaccgggtccgtttccggggtacccggggg

SEQ ID NO: 207360 - DNA, 839 bp, Homo sapiens
  misc_feature: GYAE6OF01D6F38.17.25.C03.1.454.CMB.1.raw
  modified_base (288)..(288): a, c, t, g, unknown or other
  misc_feature (288)..(288): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtcctcctgcaggcttctggattcacgttttacctccttatagtatcaacgtgggtcnccgccgacgggcccgcgtacggggaaccaaaccggtaccgtgggaacggtgggaaggttagggggacgttacgggggaaccccgtaaaaccccttaaacgacggttcgggttacgtaccgaacgttaggttcgttacctttacccgaacccctacgttccccggtaccggggaacctacggtaacccttaaccgaacgttaccggaacccgtaaccggtaaacccttacccctaaccaaacttaaaacccgaccctaacgtaaccccttaacgaacggttaggggtaacgtttacgggaacggaccgttacccgtaaggtaaccctagtaccggttaacggaacccggtaacccggtacccggggttacccgtttacgtttaacctttaacggttcgggtaccgggaaccgtaaccgggtaaccccggttaccccgtaaacgggttaacccgggttcccggggtaacgaaccggtccccgggtaacgggacccgtacgggtccccggtttacccgtttttcggggacccgtttccggggtaccccgggggg

SEQ ID NO: 207361 - DNA, 840 bp, Homo sapiens
  misc_feature: GYAE6OF01EO4W8.17.25.C03.1.454.CMB.1.raw
  modified_base (316)..(316): a, c, t, g, unknown or other
  misc_feature (316)..(316): n is a, c, g, or t
  modified_base (763)..(763): a, c, t, g, unknown or other
  misc_feature (763)..(763): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccgaggtgcagctggtgctaggtcgtggggctggaggtgaacgacgccgtggggcctcgtaggtagaacggtcctccgtgacgaggtcttcgtggtacttccgtaccgtttacctcttaagtagttactaccgtaacggtggggtcnccggaccgtaggggcccgtacgtagggaacccaacgggtcctagggtaacgtcgggtagtggggtaacggtccggggaaaccctaaacccgtaacgacggttcgggtactaccgtacgtacggttcgttaccctaccgaacccctacgtaccccgggtacgggaacctacggtaacccttaaccgaagtacccgggtaaccctacccggttaaacccttacccgtaaaccgaaacctaaaacccgtacccgtaaacgttaccctaacgtaacgggttacgggtaacggtttacgggaacgggtaccgtaccgtaaacgacgtaccgttacgaacgggttaaccccaaccggtacccgggttaccttaccggttaaccgtttacggtcggacggtaaccggtaccggtaacccgtaacccgtacggggtaacccgttacccggggganacccggtacccggtaaccgggaccgttaccgggttaccgtttacccgtttagggtcccggtcggggtaacccggggg

SEQ ID NO: 207362 - DNA, 694 bp, Homo sapiens
  misc_feature: GYAE6OF01BO836.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcgagtcgtggggctggaggtgaagagccgtggggcctgagtgacggtctccgtgcgaggtcttcgtggtacttccgtacgtttaccctcgtaatagtactccaacggtgggtacgccgccgacggtcccgcgtaggaaccaacgtaccgtaggaggtgggagtgggagtcgggaccgtaaccctaacgacgtggtcgaccagtagttacgtcttaccgccctacgtcccgtaccggacacgtactaccgataccgaaccaccgtacctccctaacgaactaaccacacgtacctagtacgtaggtaggtacggacgtacgtaccgtagacgtacgtcgtaacgaccggtaaccgacccgggtcgttaccgttaacgttacgtaggtcgaccggtacggtaccgtaccccgtaacggtaccggttcccggtacggaccggtccccggtaccggaccggtacgggttacccggttacccggtttagttacccggttcggggtaccccgggg

SEQ ID NO: 207363 - DNA, 588 bp, Homo sapiens
  misc_feature: GYAE6OF01BDT32.17.25.C03.1.454.CMB.1.raw
  modified_base (281)..(281): a, c, t, g, unknown or other
  misc_feature (281)..(281): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcgtggattcacgtttacctcctatagtatcaactgggtncgccaggccgctggacaacggacctggagtggagtgggatggggacgaaccctacgacgtggtgtcacgtaggtgtaccttcaccctagtcccgtaccgggacagtacttaccatcgaccacgaacctcctacaataaacacacgctacatcgggagttgaggacgacctgaactactcgtagacgtaccgaccgggtccgttactattaccgtgtcggacggtacgacgtacccgacgtacggtccggtggaccggacccgtacggcgtacggcccggtcctttcggtaccgttcggtaccggggg

SEQ ID NO: 207364 - DNA, 968 bp, Homo sapiens
  misc_feature: GYAE6OF01BFNBN.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtgcagcagctacaagtgcccactcccaggtgcaggctggtgactaggtcgtcggggctggaggtgaaggtaacgccgtggggcctgagtggaacggttctccgtgctaaggtcttcgtaggtacttctacgttttaacctcctaagttacgttactacctaacgtgggggtacgccggtaccgtacggggcccgtacggttacgggaacccgtaaaaccgggtacccgttaggtaaggggttttcggggaaagggttacgggggtaacgttaccgggggggaaaccccgttaaaacccccgttaaaccggtaaccggtttacggggttaaccggttacccggtaaaccggtaacggggtttcccggttaaccctttaccccaaacccccgtaacgttcccccggttaacccgggggaaacttaaaccgggttaaccccctttaaacccgtaaagttacccgaaacccgtaacccggtaaacccttccccggtaacccctaaagtaaaacccctaccgaacccggtaccctaaaacggtcgtaaccggggttaggtttaaccggaaacgggtactaccccgttaggaacccctaagttcccggtaaggaacccgtacccggtaccggtacccgtttaaccgttaattacccgggagttacccgggtaacgaacggttaccccgacccggtaaaccgggttcggttaaccccggggttagaaccccgggggtaaccccccttaggggggaaccccacccggggggttttaccccggtaacccgtttttaggtaaaccccgggttttccccggggaaacccggggggg

SEQ ID NO: 207365 - DNA, 786 bp, Homo sapiens
  misc_feature: GYAE6OF01CQDOZ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatgactggacctggaggatcctcttcttgggtgcagcagctacaagtcgcccactcccgaggtgcagctgggtgctaggtcgtggggctagaggtagaagacgccgtggggcctacgaggtgaacggtctccgtggaccgtacggtccttcgttcggtactttacctaccggttttacccttcctaacgttaacgttactaccgaacgttcgggtacggccgccgacgggtccgtaccgtacgggaacctaaaccggaccgtaggtaacgggtagggtaggtcggggaaggttccggggaacccgtaaacccgtaacgtcgttcgggtacgtaccgaacgtacggtcgtttaccttacccgacccgtactcccggttacccgggaactacgtaaccgttaccctacgtaccgtacccgaacgttaaccctcctaacctaacgaaaccgaccgaccgtaacctaactaggtacgggtaacgtacggacgtacggaccctaggacctacgtacggtacgaaccgaccggtaccgtaccgttacttaagttaccgtaggacggtcggaacgtaccggtacccgaacggttacgtaccgggtacgacccggggttaaccaccgggtaccgtaccgggttaccgttccggtttaaccgtcggttaccgggtacccgggg

SEQ ID NO: 207366 - DNA, 905 bp, Homo sapiens
  misc_feature: GYAE6OF01DAGNC.17.25.C03.1.454.CMB.1.raw
tcagcgtagactagcacgaccggtgctcgatttagtagtgtagatttggggtttggggactcaacaaccacatctgtcctctagagaaaaccctgtgagcacagctcctcaccatggactggacctggaggatcctcttcgttggtgcagcagctacaagtcgacccactcccgaggtgcagcgttggagcgagtcgtggggctggaggtagaagacgccgtggggcctgagtagaacggtcctcgtgacgtaaggtcctttagtaggtactttacccgtaaccgttttacctaccgttaagttacgttaactacgtaacggttcgggtaccgaccggaccgaacgggtcccgtacggtaacggaaccgtaaaccggtccgtaggtaaggtacgggtaaggtacggggtaacggttaccggggaaaccccggtaaaaccccgttaacggacggtttcgggttaccgtaaccgttaaacgggttcggtttaccggttacccctttaacccgaaaccccggttaaccggttcccggtaaccggggaacttaccggtaaaccttaccgaacgtttaaccggaaaccctaaccggtaaccccttaccgtaaaccctaaactaaaacccgtacgtaaccgttaacccgtaaacgtagggtaacggggttacggttaaacggggaacgtaccggtaccgttaaccggtaacgtaccgttaaccggtaacggaaacccggtaccggtacccggggttaacctttacgttaagtttacccggaggtaaccggaaccgtaaccgacccgggttacccgtaaccggttacggtacccgggttaggaacccgttcccgggttaacgcggttccgggtaccgtttccgtacggttcccgggttacgggacccggggg

SEQ ID NO: 207367 - DNA, 533 bp, Homo sapiens
  misc_feature: GYAE6OF01DKR32.17.25.C03.1.454.CMB.1.raw
  modified_base (242)..(242): a, c, t, g, unknown or other
  misc_feature (242)..(242): n is a, c, g, or t
  modified_base (381)..(382): a, c, t, g, unknown or other
  misc_feature (381)..(382): n is a, c, g, or t
  modified_base (391)..(391): a, c, t, g, unknown or other
  misc_feature (391)..(391): n is a, c, g, or t
  modified_base (526)..(526): a, c, t, g, unknown or other
  misc_feature (526)..(526): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatccctccctgtctgcctctgtggggtcagagtcaccatcacttgccgacaagtcacggacttaaaacctntttaaattggtatcagcaagaaaacctaggaaaacgcccagacctcctgatctctggtgcatccactctgacgaagtgctccatcgagttcagtggcagtggatcgtggacagtatttcaatctcactatcaccactcnncactgagtntgtagcaatctaactactgtacaacgaagacgttaactacgttcccctcgtacctacgttttcggacctaacggggaaacctaaagttggaagtaaactacgaaaacggtaaactgtaggactcgacacctactnttcgtac

SEQ ID NO: 207368 - DNA, 915 bp, Homo sapiens
  misc_feature: GYAE6OF01B3N23.17.25.C03.1.454.CMB.1.raw
tcagcgtagactagcacgaccggtgctcgatttagtagtgtagatttgggtttgggggactcaacaaccacatctgtcctctagagaaaaccctgtgagcacagctcctcaccatggacctggacctggaggatcctcttcgttggtggcagcagctacagtgccactccaggtgcagcgtggtgcagtcgtggggctggaggtgaagacgccgtggggcctgagtgaaggtctccgtgcaaggtcttcgtggtacttccaaccgttttacctacctattacggtactaccaacggttgggacgtccggaccgtacgggccccgtcgttacggggaaacctaaaaccggtcccgttagggtaacgggttacgggggaacgttacgggggggtaacgttcgggggggtaaaccccgtaaaacccccgttaaaccgtacccgggttttcggggttaccgtaaccgtaaccgggtaacggtttcggttcccggtttaacccctaaacccccggtacgtttacccccggttaacccgggggggaaacctaccgggtaaccctttaaaccccggagttacccggtaaccccgtaccggtaaacccttccccgttacccgtaaacgttaaaacccaacccgtaaccggtaacccttaaaccaaggttacgggggtaaagtttcgggaaacgggtacccgtacggttaaccggactaaccgtttcggtaaccggaaaccgtaacccgggtacccgggtacccggtttaccttaaccgttttacggttagggtaccggtaccgggtacggtaacccggtacccgtacggtacggttaccccgggttggacccggtccgttaacccgggcgtaaccgggtcccggtaccccgttttggtacccgtttccgggggtacccggggg

SEQ ID NO: 207369 - DNA, 704 bp, Homo sapiens
  misc_feature: GYAE6OF01EYAMB.17.25.C03.1.454.CMB.1.raw
  modified_base (593)..(593): a, c, t, g, unknown or other
  misc_feature (593)..(593): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttgggtggcagcagctacaagtgcccactcccgaggtgcagctggtgcaggtcgtggggctggaggtgaaagacgccgtggggcctcagtgaaggtctccgtgcgaaggtcttcgtggtattctaccgttttaccctacctagtacgtactacgtaacgtgggtgccggccgaggcccgtcgtacgggaaccaaccgtaccgtggaacggtggagtgggagtcggggacctaaaccctaacgtacggtggtacgtaccaacggtacgttcttcctaccgtacccctacgtccccgtccggggaactacgtaccttacccgagtaccgaacccgtaacgtaaccctccctacctaaacgtaaaccactaacgacctacgtagtacgggtaaggttgaacggtacgccgtagaccagtacgtcgaacggaccgccgggtccgttacttaagttccnggtacgacggtaacgtacccgtaccgtaacggtcgtcccgggttaggaccggtacccgtacggccgtacgggtcccggttaccgtttcggtacgttcccgggtaacggggg

SEQ ID NO: 207370 - DNA, 566 bp, Homo sapiens
  misc_feature: GYAE6OF01EO2Y9.17.25.C03.1.454.CMB.1.raw
  modified_base (102)..(102): a, c, t, g, unknown or other
  misc_feature (102)..(102): n is a, c, g, or t
  modified_base (559)..(559): a, c, t, g, unknown or other
  misc_feature (559)..(559): n is a, c, g, or t
tcagcgtagactagcacgaccggtgctcgatttagtagtgtagatttgggtttgggggagtcagtctcagtcaggacacagcatggacatgagggtccccgntcagctcctggggctcctgctactctggctccgagctgccagatgtgacatccagatgacccagtctccatcctcctgtctgcctgtggtggggtcagagtcaccatcacttgccggacaagtcacggtacttaaaacctatttaaatggtatcgagacaagaaacctaggaaaacgcccaagtaccctctgactctagtggtgcactccactctgacgagtcggacctccgatcgagtcaggtgcaggtgatcgtggactagtacttcaattcacaaccataccacctctactcactaaccgtgagtattacgagtactatacctactacgtactacgaataacgtagttacgtaccgttccctcgtacttacgtttacggacgtacgggtaactaacggttagaacgtacgtaacgaaacgtacgtcggtacgactccgactaacctcttccgtnttaaccg

SEQ ID NO: 207371 - DNA, 918 bp, Homo sapiens
  misc_feature: GYAE6OF01A1DZN.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactgggacctggaggatcctcttcgttggtggcagcagctacaagtcgcccactccgaggtcgcagcgtggtgctaggtcgtggggctggaggtagaacgagccgtggggcctcgtagtaggacggtcctaccgtggcgaacggtccttcggttaggtactttaccgttaccggttttaacccttacccttaagttaacgttaactccgtaaacggttgggggttacgacccggtaccggacggtccccggtccggtacggggaaaccctaaaccggtacccgttaggggaagggttaacgggtagggttacgggggtaacgttacgggggtaaacccccgtaaacccccggttaaacgtaccggttcgggttacggttaacccgacgttaggttcccgttacccgtttacccgtaacccctaaccggtttccccggggtaacccgggtaaacccggtaacgtaacccgttttaaacccgtaacgtacccggtaaccccgtaacccggtaaccccttacccgtaaccctaaaccgttaaacccgaaccgtaacccgtaaccgttaaacgtaacggttacggggttacggttaacggaaccgggtaccgtacccgtaggtaccctacgttccgtaacggaccgaaccggttaccgggtacctttaaccgttacgtttaaccgtcggtacgtaccgaccggtaccgtacccgtacccggtcgtaccgggtacggacccggaccgtacggcccggttaacgggtcccgttaccgtttacgggtaccggttccgggtacccggggg

SEQ ID NO: 207372 - DNA, 670 bp, Homo sapiens
  misc_feature: GYAE6OF01BRJ13.17.25.C03.1.454.CMB.1.raw
  modified_base (382)..(382): a, c, t, g, unknown or other
  misc_feature (382)..(382): n is a, c, g, or t
tcagcgtagactagcacgaccggtgctcgatttagtagtgtagatttgggtttggggactcaacaaccacatctgtcctctagagaaaaccctcgtgagcaccagctccctcaccatggactggacctgggaggatcctcttccttgggtggcagcagctacaagtcgcccactcccaggtgcagcgtggtgcaggtctgggctggaggtgaagaagcgtggggcctcgagtgaaggtctcctgcgaggtcttctggtacttcacgtttacctccttatagtatacaacgtgggtcgcgccgaggcccgctcgggaccaacgaccgtgaggtggagtaggggagtacgggaccgaaccctaacgacgtgggtagtctaacgngtcgttaccttccaccctacgtcccgtccggggaactacggtaaccttaccgaacttccgaacccaaccgtaacctacccctaaccaacttaaaccaccaacgtaccctaacgaaggttacgggtaggttacggagggacgtaccgtacgactatacgtcgaaccggaccgtaccgggtaccttacgttaacttacgtcgtacgacgacggtaccgacccgtacgacgtccggtgacccgccgtaccggcgtcggtcccgttaccgttcggcgtttccgggaccgggg

SEQ ID NO: 207373 - DNA, 766 bp, Homo sapiens
  misc_feature: GYAE6OF01DSQ54.17.25.C03.1.454.CMB.1.raw
  modified_base (307)..(307): a, c, t, g, unknown or other
  misc_feature (307)..(307): n is a, c, g, or t
  modified_base (386)..(386): a, c, t, g, unknown or other
  misc_feature (386)..(386): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctaacaagtcgcccactcccaggtgcagctggtgcagtcgtggggctggaggtagaaggacgccgtggggccctcgagtaggaaggtcctccgtggacaaggtcttcgtggtattccgtaccgtttacctctatagtactacgaacgtggggtcnccgccgacgggcccgcgtacggaaccaaccggtaccgtggacggtggaagtggggagtcgggaaccctaaaccctaacncgtggtacgtcaagtcggtcgttaccttccaaccctacgtcccgtaccgggactacgaccgttaccagtaccaacgtaaccgtaaccctccctaacgaaactaaaacccgactaacgtaccctaacgtaggtacggtaaggttacgggaaacggtccgtaaccgtgaaccgttccgttaacggaacggtaacccggacccggtaccgggttacccgttaaccgtttaacgtttccgtagggttaccggaccgaaacgggttaccggtacccccgtaaacgggtaccggttacccgggtacgaacccgggtacccgtaaccggacggtaccgggttacccggtttcccggttttacgggcccggtttcgggtacccggggg

SEQ ID NO: 207374 - DNA, 794 bp, Homo sapiens
  misc_feature: GYAE6OF01DKYLF.17.25.C03.1.454.CMB.1.raw
  modified_base (145)..(145): a, c, t, g, unknown or other
  misc_feature (145)..(145): n is a, c, g, or t
  modified_base (327)..(327): a, c, t, g, unknown or other
  misc_feature (327)..(327): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttgggnggcagcagctacaagtcgcccactcccaggtgcagctggtgcagtcgtggggctggaggtgaagaacgcgtcggggcctcgaggtagaacggttcctccgtgacgaagggtcctttcgtggatttccgtaaccggttttacccttccgtaattacgttactacgtaaaccgttgggggtacnccggccgacgggtccgacgttacgggaacctaaccggacgtgggtaacgtggggtactggggacggttcggggaacccgtaaaacccctaaacgacgtttgggaccgttcaaacgtaggtttccgtaccttacccgaaccctacggttcccgtaacccggggtacacggtaccctttaccgacgtaccggaaccccaacggttaaccctacccttaacgaaacttaaaacccgacccgtaacgtaacccttaacgacggttagggaacgtttacgggaacggtaacgtccctaagacctagtcgaaaccgacggtaaacccgtcgggtaccgtttacttaacgtttacggtaggtcgaaaccggtacggccgttaccccggagttaccggtccggtaacggtacccggccgtaaccgggcgttaaccgggtcccgttactttaaccgggcgtttccggggaacgggg

SEQ ID NO: 207375 - DNA, 705 bp, Homo sapiens
  misc_feature: GYAE6OF01C6I7R.17.25.C03.1.454.CMB.1.raw
  modified_base (299)..(299): a, c, t, g, unknown or other
  misc_feature (299)..(299): n is a, c, g, or t
  modified_base (344)..(344): a, c, t, g, unknown or other
  misc_feature (344)..(344): n is a, c, g, or t
  modified_base (427)..(427): a, c, t, g, unknown or other
  misc_feature (427)..(427): n is a, c, g, or t
tcagcgtagactagcacgaccggtgctcgatttagtagtgtagatttgggtttggggggagtcagtctcagtcaggacacagcatggacatgagggtcccccgctcagctccgtggggctcctgctactctggctccgagctgccagatgtgacatccagatgacccagtctccatccctccctgtcctcgtcctcgtggtggggtcagagtcaccatcacgttcgaccggacaagtcgacggtaccgtttaaaaccttatttaaattggtatcgagacaacgaaacctaggaaaaccnccccaagtaccctctgacttccgtcgtggtcactactccacttcnggacgaggtcggccctaccgtagtcggtagtcagtcggactaggtgatcggaggaccagttacttacaacgttccaccaaccncgttcaacccttacgtcgtacaccgtaaccgtagtaaggtctttaggtacaacctaagtttacctaaccctttagtaacgttaaccaacgtacggttaacctttacccgttacccgtttccccctaggttaaccttttaccggtttacggaacccgggtaccgggttaaaacccgttaaagttaccgaaacgttaaaccggtaacgtaaaaccggtttcgtacgggttacggaccttaccggaaccccttacgtaccggtttctcccggttttaaccc

SEQ ID NO: 207376 - DNA, 790 bp, Homo sapiens
  misc_feature: GYAE6OF01C8C8W.17.25.C03.1.454.CMB.1.raw
  modified_base (101)..(101): a, c, t, g, unknown or other
  misc_feature (101)..(101): n is a, c, g, or t
  modified_base (265)..(265): a, c, t, g, unknown or other
  misc_feature (265)..(265): n is a, c, g, or t
  modified_base (647)..(647): a, c, t, g, unknown or other
  misc_feature (647)..(647): n is a, c, g, or t
  modified_base (729)..(729): a, c, t, g, unknown or other
  misc_feature (729)..(729): n is a, c, g, or t
tcagcgtagactagcacgaccggtgctcgatttagtagtgtagatttggggtttgggagtcagtctcagtcaggacacagcatggacatgacgggtccccnctcagctccgtggggctcctgctactctcggctccgagctgccagatgtgacatccagagtcgaccctagtcctccacttccctcccgtgtccgtcgccgttcggtggggtcggggtaccaaggtacgtaccaaccctattccgtaacgttcggacccggtaanaacgtccgaaacggttaaccgttaaaaactttagttttaaagttggtaactaccgagaaccgtaaaccggtaaaaccgtaacgggaaaacccgccccgtaagttaccccgtaccgtagtaccgtttaccgtcgttacgggtactacctaaacgtccccgtaacgttcggtacggaccgttaacgggccggtaacccgtaccgtaggtccggttagttacgacgggttacggacgtagggttacgaccgttacgggtaacggtaacttaggttactttaacaacgttccaacccgtacctaacttccccgaacgttactaccgtaccgtaaccggtaacgtaggtaacgtacgttgtaacgtacgttacttacttacccggtntaacgaacgtaagacgttaccgaccgttacccgttcccgagtacgtttaccggtacgggaacgtaccggtaataacgggtanacgggtaagtaacgaacggttcgcggtacacgttaccacctacttactccgttacgtaccc

SEQ ID NO: 207377 - DNA, 971 bp, Homo sapiens
  misc_feature: GYAE6OF01EB8YJ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtccgtggggctgaggtagaagaacgccgtggggccttcgagtgaacggtctccgtgacaaggtcttcgtggtactttccgtaaccgttttaccctccttaattaacgttacttacgaaaccggttggggtcgaccggacccgaacggggtccccgtacgttacggggaacccaaaacccgggtacccgtaggggaacgggttagggtaacggttacgggggtaacgttcggggggaaccccgtaaaacccccgttaaaacggtacggttacgggttacgtacccaaaccggttaggtttacggttaccctttaacccgaacccccgttaaccggttaccccggttaccgggggaaacctaaccggttaaacccttttaaccccgaaacgtttaccggaaacccccgtaaaccggttaaaccccttacccccttaaaaccgtaaaaccttaaaaacccgaacctaaccggttaaaccccctaacgtaaacggttacggggttaacggtttaacgggaaaccggtaacccgggttaccctaacgggtaacccttaacggttaccggtaaccggtaacccggtaaacccggtaccccgggtttaacccggttaccgttttaaaccgttaccgttacgggtaccggtaaccggttaaccggtaccccggttaaccccgtaacggttacccggttacccggggtaacggtacccggtacccggttacggacccgtaacgggtccccggtttaacgtttccggtaccgtttcccgggggtacccggggg

SEQ ID NO: 207378 - DNA, 795 bp, Homo sapiens
  misc_feature: GYAE6OF01DK1VZ.17.25.C03.1.454.CMB.1.raw
  modified_base (341)..(341): a, c, t, g, unknown or other
  misc_feature (341)..(341): n is a, c, g, or t
tcagcgtagactagcacgaccggtgctcgatttagtagtgtagatttgggtttggggactcaaacaaccacatctgtcctctagagaaaaccctgtgagcacagctcctcaccagtgactggacctggaggatcctcttcgttggtggcagcagctacaagtcgcccactcccaggtcgcagcgtgggtgcgtagtcggtcgggcgtggaggtaggaacgagccggtcggggccctagaggtgtaacggttcctccgtagacgtacggtcctttcgtggtactttacccgtaaccgttttaccctacctaagtagttacctaccgtaacggttggggtccnccggtccgacggtccgacggtcggaaccgaccgtacgtgaggtcggagtacgggacgtcggaacccgtaacccctacgcgttggtactccgaacgttcggttcgtcccttaccgacccgttaccgtcccgtaaccgggactaaccgttacccgttaacctcgtaacccggtaacccgtaaccgtaacccctcccgtaacctaaacgtaaaccctaaccgacgtaacccgttagtacggttacgggttacggttacgggacggttacccgacgttacgtaacctaccgtacgtaaccggacccgttaaacccggtcccggttacgtttaaccttagtttaccggcggttaccgggaccgtacggtccccgtaccgtacgggtaccgtacgggtacgccgtaacccggtcggacggtcccggttcgttacccgttggtccggttcgggacccgggg

SEQ ID NO: 207379 - DNA, 843 bp, Homo sapiens
  misc_feature: GYAE6OF01CF4FX.17.25.C03.1.454.CMB.1.raw
  modified_base (155)..(155): a, c, t, g, unknown or other
  misc_feature (155)..(155): n is a, c, g, or t
tcagcgtagactagcacgaccggtgctcgatttagtagtgtagatttgggtttggggacgtcaacaaccacatctgtcctctagagaaaaccctgtgagcacagctcctcaccatggactggacctggagatcctcttcgtggtgcagcagctanagtcgccactccaggtgcagctggtgcagtctggggctgaggtgaagagcgtggggcctcgagtcgaaggtcctccgtgcgaacggtcttcgtggtactttccgaacggttttacctccgttaactaggttactacgtaacgttcggggtcgtaccgccgaacgggcccgtcgttacgggaaaccgtaacccggtaccgtttagggacggttaccgggtaaggttcgggggacgttaccggggggaaccctaaacccccgtaaacgtaccggttcgggttaccgttaccgaacgtaagggtttccgttacccttacccgaaccccgtaccgttccccggtacccggggtaactaccggtaaccgtttacccaaggttacccggaacccgtaacccgtaaccctttccctaacccctaaacgttaaaacccaccgtaaccggtacccgttaaacgtcgggttaacgggtaacgggtttacggaacgggtaaccgtacccgttaagtaacccgtaagttccgtacggaacccggtaaccgtacccggggtccctttaacgttacttaccggtggtacggtaccgtaacgtacccgttccgaacggtaccgttccgggtagtcccggtaccgtacccggcgtaaccggttcccggttactttcgggtaacccgtttcgggtaacccggggg

SEQ ID NO: 207380 - DNA, 789 bp, Homo sapiens
  misc_feature: GYAE6OF01BKH6D.17.25.C03.1.454.CMB.1.raw
  modified_base (297)..(297): a, c, t, g, unknown or other
  misc_feature (297)..(297): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttgggtggcagcagctaacagtcgcccactcccgaggtgcagctggtgcaggtcgtggggctggaggtgaagagccgtggggccctgaggtgaaggtctccgtgacaaggtcttgtgtacttctacgtttacctcgtatagtatacaacgtgggtcncgccgagccgctggaccaacgcctggagtcggagtggggagtcgggaccgtaacccgtaacgacggttcggtacgactacgtacggttctccctttaaccaccccgtacgttcccggacccggggtacaaccggtaccctttaacccgaagttccgaaccctaccgtaacctacccctaaccgtaaactaaaccgaacctaaccgtacctaacgaccggtaggtaaggtttacggacggttaccgacccgtagtaacccgtacgtacgtaaccggacccgggtaaccggtacccgggttaccggtttaccttaacgtttacgtacgggttaccggaccggtaaccggttaacccggtaccccggtaaacggtaaccgggttcccggggttaacccgggaaccgttaccccgggtaaccgggcccgggttaccggggtaccccgggttttacgtttcccggggtttaaccggttcgggggtaaccccgggggg

SEQ ID NO: 207381 - DNA, 894 bp, Homo sapiens
  misc_feature: GYAE6OF01BHRRK.17.25.C03.1.454.CMB.1.raw
  modified_base (186)..(186): a, c, t, g, unknown or other
  misc_feature (186)..(186): n is a, c, g, or t
  modified_base (255)..(255): a, c, t, g, unknown or other
  misc_feature (255)..(255): n is a, c, g, or t
  modified_base (684)..(684): a, c, t, g, unknown or other
  misc_feature (684)..(684): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggagatcctcttcttgggtggcagcagctacagtcgcccactccgaggtgcagtcgtggtnacgtagtcggtgggtctgggaggtaggaagacggtccgtggggacctcgaggtacgaacgtccttccgngacgtagtcttacgtggtacttaccttaaccgtttaccctacgttagttaacgttactacggtaaccggttgggaccgtcccgaccggtaccggtccgtaccggtacggaaacccgtaacggtaccgttagggtaacgggtaggtaaggtaggggtaccggttaccggggaaaccccctaaaaccccgttaacgtacgggttcggtacgttaccgacgtttacggttccgtaacccgtttacccgaccccgttaacccgttccccgggtaacccggggtaactaccggttaaccccttaaccgacgtaacgttaaccccgaaacccgttaacccttaccctaaaccgtaaaccgtaaaaccctaccgtaacccgtaacctaaccgtaaggttacgggtagggttaaccggagtacgtaccgtataaccncgtttacgaccggaaccgttaacccgggtaccgttacttaaacgttcggttacgttacgggacgttaccgtaacggtacccgaccgtaaacggtaccgggttacccggacggtaaccgggttacccgtaacccggggtcccggttaaccgggttaccccgggtttaccggtttacccgggttaacccgtttccggggggtaaacccgggg

SEQ ID NO: 207382 - DNA, 773 bp, Homo sapiens
  misc_feature: GYAE6OF01AXFG2.17.25.C03.1.454.CMB.1.raw
  modified_base (270)..(270): a, c, t, g, unknown or other
  misc_feature (270)..(270): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttgggtggcagcagctacaagtcgcccactcccaggtgcagctggtgcgtagtcgtggggcctggacggtgaacgaggccgtcgggggcctacgaggtggaacggttctccgtgacgaacggtctttcgnggtattcgtaccgttttacctaccttatacgtacttcgaacgttgggcgtccgccgacggtcccgacggtacggaccaacgtacccgtggacggttggacggtcggggacgtacgggacccgtaaacccgtaacaccggttggacgttacgacgtacggttcgttccgtaccgtacccgtacgttcccggtccgggaacttaaccgtacctttaactacgtaccgtaacccgacggtaacccttccgaacctaaacgtaaaccctacgaaccgtaccttaagaccggtaagggtttacggttaaggaccgtacgttccacgtactacgttacgtacggaacgaccggtccgggttacccgttaacttacgttacgtacggtacggtccgggaagttacccggtacccgtaaacggtccggttacccggaggtacccggtcccgggtaacggcccggtaaggtccccggtttcgtttaacggtccgtttccggggtacccgggg

SEQ ID NO: 207383 - DNA, 885 bp, Homo sapiens
  misc_feature: GYAE6OF01AFU1F.17.25.C03.1.454.CMB.1.raw
tcagcgtagactagcacgaccggtgctcgatttagtagtgtagatttgggtttgggactcaacaaccacatctgtcctctagagaaaaccctgtgagcacagctcctcaccatggactggacctggaggatcctcttcttggtggcagcagctacaagtgcccactcccaggtgcagcgtggtgcagtcgtggggctggaggtgaagacgccgtggggcctcgagtgaacgttctccgtgcaaggtcttcgtaggtactttccgtaaccgttttaccctaccttattaacggttactaccgtaacgtgggttcgccggccgacggtcccgcgttcgggaaccaaccggtaccgtaggtacggttaggtaacggtttaggggaacgttccggggaaccccgtaaaaacccccgttaacgtaccggttaacgggttccgtaaccgtaaccgtaaggttttacccgtcccgttttaccccaaaccccgtaccggtttacccccggtaacccgggggtaaacctaaccgggttaaccctttaacccgacgttacccggtaaccccgtaaaccgtaaccccttaccctaaccccgaaacttaaaccacccgaaccgtaccctaacgtagtaccgggtaggtttacggacggtccgtaccgtagtaaccctagtaccgtacggaaccccgtcggacccggtttacccgttacgttttacttaacgggtcgttaccggtagggtaacccggtcccgtaaccccggtaacgggttaccccgttaccggggtaacggtacccgtaaccccgggttacccggtaccgggtaacccgggttacccgggttttccccgtttaggttaaccccggggtttccgggttccccggggggg

SEQ ID NO: 207384 - DNA, 595 bp, Homo sapiens
  misc_feature: GYAE6OF01BLEJW.17.25.C03.1.454.CMB.1.raw
  modified_base (281)..(281): a, c, t, g, unknown or other
  misc_feature (281)..(281): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggcgaaccctaacgactggtgtcacagtgtcttcaccctactcccgtccgggacacgtacttaccatcgaccacgacctcctaccaataaacacacgcctacagtgggagttgaggacgcctagactatcgtacgaccgaccgaccgggtccttacttaacgttactggtacgacggagtaccgtaccccgaacgtcgttccggggtagaccggcccgtaaccgggccgtacgggcccggttacccttttcggtacccgtttcgggtaccgggggg

SEQ ID NO: 207385 - DNA, 782 bp, Homo sapiens
  misc_feature: GYAE6OF01DZFN7.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtgcagcagctacaagtgcccactcccaggtgcagctggtgcagtctggggctgaggtgaagagcctggggcctcagtgaagtctcctgcaaggctctggattcacgtttacctcctatagtatcaacgtggggtcgcgaccgagggcccgtacgtacgggaaccaaccgaccgttgaaggttggaggtgggagtcggggaccgtaaaacccctaacgacggtggttacgtccgaacgtaggttcgttacccttaccgaaccccctaacgttccccggtacccggggaacctaacggtaaaccctttacccgaaattaccgggaacccctaaccgtaaacccctttcccctaaccctaaaactaaaaacccacccgtaacggaaccccctttaaacgagttaacggggttacgttacgggaaacgggtcgacccgttacggaactacgttacgtacgggaccgaacccggtacgggtcccttacgtaacgttttaccggtggtccgggaacggtaacggttaccgtccccgggtaaaccggtacgtttaccccggggaggtaaccgacccggttaacccggaccgtaccgggtacccggtttaccgttttcgggtcccgttttccggggaacccgggggg

SEQ ID NO: 207386 - DNA, 664 bp, Homo sapiens
  misc_feature: GYAE6OF01AOR3W.17.25.C03.1.454.CMB.1.raw
  modified_base (251)..(251): a, c, t, g, unknown or other
  misc_feature (251)..(251): n is a, c, g, or t
  modified_base (516)..(516): a, c, t, g, unknown or other
  misc_feature (516)..(516): n is a, c, g, or t
  modified_base (608)..(608): a, c, t, g, unknown or other
  misc_feature (608)..(608): n is a, c, g, or t
tcagcgtagactagcacgaccggtgctcgatttagtagtgtagatttgggtttggggtacgtcaacaaccacatctgtcctctagagaaaaccctgtgagcacagctcctcaccatggactggacctggaggatcctcttcttggtggcagcagctacagtgcccactcccaggtgcagctggtgccagtcgtggggctggagtgaagaagccgtggggcctcgaggtgaggtctccgtgcgaaggtcttnaggattcctacgtttacctcttatacgtatcgaacgttgggtgccgccgaggccgtcctgggaaccaacggacccgtgacggttaggacgttgggaagtcggggtaccaaacccgttacgacgttggtgtccaacgtgttcgtccttaccgacccgacgttcccgtaccgggacctacggtaacttacccgattcgaaccacgtacctccctacaactaacacacgtaccctagacgttgggactttacgggacgtacgccctanacgtacgacgtcgaaccgacgtacgggtccctttacggtactttaaccgtggctaccggaataccggttccccgaaggtaccttccgggganaccgtcccgtagggccctacgggacggtttcccttaggtaccgtcggtaccggggg

SEQ ID NO: 207387 - DNA, 826 bp, Homo sapiens
  misc_feature: GYAE6OF01EATT0.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatcgacccagtctccactccctcctgtctcgcctcgtgggtcggggtcagtacgtccacctatccacttcggacccggaacaacggtaccgaaccggtaaccgtttaaaaaccttaagttttaaaagttgggttaactacgaacggtaacctaaacggtaaaacccgtaacgggaaaaacccgtccccccgaacggtaaccccttcccgtacggtaacctttccgtcgttacggggttacgacctaccgttacccctaaccgttccgtacggtaccgggtaaacgggttccgggacccgttaccccgtaaggttacccggggtaacggtttaccggaaggggttcgggtacggtaaggttacgggtacgttaccgggtacgggtaactaacggtttacttttaaccgaacctttccctaaccaacccgttactaccccgtaaccctaccgtaccgtacgtaacccctaacggtaggtaacggttagttcggtactaactaacttacctaaccgtacgtactaaccgtaacgtacgttaccggttaccctacgttaccccgttacgtacttacggttacggacccgggtaacggtaaccgtaagtagtaacgtacttaacggaaacggttcgtcggtcgaccttcgaccttacctctccgttcgttaccc

SEQ ID NO: 207388 - DNA, 798 bp, Homo sapiens
  misc_feature: GYAE6OF01EVGKL.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctggaggtgaagacgccgtgggcctgagtagacgtctccgtgacgaggtcttcgtggtacttccgtaccgtttacctacctaagtagttactaccgtaacgttgggtcgccgccggacgggcccgtcgtacgggaacctaaccggtaccgtgggtacggtagggtaacggttggggaacggtacggggtaaccccgtaaaacccgttaacgtacgggttacgggtcgtaccgtacggtacggtttccgttacccttacccgacccgttaccgttaccccggtacggtaaccgtaacgttaacccttaccgaacgttacccgaaacccgttaaccgtaaccccttcccgtaaacctaaacgtaaaacccaccggtaacctcccttaaacggtagggttagggtaacggtttacgggaacggtccgtaccgtaacgtaacctacgttccgaacggaacccggtaccgaccgggttccttaacttacgttacgttagggccgtacggtaaccgtcccggtaaccctaggggtaccgttccggggactacccggccgtaacggcgtaccggtccgtttaccttcgggttaccgtcgggtacccgggg

SEQ ID NO: 207389 - DNA, 833 bp, Homo sapiens
  misc_feature: GYAE6OF01BBGEG.17.25.C03.1.454.CMB.1.raw
  modified_base (481)..(481): a, c, t, g, unknown or other
  misc_feature (481)..(481): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccgaggtgcagcgtggtgcgtagtcgtgggctgaggtagaagacgccgtgggcctcgagtagacgtctccgtgacgacgtcttcgtagtacttcctaaccgttttacccacgttaagtaacgtactacgtaacggtgggtagccggtaccgtacgggcccgagtacggaacctacggtaccgtaggaggtgggtacgtgggtacgtacgggacccgtaaaccgtacgacggttggtacgtaccgtacggtagttccgtacccttaccgacccttaccgtcccggaccgggtactaacctaccgtttaaaccncgttaaccgaccctaacggtaccccttacctaacccgtaaactaaacccgtacccgaccgttaacccgtaacgttacgggttaacggaggtttaccgggaaacggtacgtaacccgtcggtaaccgtaccgttaccgggtacgtaacccggtaccggtaacccgggttacccgtttaattaacccggttacgttacgggttaaccggtaacggtaaccgtaccccgggttaacccgtacgggttacccggttacggggtaccggttacccggtaacccgggtaccgttaaccgggtcccggttaaccggttcccggtttaccggttaccggttccgggggtaaccccggggg

SEQ ID NO: 207390 - DNA, 835 bp, Homo sapiens
  misc_feature: GYAE6OF01CBYM4.17.25.C03.1.454.CMB.1.raw
  modified_base (358)..(358): a, c, t, g, unknown or other
  misc_feature (358)..(358): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctctttcgttggtggcagcagctacaagtcgcccacctcccgaggtgcgagtcgtggtgcgagtcgtgggctggaggtgaagagccgtgggacctgagtagaggtctcgtgacgtacgtcgttcgtagtacttcgttaaccgtttacctctaagtagttactacgtaacgtggtcgccgaccggaggtccgacgtcggaacaacgtaccgtagcggtcggtaagngggacggtaccgggaaccgtaaaccctacggtacgtaggttcggacctaagtacgttcgttccttacccaaccgtaccgttacccggtacgggaaacctagtaaccccgtactaacggtcccgtaaacccgtaccgtaacccgtaccccttaaccaaaccttaaacccggacctaaaccgtaccccgtaagtaaggtacgggttaaggttacgggaaccggacgttacccgtaggaacccttaacgtacccgtaacggaacccggaacccggttacccggggttaacccgttaaccgttttaaacgtttccggacgggttacgaacccggttaaccggtacccggaccggttaaccggtaccggggtttacccggtacgggttaccccggtaaccccggttaacccggacccggttaccgggttcccggtttacccggtttaccggttaaccggggtttccgggtaaaccccggggg

SEQ ID NO: 207391 - DNA, 872 bp, Homo sapiens
  misc_feature: GYAE6OF01B299C.17.25.C03.1.454.CMB.1.raw
tcagcgtagactagcacgaccggtgctcgatttagtagtgtagatttggggtttgggggactcaacaaccacatctgtcctctagagaaaaccctgtgagcacagctcctcaccatggactggacctggaggactcctcttcgttggtggcagcagctacaagtcgcccactcccaggtcgcaggcgtgggtcgctacggtcggtggggctgggagggtaggaaacggacggtccgggtacggggtcctacgtaggtacggtaacggtcctccgtaggacgtaacggtccttcgtaggtactttacccgttaaccgtttaccctaccgtaagtacgtactaccgtaacgggttgggtaccgaccgaccggtacgggcccgtacggttaaccggaaacccgaaccggttaaccgttaagggggtcggtaacgggtacggggggtaccggttaccggggaaccccgttaaaaccccttaacggtacgggtttacgggtaccctacctaacgggttacggttcccttacccgtaccccacccgttaccgggtccccgggtaacgggtaacctacgggttaaaccccttaacggaccgttacccggaaccctacccgtaacccttccctaaacctaactaaacccacgtacctacctaacggtacgtacggttacggtacggacgaccgtacgtacgactacgtacgtaacggaaccgtaccggtacccgtaccgttaacgttacgttacgtcggtacggtacggaccggttaccgacccgtaccggtaccggttccggtacggcccggtaacggcccggaacggtccggttacccggttcgttaccgggtccgttccgggggccggggtaccggg

SEQ ID NO: 207392 - DNA, 717 bp, Homo sapiens
  misc_feature: GYAE6OF01COQVI.17.25.C03.1.454.CMB.1.raw
  modified_base (636)..(636): a, c, t, g, unknown or other
  misc_feature (636)..(636): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtgcagcagctacaagtcgcccactcccgaggtgcagctggtgcagtcgtgggctggaggtgaagagccgtggggcctgagtgaggtctcctgacaaggtcttcgtaggtacttctacgtttacctctagttacgtatcgtaacgtgggtgccgcgacggccgcggtacggacctaacgacctggacgtggagtcgggagtcgggaccaaacccgtagaccggtggtcgtaccgaacgtggttcgttaccctcaccccgtacgtcccgttaccggggactaacgtaaccttacacgtaccgaaccaacccgtaacctccctaaccgaaactaaaccacccgtacgtaaccctagtacggtagggtacggttaggaggtactccgtagacctagtctaacggaaccggaccgtacccgggtcttaacgtttacgtttacgcggttaggacggaccgtaaccggtcccgtaaacggttccggtacccggggttanaccccggtaccgtaaacgggtcccgtacggggtttcccgtaccgttttacccggtccgggtttacccgggtacccgggggg

SEQ ID NO: 207393 - DNA, 885 bp, Homo sapiens
  misc_feature: GYAE6OF01BMQRH.17.25.C03.1.454.CMB.1.raw
  modified_base (340)..(340): a, c, t, g, unknown or other
  misc_feature (340)..(340): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgccccacgtcccgggtgacagcgtgggtgcagtcgtggggctggaggtgaaggaacgccggtgggggtccctcgaggtaggaacggttcctccgtggacctaagggtcctttccgtagggtactttccgtaaccggttttaccctccttaagttacggtactaccgtaacgttggggtcnccggacccgtacggggcccgaccggtaacgggaacctaaacccggtacgttacggaacgggtttggtaacggtgggggtaaccgttcggggaaccccgtaaaaccccgttaaacggtacgttcgggtaccgttaccgaacgttaggttccgtttaccttacccaaccccgtacgtacccccggtaccgggaactaacgtacccgtttaacccacgttacccggaaaccccgtaaccggtaacccttaccccgttaaacccaaaccgttaaaaaccgaccctaaaccggtaacccctaacggtaacggtttacgggtaaccggtttaggaccgggttaaccgtacccgttacggaacttaccgtacggtacccggtaaccgtaaccgggtacccggttacccgtttaacgttaacgtttacgttacgggtacgtacgtacgggtacccgttaccgaccgggttacgtccgggtagacccggtccgtaaccgggtcgaccgggttacccgttaccggttagttacccggtgggtcccggggaccggg

SEQ ID NO: 207394 - DNA, 569 bp, Homo sapiens
  misc_feature: GYAE6OF01ENRSJ.17.25.C03.1.454.CMB.1.raw
  modified_base (369)..(369): a, c, t, g, unknown or other
  misc_feature (369)..(369): n is a, c, g, or t
  modified_base (417)..(417): a, c, t, g, unknown or other
  misc_feature (417)..(417): n is a, c, g, or t
  modified_base (426)..(426): a, c, t, g, unknown or other
  misc_feature (426)..(426): n is a, c, g, or t
  modified_base (442)..(442): a, c, t, g, unknown or other
  misc_feature (442)..(442): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattctacgtttacctcctatagtatcaactgggtgccgccaggccgctggacctaacggacctggagtggagtgggatcggggacaaccctaacacgtggtcgtacacagtgtcttcaccctntccgtcggacagtacttaccatcgaccacgaacctccaccaataaacncacgcctanagtggtagttgaggcnccgtagactatcgtgacgacgacggccttatacttctagtcgcgtaagccgtacccacgtacgtcccgtaggccgtaccgtacggaccgtacggtaccgttccgtttacggccttcgggtaccgggg

SEQ ID NO: 207395 - DNA, 621 bp, Homo sapiens
  misc_feature: GYAE6OF01AKIR2.17.25.C03.1.454.CMB.1.raw
  modified_base (307)..(307): a, c, t, g, unknown or other
  misc_feature (307)..(307): n is a, c, g, or t
  modified_base (606)..(606): a, c, t, g, unknown or other
  misc_feature (606)..(606): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtcctccatccctccctgtctgcctcgtggtcgggggtcagagtcaccatcacttgccggacaagtcacggacgttaaaacctatttaaattggtatcaagcaagaaacctaggaaaacgcccagaccctctgatctcgtggtnctactccactcgtaggacgtaagtcggccgtacccagtccggtaggttcaggtggacgtagtggactcggtagggactagtactttacgaacttccgtaccaccactccaccgtactcctacgtacccaaccgtaggaagtacgttgtacgtactaactactaaccttacgtataccgtaacgtacgtacgttaccgtaccgttccccgtacgtccttaccggtttcggaccgtaacgggtaacctaaggttaaggacgtaactaacgaaacgtacgtcggtacgtctacgacctaacncttaccgtcgttacc

SEQ ID NO: 207396 - DNA, 665 bp, Homo sapiens
  misc_feature: GYAE6OF01BF7AV.17.25.C03.1.454.CMB.1.raw
  modified_base (242)..(242): a, c, t, g, unknown or other
  misc_feature (242)..(242): n is a, c, g, or t
  modified_base (434)..(434): a, c, t, g, unknown or other
  misc_feature (434)..(434): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctggggcctcagtgaaggtctcctgcaaggcttcnggattcacgtttacctcctatagtatcaactgggtgcgccaggccgctggacaacgacctggagtggatgggatcgggcgaaccctaacgacgtggtcgtcgactagtcgtccttacaccccagtcccgtaccgggacagtacctaccatacgaccaacgaacctccctacaactaaaccacacgccctaanagtacggtagttggaacggacgaccgtacgactacgttcgtacggaaccggaccgaccgggtacccgtttaccttaacgtttacctagggttacggccggtaacggtaacccgtaccccgtaacgggaccgttaccccggggttaggaacccggtcccgttaaccggggacccgtacggggttaccccggttccgtttttacgggacccgttttcggggtacccggggggg

SEQ ID NO: 207397 - DNA, 670 bp, Homo sapiens
  misc_feature: GYAE6OF01AR2V9.17.25.C03.1.454.CMB.1.raw
  modified_base (175)..(175): a, c, t, g, unknown or other
  misc_feature (175)..(175): n is a, c, g, or t
  modified_base (535)..(535): a, c, t, g, unknown or other
  misc_feature (535)..(535): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacagtcgcccactcccaggtncagctggtgctagtcgtgggctggaggtagaacgagccggtacggggcctcgaggtgaacggttctccgtgcgtaaggtcttcggtaggttacttaccttaccgtttaccctaccgttattaggttactacgtacgtgggtcgccgccgacggccgagtcggaaccaacgccgttaggacggtcggagtacgggcgtacgggaaccctaaccgtacgacgtcggtcacacgtagtcgttacctcctacccgtagtcccgtaccggactaccgtactaccacgtaccgaacctacgtaacctcctaacaactaaccacgtacgactaacgagtacggacgttagaacgtacgtctacgacncttaggacgacgtaccacggttcgtacttatacgtcgcgacgcgtaccgacctacgggtccgtaagggtcgtccggtacggtcgaacccggttcggggtaccgttacgttacgggttcccgttggggaacccggg

SEQ ID NO: 207398 - DNA, 751 bp, Homo sapiens
  misc_feature: GYAE6OF01DPQG5.17.25.C03.1.454.CMB.1.raw
  modified_base (133)..(133): a, c, t, g, unknown or other
  misc_feature (133)..(133): n is a, c, g, or t
  modified_base (260)..(260): a, c, t, g, unknown or other
  misc_feature (260)..(260): n is a, c, g, or t
  modified_base (277)..(277): a, c, t, g, unknown or other
  misc_feature (277)..(277): n is a, c, g, or t
  modified_base (528)..(528): a, c, t, g, unknown or other
  misc_feature (528)..(528): n is a, c, g, or t
  modified_base (594)..(594): a, c, t, g, unknown or other
  misc_feature (594)..(594): n is a, c, g, or t
  modified_base (699)..(699): a, c, t, g, unknown or other
  misc_feature (699)..(699): n is a, c, g, or t
tcagcgtagactagcacgaccggtgctcgatttagtagtgtagatttgggtttgggactcaacaaccacatctgtcctctagagaaaaccctgtgagcacagctcctcaccatggacgtggaccgtggaggtntccttcttcgttggtggcagcagctacagtcgcccactccgaggtgcgagtcgtggcgctaggttccgtggggcgtggtagggagaaggtaccgtcggtcgggccctgaggtaggtacggtcctcgngacgtagtcgtttacgngtaacttcctaccgtttcctacgtattagtacgtacgtacggtggtccgccgccggtacgcccgtggtaacggaaccctaacgtccgtaggaggttacgggacggtagggtggtaaccgggaaacccgtaaaccccgtaaggcgttcgggtctaacccgtagtaagttccgttacccttaaccaccccgtacggttaccccgacgggtactacgttaaccgttacacggttacccgaaccgtacctaaccnccgtaaccaaagttaaccacgttacgactacgagtacgtggagtacgctacgcttaagcgtaacgngaacccggacctacgggtcttacccgagttaacgtcggtaacgacggtacgggttaccacccggtaaggtccgggttaaccgcggtaacccggacgggttaccgnggttaccccggttcccggttaggtttaacccggttcggtacgggtcccgggg

SEQ ID NO: 207399 - DNA, 923 bp, Homo sapiens
  misc_feature: GYAE6OF01COP0P.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggacatctccttctttcggttggcgacgcgacgctacctaagtacgcccaccctcccaccggtaggcgacgcgtcggtggcgacgtcgttcggggtcggtgtagggtagggaagaaacggtaccggtcgggggccggtccgtagtaggtaacgggtacgtccttcgacgaacggtaccgttcttacgggtactttccttaacccggttttaaccttccctagttaaaggttactacctaaaccgttgggggttcggaccgtccccggacggacccgggtccgttaacgggaacccgaaaccggtacctggaagggttcgggaagttcggggtacggacggggtaacccggtaaaccccctaaaacgtcgttgggtcggtacctaacgtaacgggttcggtcctttaccccaccccgttaacctacccggtcccgggggactaaagacccttttaaccgaacgttaacgaccccgtaaaccgtaaccgttacccctaccgtaaactaaaaccaacctaccgtaccctaaacgtacgttacgggtacggttacgggtaaggtacggtaccgtacgacgtaaccgtcgttaaccggaaccgggaacccgtaacccggggtaccgttttaccttaacgtttaacgtcgggttacggtaccggaaaccgggttacccgtaaccccgttaaccgggtcggttaaccccgggggtacggtaccggaccccggtttaccgggaaccgttcccggggacccggtttcccgttttaacggttcccgggtttccgggtacccggggggg

SEQ ID NO: 207400 - DNA, 764 bp, Homo sapiens
  misc_feature: GYAE6OF01EREJD.17.25.C03.1.454.CMB.1.raw
tcagcgtagactagcacgaccggtgctcgatttagtagtgtagatttggggtttggggactcaacaaccacatctgtcctctagagaaaaccctgtgagcacagctcctcacatggactggacctggaggatcctcttcttgggtcggacagcacgctacaaggtcgaccctacctcccgaggtcgcagtcgtgggtgcgagtccggtggggcctaggagggtagaacggtacgccgggtggggtcccttacggaggttacggtaacggttccctaccgtggaaccgtaacggttccggttttaccgtaggttacctttaccgttaacccggttttaaccctacgttaaattagttactaccggtaacggtcggggtacgccgtacgggtaccgggtcccgtacgttaacgggaaaccgtaaccgggtacgttacggaacggtggggtacggtacgggtacgtacgggtaacctaaaccccgttaagacggttcggtacaccggagtcgttacgtccgttaccaccggttactccggaacggtctacgtacctacgctacgacctactacccgacctaactaacgaacctacaaccgtacctagtacggtagtaaggtcgaacgtacgtcaggttacagtacggcgtaacggcgtacgggtactacgtttacgattcggacgtacggaactcccggtaccagtcggtaccgtggaccggtaccgagtaccgacgttccgtacgttggtaccgcggtaaccgggg

SEQ ID NO: 207401 - DNA, 804 bp, Homo sapiens
  misc_feature: GYAE6OF01DHL0K.17.25.C03.1.454.CMB.1.raw
  modified_base (330)..(330): a, c, t, g, unknown or other
  misc_feature (330)..(330): n is a, c, g, or t
tcagcgtagactagcacgaccggtgctcgatttagtagtgtagatttgggtttgggggagtcagtctcagtcaggacacagcatggacatgagggtccccgctcagctccgtgggctcctgctactctggctccgagctgccagatgtgacatccagatcgacccagtcctccatccctcccttgtcctgcccttcgtggtcggggtccaggtacgtaccacctatccgacgttcggacccgaacgaacgttaccgacggttaaccgtttaaaaccttagtttaaagttggtactacgaacgactaacggaaaacccgtagggaaaaccncccctaacgtacccttccgtacgtacttccgttcgtgggttccacttaccgtacccctcgtacggttacgggtaaccgtaacgggttccggtaccccgtacccgtaggttacgggtaacgtttcgaagggtcggtacctagggtagtcgtacggtaggaactggtttactttacacttaccgtacgaacctactacccgaacctacgttccgtaccggaacccgtaacgtacggtaagttcgtttacgacgttaacttaacgttccgttaaacgtttacccgttagtaaccgaaacgtaccggtttacgtttaaccccgttccgtttaccccgtcgttacgttttaacccgggttgggaacccggttaaaccggtacttaaagggttaccgtaagtaaccggttaaaccgtaaccgttacgttcggggtactacccgtttcgaaccgttaaccgttctacggtttcgttacccg

SEQ ID NO: 207402 - DNA, 716 bp, Homo sapiens
  misc_feature: GYAE6OF01DW3VD.17.25.C03.1.454.CMB.1.raw
  modified_base (170)..(170): a, c, t, g, unknown or other
  misc_feature (170)..(170): n is a, c, g, or t
  modified_base (183)..(183): a, c, t, g, unknown or other
  misc_feature (183)..(183): n is a, c, g, or t
  modified_base (193)..(193): a, c, t, g, unknown or other
  misc_feature (193)..(193): n is a, c, g, or t
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (363)..(363): a, c, t, g, unknown or other
  misc_feature (363)..(363): n is a, c, g, or t
tcagcgtagactagcacgaccggtgctcgatttagtagtgtagatttggggtttggggactcaacaaccacatctgtcctctagaagaaaaccctgtgagcacagcctccctcaccagtggactggacctgggaggacttcctcttcgttggtggcagcagctacagtcncccactccaggtncagtcgtggngcgaggtcggtggggctgggaggtaggaagacgccggtgggcctagaggttgacggtcncgtnacgtagtcttgtagtacttacctaccgtttctacttagtagtactacgtacgtcgggtcaccgccgcggccgtcgtacggacctaacgcgtggtacgtgggtacggngggtaacgacggtaacctaaaccgtaacgtcgtacggttccactacggtacgttcctacttaccccgaaccgtccgtccggtacggaacctacgtacctacacggtaccgaacctaccgtacctacctaacctaaactaacccgataccctaacgtaacgtaggtacgggttaacggacgacggtaccacgtaccgtataccgtacggtacggtaaccgtaccggttaccggtcgtttaacgttattcccggtggtacggaccgtaccggtacccgtaacggccgtacggtacggacggtccgtacggaccggtccgtacgggtcgttgttacccggtgttcccggggacggg

SEQ ID NO: 207403 - DNA, 787 bp, Homo sapiens
  misc_feature: GYAE6OF01BZ91B.17.25.C03.1.454.CMB.1.raw
  modified_base (301)..(301): a, c, t, g, unknown or other
  misc_feature (301)..(301): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgccccactcccgaggtgcagctggtgcagtcgtggggctggaggtggaagagccgtggggcctcgaggtgaaggtcctaccgtgcaaggtcttcgtggtacttctaccgtttacctacctatagtatcgaacgtgggtcncggccgaggcccgcgtacggaaccgaaccgccgtgaggtacggagtgggacgtcgggacccgtaaacccgtacgtacggtggtacgtaccgaacgtagttcgttaccttaccaccccgttacgtcccggtaccgggaacctaacgtaaccttaccgagtacccgaacccgtaacgtaccctaccgtaacctaaactaaaccacgtaaccgtaccctaagaacggtagggttacgttacggaacgggtacgtaccgtacgtaacgtacgtttcgacggaacccgtaccggacccggttaccggtttacctaagtttcccggtaggtaccggtacggtaaacccgtcccgggttaacccccgtaacgggttccgggttacccggggtacaaccccgggttcccggttaaaccgggcccggtaaacccgggttccccggtttaaccggttttccgttccccgggggttaaaccggggttccccgggggg

SEQ ID NO: 207404 - DNA, 769 bp, Homo sapiens
  misc_feature: GYAE6OF01A8WMO.17.25.C03.1.454.CMB.1.raw
tcagcgtagactagcacgaccggtgctcgatttagtagtgtagatttgggtttgggggactcaacaaccacatctgtcctctagagaaaaccctgtgagcacagctcctcaccatggactggacctggaggactcctcttcttggtgcagcagctacaagtcgcccactcccaggtgcagctggtgcagtcgtgggctgaggtagaagagcgtggggcctcgagtgaagtctctgcacggtcttcgtggtacttctaccgtttacctacctaatagtactacgtaagtcgggtcgccgcgacggtccggactacggaaccaacggaccgtaggaggtaggaggtagggaggtacgggaaccgaaacccgtaaacgacgtcggtacgtacacgtacgttcggttacctaccgtacccctaacgtcccggtaacccggggtaactaaccggtaaccttaaccgaacgttaccggtaacccctaaaccggtaacccttacccctaaacctaaaccgtaaaccaacccgtaacgtacctaacgtaacggtacgggttaagggtttcgggaaacggtaccgtaccgttaacgacccgttaacgtttccggaacgggtaacccgtaacccggtaccggggtacctttacgtttaaccttaacgggtccgttagggaaccgtaggtaccctacccggtacgtacgggtaccgtcggaccggtcccgaggacgtaccgggttcggtaccttttggaccggtttcgggaacccggggg

SEQ ID NO: 207405 - DNA, 763 bp, Homo sapiens
  misc_feature: GYAE6OF01ANKJW.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgctagtcgtgggctggaggtgaagagccgtggggcctcgagtgaacggtctccgtgacgaaggtcttcgtggtacttcgtaccgtttacctacctatagtactctaacgtggtcgccgccgaggcccgcgtggaccaacgccgtagacggtggagtgggagtcgggacctaaaccctacgtacgtggtacgtcgtaacgtacgttcgtcttacccgaccctacgttcccggtaccgggtaacctacgtaaccttacccgactaccggtaaccccaaccggtaaaccttcccgtaaccctaaacgtaaaccctaacgtaccgtaccctaacgtaagtacgggttacgtacgggtaaccggtaccgtaccgtacgtaacgaatttccggaaccgtaaccggaccgtacccgggttacccgttaaccttacggtttacgtcgggttaacgccgggtaactaaaccccggtcccgtaaccggttacccggttaccgggtcggtacccgttacccggaaccggtcccggtaaccggttacccggtttacccgttaccggttaccggtttcccgggacccggggg

SEQ ID NO: 207406 - DNA, 649 bp, Homo sapiens
  misc_feature: GYAE6OF01A72OH.17.25.C03.1.454.CMB.1.raw
  modified_base (393)..(393): a, c, t, g, unknown or other
  misc_feature (393)..(393): n is a, c, g, or t
  modified_base (405)..(405): a, c, t, g, unknown or other
  misc_feature (405)..(405): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttggtggcagcagctacaagtcgcccactcccaggtgcagctggtgctagtcgtggggctggaggtgaagagccgtggggcctcgagtagacggtcctccgtgacgaaggtcttcgtggtacttcctacgtttacctccttatacgtatcaacgtgggtcgcgccgaggccgcgtacggaccaacgtcctggacgtggagtgggagtcgggacctaacccgtaacgcgtggtcgtcacgtgtgtcctcacccntcccgcgggacncgtacctacatccgaccacgactcctacaataaccactacgacctaacgagtggtaagttcggaacgcgtccgtagaccagttccgacggaaccgaccgtaccgggtacccgttacgtttacgttacgtcggtacgaccggtaacgtcccgtacccgacggtaccggttccggtacggtccgacccggtacggccgtacgggtcccggttacccgtttcggttaccggttcggtacccgggggg

SEQ ID NO: 207407 - DNA, 731 bp, Homo sapiens
  misc_feature: GYAE6OF01DKF2H.17.25.C03.1.454.CMB.1.raw
  modified_base (237)..(237): a, c, t, g, unknown or other
  misc_feature (237)..(237): n is a, c, g, or t
  modified_base (251)..(251): a, c, t, g, unknown or other
  misc_feature (251)..(251): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatccttcttcttggtggcagcagctacaagtgcccactcccaggtgcagctggtgcagtcgtggggctgaggtgaagagccgtggggcctcgagtgaaggtctccgngacgaaggcttcgnggtattccgtacgtttacctcctatagtactactagtgggtacgcgccacggccgtcgtacggaaccaaccgtaccgtggacggtgggaagtcggggagtcggggaacccgaaacccctaacgtacgtcgggtagtccgtaacgtagttcgttaccttacccgtaaccccgtacgtcccggtaccggggactacggtaacctttaacccgacgttaccgaccctaaccgtaacctcccctaaccgtaaactaaacccactaaccgtaccttaacgacgttacgggtaggtttaggaacgggtacgtaccgtacggaaccttacgttaccgtacgaaccgtaaccggacccgggttctaccgttaacttaccgtgtcggacggaccgtaccgtaccccgaggtaccgttaccgggacgacggtcccgtaccggacgtcggtacccggttccgtttaaccggtccgttcggtacccgggggg

SEQ ID NO: 207408 - DNA, 720 bp, Homo sapiens
  misc_feature: GYAE6OF01B94BB.17.25.C03.1.454.CMB.1.raw
  modified_base (286)..(286): a, c, t, g, unknown or other
  misc_feature (286)..(286): n is a, c, g, or t
  modified_base (297)..(297): a, c, t, g, unknown or other
  misc_feature (297)..(297): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagcctgggggcctcgagtgaaggtctccgtgcaaggtcttctggattcacgtttacctctatagtatcaacgtgggtncgccaggccgngtggacacgacctggaggtggagtggggatcggggacctaaacccgtaacgacgttgggtacttcgaacgtacggttgtccttccacccctatcccgtacggactacgtaacttacccgattacgacctaaccgtaacctcccgtaccaaattaaacccactacgtacctaacgagttagggacgtttaggaacgggaacctccgtaagaacctacgtccgtacggaaccggtaacccgacccgggttacccggttacttaaacctttacgggtacggttaccggaaccgggaaccggttacccgttaccccgggaaacgttcgggttaccccgggaacgtaccgggtacccccgtacgggacccgtaacggggttcccgtttaacccgttttcggtacccggttttccggggacccgggggg

SEQ ID NO: 207409 - DNA, 763 bp, Homo sapiens
  misc_feature: GYAE6OF01BWB3V.17.25.C03.1.454.CMB.1.raw
  modified_base (224)..(224): a, c, t, g, unknown or other
  misc_feature (224)..(224): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacagtcgcccactccaggtgcagcgtggtgcgtagtcgtggggctggaggtggaagacgccgtgggcctnaggtgagtctctgacgaggccaggtcgatagtatcttacaactaaaatagtaggtactagtaagttcgggtacgacggtacgtaccgggacccccggtaaggaacgggtccgttaggggaagggttcggggggtagggggtcgggtaccgagggtcggtacggttttaacgggacggttaacgggacgtaacggtaaggttacgtacgggaaccgtaaaccgggtaaagtaaggtaggggaaacgggtaccggtaaggtacggaaccgtaacgtaaccgttaacccggaacgtaccccgaaccgtaacccgaaccgaacgtacgtaccaacgtacaccggaactacgtacggaacgactacgtagacgtacgagtaccggaaccgtaccggtacccgggtacgtttaccttaacgttccggtagacggtaacggtaattacggtttacgtttctaccggtttactaacggttacgttaccgtttaaagttacggttacggttacggtaaccgtttacgttagggtcccggttaaacggg

SEQ ID NO: 207410 - DNA, 702 bp, Homo sapiens
  misc_feature: GYAE6OF01AH68I.17.25.C03.1.454.CMB.1.raw
  modified_base (176)..(176): a, c, t, g, unknown or other
  misc_feature (176)..(176): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtncagcgtggtgcagtcgtgggctggaggtgaagaggccgtggggcctcgagtgaaggtctcgtgactaggcttcgtggtattccgtaaccgtttacctctacgtagttactacaacggtgggtcacggccgacggccgcgtagggaacccaaccggaccgtaggcgggttaggaggtacggggacgttacggggaccctaaaacccgttaacgacgttaggtccgtaacgacgtaggtcggttaccttacccgaaccccgtacgttcccggtacccgggaacgtaaccgttaccgttaactacggaccgtaacccgaccgtaacctacccgtaacctaactaaaccaacctacgtaccctacgacgtaggtacggttacgaggtccacgtagtaacgtctacgtacgaaccgaccgtaccgtccgtatacgttcgtacggaccgcgtacgtaccggtacccgacgtacggccggtagaccggtccgacggacgaccggtccgttcgttacgtccgtcggtacccggg

SEQ ID NO: 207411 - DNA, 750 bp, Homo sapiens
  misc_feature: GYAE6OF01C8OZN.17.25.C03.1.454.CMB.1.raw
  modified_base (190)..(190): a, c, t, g, unknown or other
  misc_feature (190)..(190): n is a, c, g, or t
  modified_base (609)..(609): a, c, t, g, unknown or other
  misc_feature (609)..(609): n is a, c, g, or t
  modified_base (648)..(648): a, c, t, g, unknown or other
  misc_feature (648)..(648): n is a, c, g, or t
tcagcgtagactagcacgaccggtgctcgatttagtagtgtagatttgggtttgggactcaacaaccacatctgtcctctagagaaaaccctgtgagcacagctcctcaccatggactggacctggaggactcctcttcgttggtggcagcagctaacgaagtcgacccactcccgaggtgcagtctggngacgagtcggtgggctggaggtagaagacgccggtggggacctgaggtagaacggttcctccgtagacgtaggtcctttcgtaggtactttaccgtaaccgttttacctcttaatacgtacttaccggtaacggtcgggtacgcccggaccgaacgggtcccgtacggtaacggaacctaaccgtacgttaggacgggttaggacgtagggacgtaccgggtaaccctaaaacccgtacgagttggtaccactacgtagttctacccttaccgaaccgttaccgtccggaacggtactacgttaaccgtacagtaccggaaccctaccgtaacctacctaactaaaccaaacgccgtacgtacctacggtaaggtcgttaagggtacgacgtacgtacccgtataccgtacgttaccgnggaacccgtaccgaccggttccgttactaacgtttccgngggtaccagggtacctaccgaccggtaacggtacccggttgacggttccgacccggttaccgcggtccgtacgtttaccgtcgtaccggtggggtacccggg

SEQ ID NO: 207412 - DNA, 765 bp, Homo sapiens
  misc_feature: GYAE6OF01A977N.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcacccatggactggacctggaggatcctcttcttggtggcagcagctacaacgtgcccactcccaggtgcagctggtgcagtcgtgggctgaggtggaagagccgtggggcctcgaggtgaacggtctccgtgacgtaaggctttcgtggattcgtacgttttacctccttataagtacttcgtaacgtggtcgccgccgacggccgcgtacggaccgaaaccgtaccgtaggaggtcggagtgggtagtacgggaccgtaaaccccgtaacgacgtcgggtcgtactacgtacgtcgttacccgttaccgaccctacgtcccgtaccgggacctacgtaccgttaaccacgtacccgtacccgaaccgtaacccgttcccgtaacccgtaaactaaacccgtaccgaaccggtacccttaacgtaacggttacgggtaagttacgggacggtaccgtccgtaacggacctagtacccgttacggaacccgtaccggtaccgggtacccggttaacctttaacgttaccgttacgggtccggtaacggtaccggtaccgtaccccggaagttcccgtacgggttacggaccggtacccgtacccgggtacgtaccggtcccggttaaccgtttcggtacccgttcgggtacccgggg

SEQ ID NO: 207413 - DNA, 750 bp, Homo sapiens
  misc_feature: GYAE6OF01B7EG6.17.25.C03.1.454.CMB.1.raw
  modified_base (139)..(139): a, c, t, g, unknown or other
  misc_feature (139)..(139): n is a, c, g, or t
  modified_base (390)..(390): a, c, t, g, unknown or other
  misc_feature (390)..(390): n is a, c, g, or t
  modified_base (695)..(697): a, c, t, g, unknown or other
  misc_feature (695)..(697): n is a, c, g, or t
  modified_base (709)..(710): a, c, t, g, unknown or other
  misc_feature (709)..(710): n is a, c, g, or t
  modified_base (715)..(715): a, c, t, g, unknown or other
  misc_feature (715)..(715): n is a, c, g, or t
  modified_base (717)..(717): a, c, t, g, unknown or other
  misc_feature (717)..(717): n is a, c, g, or t
  modified_base (719)..(719): a, c, t, g, unknown or other
  misc_feature (719)..(719): n is a, c, g, or t
  modified_base (723)..(723): a, c, t, g, unknown or other
  misc_feature (723)..(723): n is a, c, g, or t
  modified_base (726)..(726): a, c, t, g, unknown or other
  misc_feature (726)..(726): n is a, c, g, or t
  modified_base (728)..(728): a, c, t, g, unknown or other
  misc_feature (728)..(728): n is a, c, g, or t
  modified_base (730)..(731): a, c, t, g, unknown or other
  misc_feature (730)..(731): n is a, c, g, or t
  modified_base (735)..(735): a, c, t, g, unknown or other
  misc_feature (735)..(735): n is a, c, g, or t
  modified_base (737)..(742): a, c, t, g, unknown or other
  misc_feature (737)..(742): n is a, c, g, or t
  modified_base (744)..(745): a, c, t, g, unknown or other
  misc_feature (744)..(745): n is a, c, g, or t
  modified_base (747)..(748): a, c, t, g, unknown or other
  misc_feature (747)..(748): n is a, c, g, or t
tcagcgtagactagcacgaccggtgctcgatttagtagtgtagatttggggtttggggggagtcagtctcagtcaggacacagcatggacatgagggtccccgctcagctccgtggggctcctgctactctggctccgngctgccagatgtgacatccagatcgacccagtcctccactccctccctgtctcgccttcgtgggtcgggggtacagacgtccacctagtcctacgttcggacccggaactaacgtaccgtaacgggtaaacctttaaaaacctttaagttttaaacgttggttactacgaagtaaccaaacgtaaaaccgtaaggaaaacccgccccaaccgtaccctcgtagtaacttcgtcgtgggtcactacctaccnccttacgcggacggacgtcggtcccgtacccgagtacggagttcgaggtcggatggtgacgtcggaggaacttacgttaattcctaaagttcccctaaccgtaaccctactttaacccccgaaacccttaccccctttacggggttaaaccccggggtaaacccccgtttaaaacccgggggtttacgggggtttaaaaacccgggggttttaaccggtttttttaaccggggaaaccccccggggtttttaaaaaaacccccgtttttttaaaacccccggtttttttaaaaaccccccccccnnnacccccccccanntctcncntnagtncgnangnngcanannnnnncnntnntc

SEQ ID NO: 207414 - DNA, 655 bp, Homo sapiens
  misc_feature: GYAE6OF01E5ANZ.17.25.C03.1.454.CMB.1.raw
  modified_base (183)..(183): a, c, t, g, unknown or other
  misc_feature (183)..(183): n is a, c, g, or t
  modified_base (252)..(252): a, c, t, g, unknown or other
  misc_feature (252)..(252): n is a, c, g, or t
  modified_base (290)..(290): a, c, t, g, unknown or other
  misc_feature (290)..(290): n is a, c, g, or t
  modified_base (301)..(301): a, c, t, g, unknown or other
  misc_feature (301)..(301): n is a, c, g, or t
  modified_base (346)..(346): a, c, t, g, unknown or other
  misc_feature (346)..(346): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggngcagtcgtgggggctggaggtgaagaagccgtgggggctcagtgaaggtcctcctgcgaaggctttcgnggtacttcacgtttaccctcctatagtatcaactgggncgcaggccgcnggacacgcctgagtggagtgggatgggacgaaccctaagcgtggntacacgagttcgtctacacccgatcccgtccggacacgtactacagtccgaaccacgacctacctaccaactaaacaccacgtacctactaaggtcggagttacgaagggacgtcctacggacacgttcgtcgaaccgtaccgaaccgggttaccgttcgtttaaacgttacgtaggtaccgacgggtaacgtaaccgtaccccggttaacgtacgttccccgggggatacccggtaccccgggtaacggcccgggttaaggcccccggttaactttttcccgggccgttttcccggggtacccggggg

SEQ ID NO: 207415 - DNA, 840 bp, Homo sapiens
  misc_feature: GYAE6OF01CJRYE.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggactcctcttctggtggcagcagctacgaagtcgcccactcccgaggtcgcgacgcgtgggtgcgtaggtcggtggggctaggagggtaggaagacgccgtcggggtcctaggtaggtcggtaacggttcctaccgtggacgtaacgggtcttacgttacggtactttccgttaaccgttttacctacctaagttaagtacgttacggtaacggtcggggttccgaccggacggacgggacccggtcgtaacggaaacccgtaccgaaccggttaggtaacggtacgggggacggttaggggaacgggttaccggggaaccccgtaaaccgtaacggtacggttacgggttacgtaacccgtaacggtaccggtttacgtacccgtttacccaacccgttacccgtacccgggtacgggtaaccgtaaccggtaacctttacccggaacgtaccgaacccgtaaccgttaaccctccccgtaaacaaaccgttaacccacgtaacgtccgttaacgtacgggtagtaacgggttacgacggtaccgacgttacgacgttacaccggtacgaacgggtaccccgtacggttacccgttattcccgtaaggtcgaccggtggtaaccgacccggttaccgacggttccggtacggtaccggtaccgaccggttaccgcgtacgggtccttaggttccacgggttcgggccggg

SEQ ID NO: 207416 - DNA, 702 bp, Homo sapiens
  misc_feature: GYAE6OF01EJPOK.17.25.C03.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
tcagcgtagactagcacgaccggtgctcgatttagtagtgtagatttgggtttggggactcaacaaccacatctgtcctctagagaaaaccctggtgagcacgacgctcctcgaccatgggacttcggacctgggaggacttccgtcctttcgttggtggcagcagctacaagtcgccactccaggtgcagctggtgcngtcgngggctgaggtgaagacgcgtgggctcgagtgaaggtcctccgtgacgaagtcgttcgtggtattccgtacgtttacctacttaatacggtactacgtaacggtggtcgccggaccgacggtccctacgtacggaaccgaaaccgtaccttagggtaaggttaggaggttcgggaacgtaccgggaccgtaaacccgtaaccgtaccgtgggtcgtacgacgtacggttctccgttactacccgactccggtacggactagtaaccttacgagttaccgacctaacgtacctaccctaacgtaataaaccgactacgacctacgagtacgggttacgtggaacgtcgaccgtgaactccgtcacggaaccacggacccggttaccgtattcgttaaccgtggtaccgacgtacgtacgtacccgtacggtaccgttacggaccgagtaccccgtaggccgtacgtcccgttacccgtttagaccccgtttggcccgggg

SEQ ID NO: 207417 - DNA, 770 bp, Homo sapiens
  misc_feature: GYAE6OF01AQXTS.17.25.C03.1.454.CMB.1.raw
  modified_base (245)..(245): a, c, t, g, unknown or other
  misc_feature (245)..(245): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagcctggggcctgagtcgaaggtctcctgacaaggcttntgattcacggtttacctcctatagtactcaagtggtcgcgccgtaacggcccgtcgtacgggaactaaccggacccgtaggtaacggtagggtagtgggggtaacgtcggggaacccgtaaaacccccgtaagtaccgtagggtcggttaccaaccgtagttcgttacctttccgaaccccgttaatccccggtacccggggaacctaacggtaaccctttaaccgattacccggaaccctacgtaaccctaccctaccaaacttaaaccgaacaacgacccgttaaacgacgttacggaaggtttacgaacgggtacgacccgttagacctaactaccgtacgaaccggaacccgtaccgggtcccgttattaaccgtttaacgtcggtacggtaccgaggttacccgtaccccgtaaacgggtcccgttaccgggtaccgaaccgggttccccgtaacccgggaccgtaccgggaccccggttacctttttaccggggaacccgtttcgggtaacccgggggg

SEQ ID NO: 207418 - DNA, 653 bp, Homo sapiens
  misc_feature: GYAE6OF01AZ185.17.25.C03.1.454.CMB.1.raw
  modified_base (260)..(260): a, c, t, g, unknown or other
  misc_feature (260)..(260): n is a, c, g, or t
  modified_base (285)..(285): a, c, t, g, unknown or other
  misc_feature (285)..(285): n is a, c, g, or t
  modified_base (310)..(310): a, c, t, g, unknown or other
  misc_feature (310)..(310): n is a, c, g, or t
  modified_base (406)..(406): a, c, t, g, unknown or other
  misc_feature (406)..(406): n is a, c, g, or t
  modified_base (418)..(418): a, c, t, g, unknown or other
  misc_feature (418)..(418): n is a, c, g, or t
  modified_base (635)..(635): a, c, t, g, unknown or other
  misc_feature (635)..(635): n is a, c, g, or t
tcagcgtagactagcacgaccggtgctcgatttagtagtgtagatttggggtttgggagtcagtctcagtcaggacacagcatggacatgagggtccccgctcagctcctggggctcctgctactctggctccgagctgccagatgtgacatccagatcgacccagtcctccactcctccctgtctcgcctcgtaggtggggtcagacgtcaccatcactgccgacagtcacggtacttaaaactatttaaatggtactnacgacaacgaaacctagggaaaacncccagacctctagatctcgtggtcncactccgattcgagacgaagtcggaccgtacctaagtcggtagttacgaggttcggactaggtgacgttcgaggactagtatttacgatcactacnctaccacctacnctacgaactaccgtaggaacgttgttgggtactacctaaactttcctaaaccgtacttaccgtaaccgaaacgttcgtaacgtttaccctaccggttttacccctacggttacctttaccggtttaccgggacccgggtaaacgggaaccttaaaagggtcgaaacgaacgttaaaccgaaacgtacgttacgggagttacctacgacccttaaacnctttaggttcttaacccg

SEQ ID NO: 207419 - DNA, 664 bp, Homo sapiens
  misc_feature: GYAE6OF01B82Z2.17.25.C03.1.454.CMB.1.raw
  modified_base (180)..(180): a, c, t, g, unknown or other
  misc_feature (180)..(180): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagcnggtgcagtcgtgggctggaggtgaagaagccgtggggcctcgaggtggaacggttctccgtggacgaagggtcttgtggtattctaaccgttttaccctaccgttaataagtactacctaacgtgggtgccgaccgaggcccgcgtaggaaccaacggacctggaggtaggagtgggacgtacggggacctaaacccctaacgacgttggtacgtcaacgtagtcgtaccttcaaccctactcccgtcgggacacgtaactaccgatcgaacccgtacaaccctaccgtacaactaaacaaccgacgtacctaaccgtagttacggtagttaggaacggtacgaccgtagaactagtcgtagaaccggtacaaccgggtccgttacttaagttccgtaggtcgacggacgtaccgtacccgagtaccgtcgggacgtccgaccgtacggacgtcggaccgttcttcggtcgttcgggtaccggg

SEQ ID NO: 207420 - DNA, 756 bp, Homo sapiens
  misc_feature: GYAE6OF01DBYSN.17.25.C03.1.454.CMB.1.raw
  modified_base (188)..(188): a, c, t, g, unknown or other
  misc_feature (188)..(188): n is a, c, g, or t
  modified_base (280)..(280): a, c, t, g, unknown or other
  misc_feature (280)..(280): n is a, c, g, or t
  modified_base (291)..(291): a, c, t, g, unknown or other
  misc_feature (291)..(291): n is a, c, g, or t
tcagcgtagactagcacgaccggtgctcgatttagtagtgtagatttgggtttgggagtcagtctcagtcaggacacagcatggacatggagggtccccgctcagctcctggggctcctgctactctggctccgagctgccagatgtgacatccagatgacccagtctccatccctcctgtctgcctntggtggggtcagacgtcaccatcacttcgaccggacagtcacggtacgtttaaaacctatttaagttggtatcagcaagaacctaggaaacncccagacctcngactctgtggtgctactcctatcgtaggcgtaaggtcggcctaccgtagtacggtaggttaccgaggttcggacagggttcgaacgttcggaggtaactagttactttacgaacttcctaccaacctactacccaaccgttaccgttactacggaaccccttaccggtagggtaacgttacgtttcgtaaccgtaacttaaccggttccttaaccgtttacgtacggttaaaccgtaaaccgtaacgtttaacccggttttaacccgtaccccggttttccccccgtaacggttacccttttaccgggttttacccggggaacccggttaaacccgggggaacttttaaaacgggttacggaaaccgtttaaaccgtaaaccggtaaaaccgggttccgtttcgggtaccggtaccgttaccgggaacccctacccgtaagttttccggttacccggttttaacc

SEQ ID NO: 207421 - DNA, 798 bp, Homo sapiens
  misc_feature: GYAE6OF01BIRGM.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatccttcttcttggtggcagcagctacaagtcgcccacctcccgaggtgcagctggtgcaggtcgtgggctggaggtagaagacgccgtcggggcctacgaggtagaacggttcctccgtcggacgaaggtccttcgtaggtacttaccttaccgtttaccctccttaatagtactacgtaacgtggtcgccgaccgacggtccgcgtacggaaccgtaacgccgtaggaggtcggaggtagggacggtacgggaaccgtaaacccgtaacgtacgtcggtcgtacgtacgtacgttcgttaccttccgaacccgtcgtcccgtaccggaacctaccgtaaccctaacctacgtaccgaaccctaaccgtaaccctaccctaacctaaacgtaaaccacgtaaccgtacccgtaacgtacgttagggtaggttaacggacggtaccgtccgacgtaacgtacgttacgaaccggaacccgtaaccgggtacccggttacccgtttaacgtttaaccgttaaccggtgggttaccggtacggtaaccgtacccggtaaccccgtacggtaccggttacgggaccggtacccggttaccccggtacggacccggtaccgggttacccgtttaccggtttcgggttacccggttcggggttaccccggggg

SEQ ID NO: 207422 - DNA, 713 bp, Homo sapiens
  misc_feature: GYAE6OF01AGWYH.17.25.C03.1.454.CMB.1.raw
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaggtctcctgcaaggcttcgtggtacttctacgtttacctcctatagtatcaacgtgggtncgcaggccgngtggacacgaccgtgagtggagtgggagtcgggaccgaaccctagcgtggtgtacacgtagtcgttccttaccacccgtactcccgtaccgggacacgtaccttaccacgtcgaacccacgtaacctccctaccaaactaaccacgtaaccgtaccctaacgtagtagggtaacgtttaggacggtaccgtcctaggaacctacgttaccgacggaaccggtacccggtacccgggttcccgtttaacgttaacgttttaccggaggttaccggaaccgggtacggtaaccccgtaccccgtaaccggtacccggttacccggggtggtaacccggtaccccggtaacgggcccgtaaccgggttccccgggtttaccgtttaccgggttcccggtttccggggtaaccccgggggg

SEQ ID NO: 207423 - DNA, 803 bp, Homo sapiens
  misc_feature: GYAE6OF01DDNK3.17.25.C03.1.454.CMB.1.raw
  modified_base (499)..(499): a, c, t, g, unknown or other
  misc_feature (499)..(499): n is a, c, g, or t
tcagcgtagactagcacgaccggtgctcgatttagtagtgtagatttgggtttgggactcaaacaaccacatctgtcctctagagaaaaccctgtgagcacagctcctcaccatggactggacctggaggatcctcttcttggtggcagcagctacaagtgcccactcccaggtgcagctggtagcagtcgtggggctggaggtgaacgaagccgtggggcctcgaggtagaagggtcctccgtgaccgaaggtccttcgtggacttctacgttttacctcctattagtatactaacgtggggtcgccgcgacgggccgcgtcggaaccaaccgaccgtgaggtggagtggggaacgtgggaccgaaaccccgtaacgcgtggtcgtaccacgtacgttcgtccttaccaccctcgtcccgtacccggactacgtaaccttacacgtcgaccaccgtaacctccctaaccaactaaaccaccgtacgtacctaaaccgngttaacgggtagttacgggaacggtacgtacccgttagtacctacgtttaccggtaacggaacccgggaaccggtaaccccggggttcccggttaacctttaacggttttaaccgtacgggttaccggtaacgggtaaacccggttacccggttaaccccggaaaccgggtttacccggttaaccccggggttacggaaacccgggttacccccggtaaacccgggtcccggtaacccgggttcccggggttttaaccccctttttcgggtaaacccgggtttccgggggttaacccggggggg

SEQ ID NO: 207424 - DNA, 881 bp, Homo sapiens
  misc_feature: GYAE6OF01AC3Z9.17.25.C03.1.454.CMB.1.raw
  modified_base (103)..(103): a, c, t, g, unknown or other
  misc_feature (103)..(103): n is a, c, g, or t
tcagcgtagactagcacgaccggtgctcgatttagtagtgtagatttgggtttgggggagtcagtctcagtcaggacacagcatggacatgacgggtccccgntcagctccgtggggctcctgctactctggctcgagctcgccagatgtgacactccagactcgaccctagtcctccactccctcctgtctcgtcctcgtgggtacgggtcagtacgtcaaccacgttacgacgttacggaccgtaacgtaaccgtacggtaacccgttaaacgtttaaaaacctttaagtttttaaacgttggtaactcgaacgacaaccgtaaaaccgtaacggaaaccgtaccctacgtacccttcgtactactcgtcggttacggtcaccgtacttacctaacctcgttgacggtaacggtcgtacccgttaccgtacggttcggtacgttacggacggtcggtaagcggtgtaacgttcggacggtacttacgtaactttaacaaccgttctacccgtaaacgtccttaaccaccgttaccttacgtacgaacccctaacggggtagtaacggttacgtacgttacgtaaccttaccttacgttaccgtttaaacgtaccggtaaacttaaaacccggtgggtttaaaccccgtttaaccggttacccccgtttaccccccgttaaacggttcccgtttaaccgggtttacccggggaaacccgggggttaaccgtaaaacgggttaaacccggtttaaccgggaaacggtttaaacccggttaaaccggaaaacccgggtttccgttacggggtaaacgggttaccccttacccgggtaccctttaaaccgtcccgtttttaacccggttcgtttaaccccggg

SEQ ID NO: 207425 - DNA, 712 bp, Homo sapiens
  misc_feature: GYAE6OF01BGB9U.17.25.C03.1.454.CMB.1.raw
  modified_base (361)..(361): a, c, t, g, unknown or other
  misc_feature (361)..(361): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactccttcttcgttggtggcagcagctacaagtcgcccactcccaggtcgcagctggtgctaggtcgtgggctggaggtagaagacggcgtcggggcctgaggtgaacggtcctcgtgcaaggtcttacgtggtacttctaccgtttacctactatagtactaccgtaacggtgggtacgccgccggaggtcccgtcgtaaccggaaccgtaaccgtacgtacggtagggnggtagggtacgggtacggtacgggacccgtaaacctaacgtcggttaggtcgtaccgtacgtggtacttccgttaccacccgtagtacccggtacgaacgtacgtaacccgttaacgtacgtaccggaaccgtaaccctaacttcccaacgtaaactaacccacgaacgtaccctacgtaggtacgggtaagtacggacgtaccgacttacggactcgtacggtccgaaactcgggaacccgttccgtagttcttaacggtcgtcggacgtacgacccgtcggaacgtcgtacggacgccgcggtaccgacggtacggcccgtttaaccgttcgtgggtcccgggtcgggg

SEQ ID NO: 207426 - DNA, 837 bp, Homo sapiens
  misc_feature: GYAE6OF01AE0DY.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaggtctcctgcaggcttcgtgattcacgtttacctcctatagtatcaacgtgggtcgcgccgacggccgcgtaggaaccaaccgtaccgtggaggtcggaggttagggggacgttccggggaaccctaaaccccgtaacgaccggtagggttccgtaccgacgtaaggttcgttacccttaacccgaaccccgtacgttccccggttacccgggggaacctaacgggtaacccctttaccgtaacgtacccgtaaaccccgtaaccgtaacccttaccccctaaccgtaaactaaaaacccgaccgtaaccgtaacccttaacgaacggttaacgggttacggttagggaaccgggtaaccgtcccgtaacggtaacctaccgtttccgtaaccgggaacccggtaacccggtacccggggttacccgtttaccgtttaaacgttttaccggtacgggttacggtaaccggaaccggtttacccggacccccgtaacgggtacccgttccggggtaaggtacccggtaccccggtaaccgggacccggtaccgggttacccggtttacccggttttaccggtaaccggttttcccggggaacccgggggg

SEQ ID NO: 207427 - DNA, 642 bp, Homo sapiens
  misc_feature: GYAE6OF01C8JKA.17.25.C03.1.454.CMB.1.raw
  modified_base (339)..(339): a, c, t, g, unknown or other
  misc_feature (339)..(339): n is a, c, g, or t
  modified_base (350)..(350): a, c, t, g, unknown or other
  misc_feature (350)..(350): n is a, c, g, or t
  modified_base (508)..(508): a, c, t, g, unknown or other
  misc_feature (508)..(508): n is a, c, g, or t
  modified_base (557)..(557): a, c, t, g, unknown or other
  misc_feature (557)..(557): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttggtggcagcagctacaagtcgcccactcccaggtgcagctggtgcgtagtcgtgggctggagtggaagaacgccgtggggcctcgaggtggtaacggtccgtccgtgacgtaaggcttgtggtacttcgtaccgtttacctctatagtactcgtaacgtgggtcgcgccgacggccgcgtacggactaacgcgacgnggtaggtaggngggtagtcgggaaccgtaaacccgtaagtacgtcggtcgttacacgtacgttcgtacgtacccacctccgtccgtaacggcgaacgtacctaccgtacgactaacccgactaccctccgtaacaactaacacgtaccgactagagtaccgagtgacgngctagcatcgtacgacgacgtacgtccgtcttacgttctacggctacgngaccccgtacaggtcccgtacgggtacgacccggtaccgtcgacccgtcgggtaccgttgttaccggttcgtccggggtaccggg

SEQ ID NO: 207428 - DNA, 843 bp, Homo sapiens
  misc_feature: GYAE6OF01EO956.17.25.C03.1.454.CMB.1.raw
  modified_base (686)..(686): a, c, t, g, unknown or other
  misc_feature (686)..(686): n is a, c, g, or t
tcagcgtagactagcacgaccggtgctcgatttagtagtgtagatttgggtttgggactcaacaaccacatctgtcctctagagaaaaccctgtgagcacagctcctcaccatggactggacctggaggatccttcttcttgggtggccagcagctacgaacgtgccccactcccgaggtgcacgtcgtggtgcctagtcgtggggctggaggtgaagtaacgccggttagggcctagagtcggtaacggtcctccgtaggacaaggtccttcgtaggttaactttccgttaaaccggttttccctaccgtaagttacgttacgttacgaaccggttggggtacgaccggccgtaacgggccgtacgttcgggaacttaacccgacgtggtacggtggtaggtacgggtacgttacgggaccctaaaccgtaacgtaggttcggtactacgacgtagttcccgttacacccgaaacggtccgttaccggtacccggtactaaccgttaaccgttacgtaacgtacgtaaccccgtaaccgtaacccttaccctaacctaactaaaccacgtaaccgtaacgacctagttacgggtacgtacggtacgggtactaccgtacgtaacgtcgtacgttaacgaacccgttaccgggacccgtttaccttaaacgtttacgttttaaccncggggtttacccgagggttaaacccgtaccccgggtaacccttaacccggggtacccgttcggtaaacccggccccgggttacggtaccccggaccgttaccggggtccccggtttacccgttttagggtccccggttacccgggggtacccggggg

SEQ ID NO: 207429 - DNA, 1061 bp, Homo sapiens
  misc_feature: GYAE6OF01AXALL.17.25.C03.1.454.CMB.1.raw
tcagcgtagactagcacgaccggtgctcgatttagtagtgtagatttgggtttggggtacgtcaacaaccacatctgtcctctagagaaaaccctagtgagcacagctcctcaccatggactggacctggaggatcctcttcttggtggcagcagctacaagtcgcccacctcccgaggtgcagctggtgcagtctggggctggaggtggaagaacggtccgtcgggggcctcgaggtggaaacggtcctccgtcggacgtaacgggtcctttcgtaggtactttccgtaaccggttttaccctaccgttaattacgttaacgtacctaacggtttggggtaccgcccggaccgacgggtcccggtacgttacggggaaccctaaaccgggtaccccgttagggaacgggtttaccggggaacggtttagggggggtaaccggtttaccggggggaaaccccgtaaaaaccccccggttttaaacggacccgggtttaggggttaccggttaacccgaacgggttaaacgggtttcccggtttacccttttacccccggaaaccccggttaaccccgttttcccggggtaacccccgggggtaaactaaaccccgggtttaaacccttttaaaccccggaaccgtttaaccccgggaaaacccccgtaaaccccggtttaaccccgttacccccgttaaaccccctaaaaacgtttaaaaacccccgaaccgtaacccgttaaaccccccgtaaccgggttaaacggttttaacgggggtaaccccgggttttaaagggaaaccgggtaaccccgggtacccttaagggtaacccttaaacgggtccttaaacgggaaccccgtaacccgggtacccgggtttacccttaacggtttaaaccgttaccggttgggtaaccccggtaggaaaccgggttcccctaacccggggtaccgtaacggtttcccggggaactaaccggtaccccggtaccgggtaccggtacgggtaccccggttttaccggtttaccgtaaccgggtttcggggaaccccggggg

SEQ ID NO: 207430 - DNA, 796 bp, Homo sapiens
  misc_feature: GYAE6OF01B4UMM.17.25.C03.1.454.CMB.1.raw
  modified_base (224)..(224): a, c, t, g, unknown or other
  misc_feature (224)..(224): n is a, c, g, or t
  modified_base (293)..(293): a, c, t, g, unknown or other
  misc_feature (293)..(293): n is a, c, g, or t
  modified_base (310)..(310): a, c, t, g, unknown or other
  misc_feature (310)..(310): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctgggaggatccttcttcgttggtggcagcagctacaagtgcccactcccaggtgcagctggtgcagtcgtggggctggaggtgaagagccgtggggcctnaggtgaaggtctccgtgacaggcttcgtggattcctacgttttacctctatagtatacaacgtgggtcnccggtccgagggcccgngtacggaaccaaccggtacctggacggtgggaagttggggaacgttcggggaacccctaaaaccctaacgtacgttgggtacgttactaacgtacggtcgttaccctacccgtaccccaaggttccccgtacggggaacctaacgtaacccttaccgaacgttccgaaccctaaccggtaacccttcccaacctaaacgtaaaccaccgtaacgtaccctaagagtttacgggaggtttaacgggacgggaccgtaccgttaacggaactacttaccggtacgaacccggtaacccgaccccggggtttacccgttaacgttttaactttacggtgtaaccgggtaccgaacgggttaccctacccccgggtaacggtaacccgggtttccgggaccgggttacccgtaccgggttaacccggccggttaacccgggtcccggggtttccttttaaccgggtccgggttttaccgggacccggggg

SEQ ID NO: 207431 - DNA, 666 bp, Homo sapiens
  misc_feature: GYAE6OF01CAYSC.17.25.C03.1.454.CMB.1.raw
  modified_base (485)..(485): a, c, t, g, unknown or other
  misc_feature (485)..(485): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagaacgccgtggggcctcgagtgaaggtcctcctgcgacggtcttcgtggtacttccgaccgtttacctaccttaatacgtactacaacgttgggtacgccgtccgacggcccgtcgtacggaaccaaccgtaccgtggaggtggagtggggacgtcgggaacctaaacccgtacgacgtggtcgtacgacgtagtcgttacctccaacccgtctcccggaccggatacgtaccgtaaccagtacgaaccctaacgtaacctccctaccgaaactaaaccnctacgtacctacgtaggtagtagttcggaacggtacgcgtagactatcgtacgaacgtacgtaccggtcctacttacgttacgtggtacgacgtaacgtccgtacccgacggtccgttccggagtaccgacggtaccggcgtaccggtccgttacgtttaccggtcgttcgggtaccgggg

SEQ ID NO: 207432 - DNA, 864 bp, Homo sapiens
  misc_feature: GYAE6OF01DZAP4.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctaacagtcgcccactcccgaggtgcagcgtggtgctagtcgtgggctggaggtgaagacgccgtgggcctgaggtgaacggtcctccgtgacgaaggtcttcgtggtacttcgtaccgtttacctacttaagtacgtactacgtaacggtcgggtcgaccgcccgacgggcccgtcgtacgggaaccgaaccggtaccgtagggtacggtagggtaggttacggggaacgggtaccggggtaacccgtaaaaccccgttaacggtacggttacgggttaccgttaaccgaaacggttcggtttaccggttaacccttacccggtaaccccgtaaccggttccccgggtaaccggggtaaaccttaaacccggttaaacccgttttaacccgacggttaacccgaaccccgaaaccgttaaccccctacctaaccgaaaacgttaaacccacgtaacccgtacttaacgacggttagggtaacggttaaggacggaccgtttacgacgtaaccgagttaccggacgtaaccgcccgtaaccgggtttcccttaagttacctacggttacggacccgtaaggtacccgtaacccgtacccggtacgggttaccgtaccgggttacggcccggttaccccgggtacggtaacccggtcccgggttaccggtttacccttttacggggtacccggtttcggtaaccccgggggg

SEQ ID NO: 207433 - DNA, 758 bp, Homo sapiens
  misc_feature: GYAE6OF01D867T.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagaagccgtggggcctcgagtgaaggtctccgtgcgaaggtcttcgtggtatttccgtaccgttttacctccttaatagttactactaacgtggggtacgccggaccgacggccgacgtacggaaccgaaacggtaccgtggaggtgggtaggtggggtaacgtacggggaccgaaacccgttaacgacgttcggtacgtaccgaacgttacggtacgttcctaccgaaccctacgtccccgtaccggggactacgtaaccgtttaccaagttaccgaacctaaccgtaacccttacccgtaaccaaactaaaaccacaaccgtacctaacgacggttacggtaacgggtttaggaacggtacggtaccctaagggtaccagttacgtaccggtaaccgaccggtaacccgggtccgtttacttaacgtttccgtagggtaccgacggtaacggtaccggtaccccgtacgggtaccggttaccgggtacgacccggtaccgtaccggcgtaaccggtccggttaccgtttacggtcgtttccgggacccgggg

SEQ ID NO: 207434 - DNA, 938 bp, Homo sapiens
  misc_feature: GYAE6OF01DX7HC.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggacctggacctggaggatcctcttcttggtgcagcagctacaagtcgcccactcccaggtgcagctggtgcagtcgtggggctgaggtagaagaagccgtggggccttcgaggtagaacggttcctcccgtgactaagggtctttcgtgggtaactttccgtaaccggtttttaccctaccgttaagttaaggttaacttaccgtaaaccgttgggggttaccgccggaccccgtaacggggccccgttacggtttaccggggaaaccttaaaccgggtaccccgttaggggtaaccgggtttacgggaaacggtttggggggaacgttaccgggggggaaacccgtaaaaccccctttaaaacgacccggttttaggggtcggttacccgaaaccggttaaggggtttccgtttaacccgtttccccaacccccgttaacgtttaccccccggtttaacccggggggaacctaaaccgggttaaaccccgttttaaaccccaaacgggtttaacccgtaaccccgaaaccggtaaaccccttaccccttaacccggtaaaaccttaaaaacctaaccccgaacggtaacccccttaagtaacggttagggttaacggtttacgggaacgggtacctacccgttacggaaccgttacttacgaacggtaccgaaccgtaccggggtaccgttacgttaacgttacgttcggcgaccggtaagtacccgtacccgtacggtacgtaccggtaggtaccggtacccgtacgggaccgtaccggttacccggtccgttttacgtacccggtttcgggacccggggg

SEQ ID NO: 207435 - DNA, 841 bp, Homo sapiens
  misc_feature: GYAE6OF01AQRN3.17.25.C03.1.454.CMB.1.raw
  modified_base (296)..(296): a, c, t, g, unknown or other
  misc_feature (296)..(296): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctgaggtgaagagccgtggggcctcagtgaaggtcctctgacaaggtcttacgtggtacttcgtaccgtttacctactatacgttataccaacgtgggtcncgccgtaggccgacgtggaccaacgcctggacggtgggacgttgggacgttcgggaaccgtaaaccccgttaacgaccgttcgggttacgtactacggtacggttcgttaccctttacccgaacccccgtaacgttaccccggttacccgggggaacccttaaacgggtaaccccttttaacccggaaccgtttacccggaaacccccgtaacccggttaaaccccttacccccgttaaaccccgtaaaaactttaaaaacccccgaacccgtaaaccgggtaccccctaaaacgtaaggtttaccggggtaacggttttacggaacgggtaccgtacccgtaacggtaacctacgttccgtaacggaacccgaaccggtaccggttccccgtttacgttaacgttccgttaggaccggtacggaacggtaccccgtaccccgtacgggttacccgttccgggtaacggaccggtacccgttacccgggagtcccggggttacccggttaccttttaccgggtcccggtttcgggggtcccgggg

SEQ ID NO: 207436 - DNA, 884 bp, Homo sapiens
  misc_feature: GYAE6OF01CU8QP.17.25.C03.1.454.CMB.1.raw
  modified_base (149)..(149): a, c, t, g, unknown or other
  misc_feature (149)..(149): n is a, c, g, or t
  modified_base (504)..(504): a, c, t, g, unknown or other
  misc_feature (504)..(504): n is a, c, g, or t
tcagcgtagactagcacgaccggtgctcgatttagtagtgtagatttgggtttggggactcaacaaccacatctgtcctctagagaaaaccctgtgagcacagctcctcaccatggactggactggaggactcctcttcttgggtgacngcagtctagaagtcgcccactccgaggtcgcacgtcgtgggtgcgtagtcggtgggctggaggtagaagacggccggtcggggcctacgtaggtacggtaacggtcctccgtacgacggtaacggtccgtttcggtacggttactttacccgtttacccgtttaccttaccgttaaagtttacgtaacgttaacgtaacgggttcggggtaccgtaccggccggaccgggtccggtaacggttaccgaaacccggttaaccgtccggttaacggagggttacgggtagggtacgggggtaacgtaaccccgggggtaaacccttaaaccccgaaacggttccggtacgggtaccnccgttaaacggtacggttttaccttacccgtacccgaacccttaccggtccccgggtaacggtaactaacggtacccttaacgaccgtaaccggtaacccgaaacccgtacccttaaccgtaaccgtaaaaacctaaaccgtaccgacccttaactaaacggtgggtttacgggtacgtaacgggacgtaccgtacgtacaccgttagtaccggcggtaacccggaacggttcccttacgttacttaacgttccgggtcgtacgggtaaccgtaccgaacccggtacccgtaacggcccggttacgggagttaacccgggccggtaaaccggccggtaacccgttaccggtttggttacggtccggtcgggtaacccggg

SEQ ID NO: 207437 - DNA, 928 bp, Homo sapiens
  misc_feature: GYAE6OF01C1A0R.17.25.C03.1.454.CMB.1.raw
  modified_base (180)..(180): a, c, t, g, unknown or other
  misc_feature (180)..(180): n is a, c, g, or t
tcagcgtagactagcacgaccggtgctcgatttagtagtgtagatttgggtttggggactcgaacaaccacatctgtcctctagagaaaaccctgtgagcacagctcctcaccatcggactggacctggaggtatcctcttcgttgggtgcagcagtctacagtcgcccactccgaggtncagtctggtgctagtcgtgggctggaggtagaacgacgtccgtaggggcctacgaggtgacggtcctacgtagacgaggtccttcgtcggtacttctaccgttaccttaccgtagtactactcgacggttaggcgacgtccggacggtccgtacgtacggaacctaaccgtaccggtacggaacggtcgggtaaggtcgggtacggttacccgggaacccgtaaaacccgttaacggtacggttacgggttaccgtacgtaaaccggtacgtttaccgggttcccttaaccgtaacccgtaccggtaacccggtttacccgggggaactaaaccgttaacccgtaaccctaggtacccggtaaacccgtaacccccggttaacttccccggtaaaccttaaaacgtaaaccccggtaccgtaaacttaaccccggtaaacggttacgggttaccggggtttaacggttaaacgggtaccgggtaacccgtaccggttaacgaaccgtttaaccggttaacccggaccgggaaccgggttaacccggtaacccgggttaccgtttacgtttaacccgttaacgggttcggtaaccggttaaccgggttccgtaaaccccgggttcccgtaaaccggggttacccgggtaaaccgggttccgtaaaccccggttcccggggtaccgacggttaacccgggttcccggtttaaacgtttccggggtaacggtttccccgggggtaacgggg

SEQ ID NO: 207438 - DNA, 674 bp, Homo sapiens
  misc_feature: GYAE6OF01BWFXN.17.25.C03.1.454.CMB.1.raw
  modified_base (188)..(188): a, c, t, g, unknown or other
  misc_feature (188)..(188): n is a, c, g, or t
  modified_base (305)..(305): a, c, t, g, unknown or other
  misc_feature (305)..(305): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctgggaggatcctcttcttggtggcagcagctacaagtcgcccactcccaggtgcagtctgggtnctgtcgtggggctaggaggtaggaagacgccgtggggcctcgagtggacgtcctcctgcgaggtcttcgtggtacttccgtacgtttacctcttaatagtatcgtaacgtggggtcnccgtccgaggccctgcggaacacggctggaggtggagtagggagtcgggaccaaccgtatacgtggtatcagtgtcgttacctaccaccgtacgtcccgtacggactacgtactaaccagtaccgacctacgtaaccctacctaactaactaaaccaccgtaacgaccctaagtacgtacgggtaagttacggaggtacctcggtacgtactacgtccgacgaccgtaaccggtcgtaccgttacttacgttacggcggtaacgtcgtaaccgtaccgtacccgtaggccggttacccggacggtccgaaccccggtaggtccggtaccggtccggtttaccgttcggaccgttccggggtacccgggg

SEQ ID NO: 207439 - DNA, 654 bp, Homo sapiens
  misc_feature: GYAE6OF01E0W0R.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggattctcttcttggtggcagcagctacaagtgcccactcccaggtgcagctggtgcagtcgtggggctgaggtgaagaagcctggggcctcagtgaaggtctcctgcaggcttctggattcacgtttacctcctatagtatcaacgtgggtgcgccgaggccgctggacaacgacctggagtggagtgggagtcggggaccgaaaccctaacgacgtaggtcgtacacgagttcgtccttaccacccctacgttcccgtaccggggacacgtaccttaccatcgaacccaccgaaccttccctaccaataaaccacacgacctaactagtagggtaagttgggaacggacgtccgtagaacctacgtcacggaaccgaccgaccgggtacccgttacttaacttacgttcggtacgaccggtaagtaccgtacccgaacggtaccggtccgggtacggaccgtacccggtaccggcggtaccggtcccggttaccgtttcggtacccgttccgggtaccgggggg

SEQ ID NO: 207440 - DNA, 705 bp, Homo sapiens
  misc_feature: GYAE6OF01B66MB.17.25.C03.1.454.CMB.1.raw
  modified_base (246)..(246): a, c, t, g, unknown or other
  misc_feature (246)..(246): n is a, c, g, or t
  modified_base (286)..(286): a, c, t, g, unknown or other
  misc_feature (286)..(286): n is a, c, g, or t
  modified_base (350)..(350): a, c, t, g, unknown or other
  misc_feature (350)..(350): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctcctgcaggcttgnggattcacgtttacctccgtatagtactcaacgtgggtanccgccgaggccgcgtaggaccaacggcctggagtggagtgggagtcgggaccgtaaccctaacncggttggtacgtacaacgtggttcgttccttaccaacccctagttccccggtccggggaacctaacggtaaccctttaacccgataccggaaccccaaccggtaacccttcccttaacccaaacttaaaacccgactaaccgtaccctaacgtagtacgggtagttcggaacggacgtacccgtgaacctagttccgtacggtaccgaccggtaccgggtacccttaacgttacgtttaccgtgggttacgcgggaacgtacccgtacccgaacggtccggttaccgggtacgacccggtccgtacgggccgtacgggtcccggtacgttttacgccggttcgggtacccggggg

SEQ ID NO: 207441 - DNA, 870 bp, Homo sapiens
  misc_feature: GYAE6OF01DFTRN.17.25.C03.1.454.CMB.1.raw
  modified_base (603)..(603): a, c, t, g, unknown or other
  misc_feature (603)..(603): n is a, c, g, or t
tcagcgtagactagcacgaccggtgctcgatttagtagtgtagatttgggtttgggactcaacaaccacatctgtcctctagagaaaaccctgtgagcacagctcctcaccatggactggacctggaggactccttctttcttggtggcagcagctaacaagtcgcccactcccaggtgcagcgtggtgctaggtcgtgggctggaggtagaaggacggcggtcggggccttacgaggtaggaacggtcctccgtagacgtaaggtcttcgtaggtactttaccgtaacccgttttacctaccttaagttagttactaccgtaggtcgggtacgcccgacgacgggtcccgtacgtaccggaaccgtaacccggtaccgtaggtacggtagggaggtcggggtacgtaccggggaacccgttaaaacccctaacggtcggttacggtacgtacccgtaagtacggtttccgtaccctttacccgaacccgtaccgtaccccggtaaccgggtactaaccggttaacccttaccgacttaaccgaacccctaaccgtacccttacccgaacctaaacgtaaaccacgtaacctaccttaaacgngggttacgggttaacgtacggaacggtacccgttcgtaccggaacttacgtaccggtacgaacccggttaacccggtcccgggttaactttaaccgggttaaccctttggggtaccgtacgggtaaacccgttaacgggtacccccgttaaccggaaccggtttccgggtacccgggttacgacccccggtaacccgggtagaccccgttaccggggttaccggtttaacccgttttaccgggtccgggtttcgggaccccgggggg

SEQ ID NO: 207442 - DNA, 675 bp, Homo sapiens
  misc_feature: GYAE6OF01DHZF1.17.25.C03.1.454.CMB.1.raw
tcagcgtagactagcacgaccggtgctcgatttagtagtgtagatttgggtttggggactcaaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtagaagaagccgtggggcctcgagtgaacggtctcctgacgaacggtcttcgtggtattcctaacgtttacctcctaatagtactctaagtgggtcgccgaccgacggccgcgtacggaacaaccgtacgtggagtggagtgggacgtcgggaaccaacccgtaacgcgttggtactacgaacgtacgttcgtccttccgaaccgtactcccgtaccgggacacgtaccttacagtacgaacctaaccgtaacctcccgtaaccaacgtaaaaccacgtacaaccgttacacgttagggtagttacggagtaccgtccgtagactacgtcgaacgacgaaccggccgttaccgtacttaacgttctggtacgaccggtacgaccgttaccccgaaggtcggtaccggacggacgtacccgtacgggacgtacgggtccgtttaccgtttagtaccgttccgggtaccgggg

SEQ ID NO: 207443 - DNA, 645 bp, Homo sapiens
  misc_feature: GYAE6OF01DJVO9.17.25.C03.1.454.CMB.1.raw
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgagggtgaagaagcctggggcctcagtgaaggtctccgtgcaaggcttctggattctacgtttacctcctatagtatcaactgggtncgccaggccgntggaacaacgacctggagtggatgggagtgggaccaaaccctaacacgtggtgtcaacagttgtcctttaccaacccctatcccgtacggggaactacgaaccttaccatacggaaccaacgtaacctcctaccaataaacacacgaccctaagagtgggagttaggaacggacgtctacgactagtcgtaacgaccgaaccgaccgggtacctacttaactttaccgtggtacgacggagtacccgtcccgaacggtaccggttacccgggtaggaccgtacccggtacggacccggtacgggtacccggttacccgttttacggtaccgtttccgggtaaccgggggg

SEQ ID NO: 207444 - DNA, 941 bp, Homo sapiens
  misc_feature: GYAE6OF01CU13R.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccagtggactggacctggaggatcctcttcgttggtggcagcagctacaagtcgcccacctcccgaggtgcagcgtggtgcgtaggtcggtggggctggtagggtagaacggaacgccgtcggggcctgaggtggacggtctccgtgacgacggtcttcgtaggtattaccgttaaccgtttaccttaccttaagtaacggttactaccgaacggttcgggtcgacccggtaccggaccggccggtaccggtaccggtaaaccgtaaccggtacccggtaggtagggttacgggaaggtaggggtaacggtaccgggaaaccccgttaaacccgtaacgtaccggtcggtttaccggacgtaacgtcgtttacgtcccttaccgtaacccctaccgttacccggtacccggtaccgaaccgttaaccgttacccgaacgtaccgtaacccgtaaacccggttacccctttacccaaacctaaaccgaaaccgacccgtaacccgttaccctaaaggtcggtttaacgggtaccggttaacgggaaccgggtacccgttaccgttaaggtaaacccttacgttaaccgggtaacccggaacccggtaaccggttaaccccggggtttaccctttaacgttttaaccgtaccggttcggggtaccggaaaccggtttaaccgggacccgttaaccccggttaaacgggtcccccggggttaggggtaaacccggacccccggttaccgttaacccgggggaccgttaaaccggggtttccccggtttacccgttttaaccggttcccgggtttcgggggaaaccccggggggg

SEQ ID NO: 207445 - DNA, 748 bp, Homo sapiens
  misc_feature: GYAE6OF01EYVSB.17.25.C03.1.454.CMB.1.raw
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgtaggtctccgtgcaaggtcttcgtggtacttccacgttttacctcctatagtatacaacgtgggtcgccgcccgacgggccgcgtacgggaccaaccggtaccgtggacggtaggagtggggagtcgggggaacctaaaccccgtaacgacgttagggtcgtacgaacaggttcgtaccttccgaaccctacgtccggtccggtaactacgtaccttaaccgacttaccgaaccgtaacccgtaaccttacccgtaacctaaactaaaccaacctaacgtcccttaacgacggttacggtaggttacgaggtaccgtcctaacgtaccgtacgttacgtacgaaccggaacccggttaccggtacccgtttacttacgtttaccgtacgggtacgtaccggaacgtacccgtaccccgtacggttacccggttacgggtacggtacccgtacccggttaccgggtaccgtaccggggttccgttaccgttttccggtacccgtttcggggtacccggggg

SEQ ID NO: 207446 - DNA, 762 bp, Homo sapiens
  misc_feature: GYAE6OF01E1WF5.17.25.C03.1.454.CMB.1.raw
  modified_base (198)..(198): a, c, t, g, unknown or other
  misc_feature (198)..(198): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgnggtgaagaagccgtggggcctcagtgaaggtctccgtgcaaggtcttctggacttcacgtttacctcctatagtatcaacgtgggtgcgccgaggccgcgtcggacaacgacctggaggtggagtgggacgtcgggacccgaaaccctaacgacgtgggtgtccgaacgtaggttcgttccttacccaacccgtactcccggtccggggaacctacgtaccttaacccagttaccgaacccaacggtaaaccccttcctaacccgtaaataaaacccgacccaacggtacccctaagtacggttagggtaacgttaacgggacggtaccgtccctaggaaccctgtacgttacggaacccgtaaccggtacccggggccctttaaccgttagtttaacccggttggtaccggtaccggtaacggttaacccggtacccccgtaagggtaacccgttccccggggttaaggtaaccccggccccggtttaaaccgggggccttaaccggggtcccccgggttaacccgttttttacggacccggttttccggggaacccgggggg

SEQ ID NO: 207447 - DNA, 665 bp, Homo sapiens
  misc_feature: GYAE6OF01BOW8N.17.25.C03.1.454.CMB.1.raw
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagccgtggggcctcaggtgaacggtctcctgctaaggcttcgtggtattctacgtttacctaccgtatagtactctaacgtgggtcgccgaccgacggccgcgtacggaccaaccggtacctggacggtaggaggtagggtagtcgggaccgaaaccctaacgtacgtggtacgtcacgtagtcggttcctacaccctacgtacccgtaccggacacgtacttacactacgaccacgacctacctaccgaactaacaccgtaacgtcctaacaggtacggtaggtagacggaccgtcgtacgaactacgtcgtaccgaacggaccgtaccgggtccttacgttaacgttacgtacggtacggacgtacgtccgtacccgtacgtaccggttccggtaggccggtaccgtaccggacggtcgtacccggtaccgtttcgtcccggttcgggtacccgggg

SEQ ID NO: 207448 - DNA, 745 bp, Homo sapiens
  misc_feature: GYAE6OF01D8YGO.17.25.C03.1.454.CMB.1.raw
  modified_base (153)..(153): a, c, t, g, unknown or other
  misc_feature (153)..(153): n is a, c, g, or t
  modified_base (218)..(218): a, c, t, g, unknown or other
  misc_feature (218)..(218): n is a, c, g, or t
  modified_base (512)..(512): a, c, t, g, unknown or other
  misc_feature (512)..(512): n is a, c, g, or t
  modified_base (575)..(575): a, c, t, g, unknown or other
  misc_feature (575)..(575): n is a, c, g, or t
  modified_base (607)..(607): a, c, t, g, unknown or other
  misc_feature (607)..(607): n is a, c, g, or t
  modified_base (649)..(649): a, c, t, g, unknown or other
  misc_feature (649)..(649): n is a, c, g, or t
tcagcgtagactagcacgaccggtgctcgatttagtagtgtagatttgggtttgggggactcaaacaaccacatctgtcctctagaagaaaaccctgtgagcacagctcctcaccagtggactggaccgtggaggactccttcttcgttgggnggcagcagctaagacggtcgcccactcccgaggtcgcgagtcgtggtgacgaggtcggtcggggntaggtaagggtagaaacggtacggccggtaggggccttagaggttcggaacggtcctccgtagacggtaggttccttggtaggttacttaccgttaaccgtttcctacttagtaacgttactaccgtaacgggttgggaccgaccgtaccgggacggccggttaaccgagggtaaaccctaaccgggaccgtggtaacgggtagggacgggtagggtacgggtacccggaaccgttaaaaccgtacggtcggttaggacgtaacctacggtagtttccctcccgtacctaaccncggttacccgtacggactacgtaacgtacacgtacgaccgtactacctcctaacaactaaccnctaaccgactagtagtacggtagtcgagtacncgtacacgtcacgtacggaccgaccgtcgtcgttattacgtnacggtcgacgtaccgtccgaccgtacgggtctaccggtagacccgtcgggacgttaaccggcggttcccggtgttacggttccggcggggttacgg

SEQ ID NO: 207449 - DNA, 684 bp, Homo sapiens
  misc_feature: GYAE6OF01BS7J3.17.25.C03.1.454.CMB.1.raw
  modified_base (231)..(231): a, c, t, g, unknown or other
  misc_feature (231)..(231): n is a, c, g, or t
  modified_base (245)..(245): a, c, t, g, unknown or other
  misc_feature (245)..(245): n is a, c, g, or t
  modified_base (263)..(263): a, c, t, g, unknown or other
  misc_feature (263)..(263): n is a, c, g, or t
  modified_base (372)..(372): a, c, t, g, unknown or other
  misc_feature (372)..(372): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgccccactcccaggtgcagctggtgcagtcgtgggctggaggtgaagagccgtgggcctgagtgaggtcncctgacaaggcttnggtattccacgtttaccnctatagtatacaacgtgggtcgcgccgaggcccagtcggaaccaaccggtacctggaggtaggagtggggacgtcgggacccaaacccgtacacgtggtcgtacaacgngtttcgtccttacccacccgtacgtcccgtacgggaacacgtaccttacgactacgaacccacgaacccttaccctaacctaaactaacccgacaccgtaaccctaagtaaggtcggtagtaacggacggaacgtccctagactacgtcgtaacggtaaccgaccgtaccgggccttacgttaataccgtggaccggtacgaacgtccgtaaccccgacgtaccggtaccccgggagtaccccgggacccgtacgggaccgtacgggttaccccggttaccgtttaccggtaccgttcggggtacccggggg

SEQ ID NO: 207450 - DNA, 674 bp, Homo sapiens
  misc_feature: GYAE6OF01EIXD0.17.25.C03.1.454.CMB.1.raw
  modified_base (242)..(242): a, c, t, g, unknown or other
  misc_feature (242)..(242): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcagtgaagtctctgcaaggcttcnggattcacgtttacctcctatagtatcaacgtggtcgcgccgaggcccgctacggacaacggcctggagtggagtggggagtcgggaccgaaccccttaagacgttgggtcgtaccgaacgtaggttcggttcctttaccgaaccccgtagtccccggtaccgggaccgtaacgtaccctttaccaacgtccggaaccctaaccgtaaccctccctaccaaactaaaacccacgaccgaccctaacgtagtacgggtaacgtttaggacgggtacgtacccttaggacctacgtcgtacggaaccgaccgtaccgggtccgttacgttacgttacgtggtcgacggtacgtaccggaccctaggtaccgttaccgggagaccggtccgtacggcgacggtcccggttctttacgtaccgtcgggtaccgggg

SEQ ID NO: 207451 - DNA, 681 bp, Homo sapiens
  misc_feature: GYAE6OF01AL646.17.25.C03.1.454.CMB.1.raw
  modified_base (256)..(256): a, c, t, g, unknown or other
  misc_feature (256)..(256): n is a, c, g, or t
  modified_base (585)..(585): a, c, t, g, unknown or other
  misc_feature (585)..(585): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtagaagacgccgtggggcctgaggtgaacggtcctcgtagcaacggtcttcgnggtacttcgtaacgtttacctacctatacgtactcaacgtgggtcgcgccgacggcgtacgtggaaccaacgaccgtgacggtggagttagggattacgggacctaacccgtaactacgttggtcgacgtacgtagttcgttactacgaccccgacgttcccgtaccggggactacggtaccttaaccagtaccgaaccgtacgtaacctcccgtaaccaataaacccgacgtaaccgacgtaacgagttacgggacgttacggaacgacgtacctgaaccctagttaccgacggaaccgaccggtaccgttaccgtacttacgtacgnggtacgaccggtagaccgtaccctaggtcctacgggtacgaccggtaccgtacggccgtacggtacgttaccgttcgtaccgttcgggtaacgggg

SEQ ID NO: 207452 - DNA, 717 bp, Homo sapiens
  misc_feature: GYAE6OF01CSU8G.17.25.C03.1.454.CMB.1.raw
  modified_base (101)..(101): a, c, t, g, unknown or other
  misc_feature (101)..(101): n is a, c, g, or t
  modified_base (298)..(298): a, c, t, g, unknown or other
  misc_feature (298)..(298): n is a, c, g, or t
  modified_base (707)..(707): a, c, t, g, unknown or other
  misc_feature (707)..(707): n is a, c, g, or t
tcagcgtagactagcacgaccggtgctcgatttagtagtgtagatttgggtttgggagtccagtctcagtcaggacacagcagtggacatgaggtccccgntcagctccgtgggctcctgctactctggctccgagctgccagatgtgacatccagatgaccctagtctccatcctcctgtctgcctcgtggtggggtcagacgtcacctagtccacgttcggaccggactaagtccgacggtaaccgtttaaaaccttaatttaaattggtactcagcaagaaaccgtaggaaaacnccccgagtaccctctagacttcgtcgtgtcgctactcccgacttacgtcgtaacggtaacggtcggaccgtcccaaagttccggtacgttaccgaaggtcgggtactaacggtgggtaacttcgggtacgggtaactggttaactttaaccaaacgttcaccctaacctactaccctaaccctacgtttaccgacggtaacccgtaccgttagacggttaagttcgtaacgaactaaccgttaccttaaccgtactacgtaacctaaacgtaacggttaccgttaaccctaacccgttccctaccgttacggttaccgtttcgggaacccggtacgggtaacctaaaggttcgaagtaccgtacgaaacggtacgttcggtacgtaccgtagtaaccctattaacgttntcgttacccg

SEQ ID NO: 207453 - DNA, 856 bp, Homo sapiens
  misc_feature: GYAE6OF01EX92V.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccgaggtgcagctggtgcagtcgtggggctggaggtgaaagagccgtggggcctcagtgaaggttcctccgtagcaggtcttcgtggtacttctaccgtttacctcctatagtactcaacgttggtacgccgccgacgggtccgcgttacggaaccgaaccgaccgtggtaacggtacggagttagggggacgtcgggggaaccccgtaaaaccctaacgacgttcgggtcgttaccacggtacggtttcgtcctttacccaacccgttaaccgttccccggtaccgggtaacccgtaacgttaaacccctttaccgtaacgtaccggtaaaccccgtaaccgtaaacccctttaccccgtaacccaaaaccgttaaaacccaccgtaaccgtacccttaaacgaacgggttacgggtaacggtttacgggaacgggtaccgtacccggtaacggtaactaaccgttccggtacggtaaccccggaaccgtacccgggttacccgttacgtttaaccgttaacgtcggttacggacccggaacggtttacccggacccgtaaccgggttaccggttacccggggtaacggtacccggttacccgtaaccgggttaccccgaaccggggttccccgggtttaacccgttttaccggggtaaccggttttcccggggtaaacccgggggg

SEQ ID NO: 207454 - DNA, 889 bp, Homo sapiens
  misc_feature: GYAE6OF01C53B9.17.25.C03.1.454.CMB.1.raw
  modified_base (189)..(189): a, c, t, g, unknown or other
  misc_feature (189)..(189): n is a, c, g, or t
tcagcgtagactagcacgaccggtgctcgatttagtagtgtagatttgggtttggggactcaacaaccacatctgtcctctagagaaaaccctgtgagcacagctcctcaccatgactcggacctggaggactcctcttcgttggtggcagcagctacaagtcgcccactcccaggtcgcagtctggcncgagtccgggggactggagtagaagacgccgtggggcctgagtacgtaacggtcctacgtgacgtacggtcctttcggtaggtactttaccttaacccggttttacctaccgttaagttaacggttacttaaccgtaacgggtttcggggtaccgacccggaccccggtaacgggtcccgtacggtaaccggaaaccgtaacccggttaccgttaaggggaccggtacggggtaagggttcggggtaaacggtcccgggtaaaccccgtaaacccgtaacccggtagggttccgggtacttaccggaccggttaggtttacccggttacccttaccccaacccgttacccggtcccggttaaacccgggaccaaccggtttaccttaaccgacgtaccaacccggtacctaacccctaccttaacgaactaacgaccctacgtaactagtacgtagggttacgtacggaacgtccgtaccgtacgtaaccgtcgttaacccggaacgtaacccggacccgggtacccttccgttaacgttaccgttttacggaccgggtaccttacgggaccgttaccccggtaaccggtaccggtacgggacccggggtttacgaacccccgttacgggttacccggacgggttcccgggttacccggtttatttcccgggttacccgggtccgggggtacccccgggg

SEQ ID NO: 207455 - DNA, 920 bp, Homo sapiens
  misc_feature: GYAE6OF01CX88R.17.25.C03.1.454.CMB.1.raw
  modified_base (185)..(185): a, c, t, g, unknown or other
  misc_feature (185)..(185): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttagtggtagcagctacaagtcgcccacctccaggtgcagctggtncgagtcgtgggctggaggtagaagacgccgtgggcctcgagtgtaaggtctccgtgacgtaacggtcttcgtaggtacttacgtaccgttttacctaccctaagttacgtaactcgtaaacggttggggtacgccggacccgacgggcccgtacgttacgggaaaccaaccggtacccgttggaacgggttgggaacggttcggggaacggtttaccggggggaaacccctaaaaccccccgttaaacggaccccggtttaggggttaccgtaacccgtaacggttacgggttacgggttttacccttaccccgaaccccccgttaagttacccccgggtacccgggggaaaccttaacgtaaccccgttttaacgaccgtttaaccggaacccgaaacccggttaaccctaccccgtaaacccttaaacgtaaaaccccgtaacgtacccggttaacccttaaacctaagggttacgggtaacgtttacgggaaccggtaacccgccgttaacgtaactagtccccgtaaggtaaccccgaaccgtacccgggttcccttaacgttaaccggtttacgtaccgggttacgaacccggtaaggtcccggtaacccccgtaacggtacccggttaccgggtaggtacccccggtcccgtaaccggggcccgtaaccgggtccccgggtttccgttttaaccgggcccgtttcggggcccgggggtaaacccccggg

SEQ ID NO: 207456 - DNA, 931 bp, Homo sapiens
  misc_feature: GYAE6OF01C22WH.17.25.C03.1.454.CMB.1.raw
  modified_base (216)..(216): a, c, t, g, unknown or other
  misc_feature (216)..(216): n is a, c, g, or t
tcagcgtagactagcacgaccggtgctcgatttagtagtgtagatttgggtttggggactcaacaaccacatctgtcctctagagaaaaccctgtgagcacagctcctcaccagtggactggacctgggaggatcctcttcgttggtggcagcacgctaacgaagtcgacccaccgtcccgaggtgacgagtccgtgggtcgacgtaggttccggngggggtccgtgggtaaaggggtaggaaacgggaacgggtcccggtcggggggtaccctacggtaaggttacgggtaaacgggttcctcccggtacggtaaccggaacgggttcctttacggtacgggttaactttacccgttaacccgttttaacccgtaccttaagttaacggttaactccgtaacggtggggtcgccggtccgacgggccgacgtacggaaccgtaccgtacgtaggaggtaggtacggtagggacgtacgggaccgaacccgtagtacggtggtcgtactacgtacgttcgtccgtaccgacccgtaccggtccgacggaactaccgtaaccttaccgacgtaccgaacccaccgtaccctaccgtaacctaaaccgtaaccgacctaacgtacctacgtacggtagtaacggtacggacggtaaccgtccgtaacgtacgtaccgttacgtaccggtaacccggacccggtaacccgggtaccgttaacgtttacccggttaacgtacgggtaaccggtaaccgggtacccggtaacccggttaaccccggacgggttaaaccccgggttaccggggtaacccgggtaccccgggtaaccccggggttaccggggtacccggtaaccgggggtttaccccccggtttacgggttttaaccccgggttaccccgggggtttcccggggtaaccccggggggg

SEQ ID NO: 207457 - DNA, 806 bp, Homo sapiens
  misc_feature: GYAE6OF01CMWB5.17.25.C03.1.454.CMB.1.raw
  modified_base (240)..(240): a, c, t, g, unknown or other
  misc_feature (240)..(240): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtcgcccactcccgaggtgcagctgggtgctagtcgtggggctggaggtgaaagacgccgtgggcctgagtgaggtctcgngcgaggtcttgtggtattcctaccgtttacctctatagtataccgaacgttgggtacgcggtccgacgggcccgtacgtacggaacctaccggtaccgtggaggtggagtgggagtcgggacctaaaccctacgtcggtggtcgtacacggtacgttcgtacccgttcccaacccgtaccgtcccggtacccggggtaactaaccgggttaaccctttaacccgacgttaaccgaaccccgtaaccgttaaccccttaccccgtaaccctaaaactaaaaccccgaccgtaaccgtaacccttaacggtacggttacgggttaacgggttacggaaccgggccgtaccgttaggaccttaaccgtcggttaacccggaacccggtacccgggttaacccgggttcccgtttaacgttaaccgtttacgtcgggtacggtaccgttaccgggacccttccccggaaacggttcccggtaccgggtaccggtcccggtaacccgggttaccggaccgtaccggggttcccgtttacggtttccggtcgggttcccggggtaccggggg

SEQ ID NO: 207458 - DNA, 577 bp, Homo sapiens
  misc_feature: GYAE6OF01CY8HX.17.25.C03.1.454.CMB.1.raw
  modified_base (331)..(331): a, c, t, g, unknown or other
  misc_feature (331)..(331): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattctacgttttacctcctaatagtatcaactgggtgcgcaggccgctggacacgactgagtggatgggatgggacaaccctaanacgtggtcgtcacgagtcgtcttcacccatccgtcggactagaccttacatcgaaccacgtaacctcctaccaataaaccactacgacctaacatgggagttggagacgtcctagaactatcgtaggaaccgtacgaccgggtacctactacgtttacgtgtcgagtacgacgtaccccaggtacgtccgggtgaacgtccctaacgggcaacggtcggttacctttgacccgtttggtacggggg

SEQ ID NO: 207459 - DNA, 680 bp, Homo sapiens
  misc_feature: GYAE6OF01AFCAU.17.25.C03.1.454.CMB.1.raw
  modified_base (230)..(230): a, c, t, g, unknown or other
  misc_feature (230)..(230): n is a, c, g, or t
  modified_base (264)..(264): a, c, t, g, unknown or other
  misc_feature (264)..(264): n is a, c, g, or t
  modified_base (288)..(288): a, c, t, g, unknown or other
  misc_feature (288)..(288): n is a, c, g, or t
  modified_base (302)..(302): a, c, t, g, unknown or other
  misc_feature (302)..(302): n is a, c, g, or t
  modified_base (307)..(307): a, c, t, g, unknown or other
  misc_feature (307)..(307): n is a, c, g, or t
  modified_base (314)..(314): a, c, t, g, unknown or other
  misc_feature (314)..(314): n is a, c, g, or t
  modified_base (325)..(325): a, c, t, g, unknown or other
  misc_feature (325)..(325): n is a, c, g, or t
  modified_base (419)..(419): a, c, t, g, unknown or other
  misc_feature (419)..(419): n is a, c, g, or t
tcagcgtagactagcacgaccggtgctcgatttagtagtgtagatttgggtttgggagtcagtctcagtcaggacacagcatggacatgacgggtccccgctcagctcctggggctcctgctactctggctccgagctgccagatgtgacatccagatcgacccagtctccactccctcctgtctcgcctcgtgggtggggtcagacgtccacgactcacgttgccgaanacgtcacggtactttaaaactatttaaatggtancaagcaacgaaaccgtaggaaacnccctagcctcgtanactcncgtagcncactccatcgngacgagtcgacctccagtcgaaggttcaggtcgatcggtagacgtcgaggtacattaacgttacacttccacaccacgtaaccacctcgttacncggtaaccctacggtagtacggttatttacgggactaaccttaataccgttaaccgttacgtaacgttaaccaaacgtaacgttaacgtttacccggttaacccgttcccttaacgtacgttttaaccggttaccgggaaaaccggtaaccggggtaaacgttaaacgttaacgaacgggtaaaccttaaaaccgggtaacgtaaccgttgggaacccgttcgaaacttacccgaactacgggttttactcccgttaaccc

SEQ ID NO: 207460 - DNA, 745 bp, Homo sapiens
  misc_feature: GYAE6OF01BL500.17.25.C03.1.454.CMB.1.raw
  modified_base (380)..(380): a, c, t, g, unknown or other
  misc_feature (380)..(380): n is a, c, g, or t
  modified_base (723)..(723): a, c, t, g, unknown or other
  misc_feature (723)..(723): n is a, c, g, or t
tcagcgtagactagcacgaccggtgctcgatttagtagtgtagatttgggtttgggagtcagtctcagtcaggacacagcatggacatgagggtccccgctcagctccgtggggctcctgctactctggctccgagctgccagatgtgacatccagatacgacccagtcctccactcctccctgtcctcgcctgtggtcgggggtacagagtccaacctatctaccgttcggaccggaacgtaacgtaccgaaccggttaaccgtttaaaaaccttaattttaaaagttggtaactaccgaagacctaaaacggaaaaccgttacggaaaaacccgccccaacgtaccccttccgtacgtaacttccgtcgtagggtacncctaccttacccacgttaccggtaggaaccgtaagggttccggtacccgtacccgtaacggtaccggtacggttaccgtaagggtcggtacgtaacgggttcgtaacgttcgggtaacgggaacttaagtacctttaacgaaaccttaccgactactacccacgtaccttcgacgaactacgtggtaagtagttcacgtactaatccgtaactagtcgaactacgtagttactacctaccgttccctgtacctttacggtccggacgtaaccgggaacttacggttagaacgaaccgtaaccggtaaacgtagtccgggtaacgtcttaccgacctaacgttnttccgttcgttaaccttacccg

SEQ ID NO: 207461 - DNA, 840 bp, Homo sapiens
  misc_feature: GYAE6OF01DFGBH.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgccgagcgtggtgcgtagtcgtggggctggaggtagaagaagcgtggggcctcgagtagaggtctccgtgacgaaggtcttcgtggtactttaccgtaaccgtttttaccctaccttaagttaacggttaactacgtaaaccggttgggggtacgccggtcccggaagggccccggtacgtacggaacccgtaaaccggtaccgtaggtagggttggaaggttaggggacgttaccggggaacctaaaccccgtaagtaccgttgggttacgaaccctaagtaggttccgtacctttacccaacccgtaccgtttacccggaccggggaactaccggttaaacctaacccgtaaggttacccgaacccgtaaaccggttaacccttaccccgttaaaccgaaaaccttaaaacccgaacccggttaactaaccccgtaacgttaagggtaacgggttaacggtttaacgggaacggtaccgtacccgttaggtaaaccttacggtacgtaccgggaaccgaaccggtacccggggttaccttacgttaaacgttcggtacgcggttaaccggaacgttaccgaacccgtacggtacggtacccggtaggccgtacccggaggaccgtacgggtcgttaccgtttcgtaccggtcgggtaccgggg

SEQ ID NO: 207462 - DNA, 898 bp, Homo sapiens
  misc_feature: GYAE6OF01BL9LR.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctgggaggatcctcttcttggtggcagcagctacaagtcgcccactcccgaggtgcagctgggtgcagtcgtggggctggaggtgaagagccgtggggcctcgagtgaaggtctccgtgacgaggtcttcgtgtacttctaccgtttacctccttaatagttactacaacggttgggtacgccggaccgacgggcccggaccgtacggggaaccctaaccggtaccgttagggtaggttcgggtaggtacgggggtaacggtaccgggggaacccgtaaaacccccgtaaacgtacggtttcgggttacggtacctaacggtaggttcggttacccgttacccacccccgttacgttccccggtacccgggtaaccgtaacggttaaccctttacccgaacgttacccgaaacccgtaacccgtaacccttacccctaaccttaaacctaaaacccgaaccctaaccggtacccctaaacgtaacggtacgggtttaacggtacggtaacgggtaccgtacccgttacgtaaccgtactacgggtaccgaaccggtaacccgggacccggttacccgtttaccgtttaacggttaccgttacgggtaccgggtaccggtaaccggtacccggtaccccggtaaccgggtttaaccgggttccccgggtaacgggtacccggttacccccggggtaaccggggtacccgtacccggggttacccgggtttacccttttacggggttaaccccggtttcggggtaaccccggggggg

SEQ ID NO: 207463 - DNA, 615 bp, Homo sapiens
  misc_feature: GYAE6OF01B4M0P.17.25.C03.1.454.CMB.1.raw
  modified_base (225)..(225): a, c, t, g, unknown or other
  misc_feature (225)..(225): n is a, c, g, or t
  modified_base (274)..(274): a, c, t, g, unknown or other
  misc_feature (274)..(274): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatcgacccagtctccatccctccctgtctcgcctcgtggtgggggtcagagtcaccatcacttgccgganagtcacggtacttaaaactattaatgtatcagcaagaacctaggaaacncccagacctctgatctcgtggtgctactccactcgtgacgtaggtcggccgtaccagttcggtacggttcgaggtcggacgtaggtggtacttcggtacgggaactacggttaactttaccaaacgttccctacaacctactacccacctacctctacgacctaacgtggtacgtattgtacgtactaactctaacgttactacgtacctaacgtagttaacgttacctaccgtttcccctcgttacttaccggtttcggaccggtaacgggtaactaaggtacgacgtaacgtaacgtaaacgtacgtacgtcgtactcgacctacctcttcgtcgttcc

SEQ ID NO: 207464 - DNA, 830 bp, Homo sapiens
  misc_feature: GYAE6OF01C0HFW.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagcgtggtgcgtaggtttggggctggaggtgaaggacgccgtggggcctacgaggtaggaacggtcctcctaggactaaggtcttcgtggtacttcgtaccgtttacctacttaagtagtactaccgtaacgtgggtacgccgaccgtacgggcccggtacgtacgggaacctaaaccgggtaccgttagggtacgggttaggggtaaggttagggggaacgtaccgggggaaaccccgtaaaaccccgtaacggtaccggttgggttacgtaccgtaacggttacggttccgttacccttcccgaaccccgttacgttccccgggtacccgggtaactaccggttaacccttaacccgacgttaacccggtaacccgaaccggtaaacccttaccccgtaaccctaaactaaacccgaccgtaacgtaccctaagtaacggtcgggtaacgttacggaacggtacgtccgtacgaactacgtacgtaccggaacccgtaccggtaccgggtacccgttacttaacgttacgtacgggtacgtacggtaacggtaccgtacccgacggtaccggtccgggtaggacccgtaccgtaccgggaccggttcggtcccggttaccgttggtaccggttcgggtcgggggaacccgg

SEQ ID NO: 207465 - DNA, 809 bp, Homo sapiens
  misc_feature: GYAE6OF01CJSP9.17.25.C03.1.454.CMB.1.raw
tcagcgtagactagcacgaccggtgctcgatttagtagtgtagatttggggtttgggggagtcagtctcagtcaggacacagcatggacatggacgggtccccgctcagctccgtggggctcctgctactctggctccgagctgccagatgtgacatccagatcgacccagtctccatcctccctgtctgcctcgtgggtggggtcagacgtaccacctatcctacgttcggaccggaacaacgtacgaacggtaaccgtttaaaaccttaatttaaagttcggtatacgaggtacaaacgtaaaccgtacggaaaaccgcccaaggacccttctagacttccgtacgttgggtcacctacgtaccctacgttcgtacggtacggtaaggtccgggcccgttaaccctaggtaccgggtaacgggtttcaagggttcggtaacgtaagggttcgggtactttcgggacgggtaactaaggtttacttttaacgaacttcctaacctaacccgtaactacctaacccgtactacgtaccgtaaccctaaccggtaggtaaagggttctttagggtaacaacttaaacgttacccttaacttaacggtagtaaaccctaaacgtaacggttaaccggtttaaccctaccccggtttacccccgttaggttacccgtttaaccgggtttccggggaaacccgggtaaacgggggtaaacccttaaaaggttcggaaacttaaaccgtaaaccgtaaaacggttacgtcgggttacaccgttcgaaccctacttacttcgttacccgtttacc

SEQ ID NO: 207466 - DNA, 824 bp, Homo sapiens
  misc_feature: GYAE6OF01CUL25.17.25.C03.1.454.CMB.1.raw
  modified_base (396)..(396): a, c, t, g, unknown or other
  misc_feature (396)..(396): n is a, c, g, or t
tcagcgtagactagcacgaccggtgctcgatttagtagtgtagattttgggtttggggactcaacaaccacatctgtcctctagagaaaaccctgtgagcacagctcctcaccatggactggacctgggaggatcctcttcttgggtggcagcagctaacaagtcgcccactcccaggtgcgagcgtggtgcaggtcgtggggctggaggtagaagacggccgtcggggcctcgaggtgaacggtcctacctcgacgtaaggtccttcgtgggtactttaccttaacccggttttacctaccgttaagttacgttactaccgtaacggttgggtcgacccgccgacggcccgtacgtaccgggaacaacccggacgttggaacggtgggtaacggnggggtacggtacggggtaaccctaaaaccccgtaacgtaccggttaggtcctacgaacggttacgttcgtaccctttacccacccgtaccttacccggtacccgggataaccgtttaaacccgttccgaacgttacccggtaacccgtaaccgttaacccgttacccctaaacccgttaaaacaaaccaaaccgtacctaacccgttaagaacgggttacgggtaaggttcgggaccgacgtaccccgtagacctagttacccgaacggtacccgacggttaccccgggttacttacgttaaccgttgtaccggacgtacggtacgaccggttaccgacggttacgggtcccgtaacggccgggttaacccgaccggtacgggtacccgtttccgggtatttcccggtacgtccggggtaaccggggg

SEQ ID NO: 207467 - DNA, 735 bp, Homo sapiens
  misc_feature: GYAE6OF01AQTUN.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagaagccgtggggcctcgagtgaaggtctcctgcaaggtcttcgtggtacttctacgtttacctacttatagttactctaacgtgggtcgccgtccgagggcccgtcgtacggaaccaaccggaccgtggaggtgggagtgggagtcggggaccaaacccgtaacgacgtcggtcgtacgacgtaggtcgttccttaccgaccctacgtcccgtaccgggactacgtaaccttacgacgtaccgaaccctacgtaaccctccctaaccaaactaaaccacgtaccgtacctaacgacgtgggtaacgttggaacggtacgtcccgtagtaacacgttacgacggaaccggtaccgacccgggttcccgttaacttaccgttaccgtacggtaccgggtaaccgtacggtacccggtaccccgtaaccggtccggttacccgggtaccgtaccgggttcccccggtaacgggtcctaaccggggttcccgttacccgtttcgggttacccggtttccggggtaacccggggg

SEQ ID NO: 207468 - DNA, 735 bp, Homo sapiens
  misc_feature: GYAE6OF01B5SDQ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcgagtgaacggtcctccgtgcaaggtcttcgtggtacttctaccgtttacctacctatagtatcaacgtgggtcgccgccgaggcccgcgtcggaccgaacgaccgtggaggtggagtgggagtacgggaccgtaaaccctacgacgtggtcgtcacgtaagttcgttccttaccaccctacgtcccgtacccgggactacgtaacccttaccgacgtaccgaaccgtacccgtaacccttccctaaccaaaccttaaaccacctaaccgacccttaacgacggttagggtacggtttacggaacgggtaccgtcccgtaaggtaacctacgttaccgacgggtaacccgacccggtaccgggtaccctttacgttaaccgtttaccggtaggtaccggtacggaaccgttacccggtaccccgaccggttacgttacccgggtacgcccggtacccgtacgggcgtacccggttaccggttaccctttcgggacccgtttccgggtaccggggg

SEQ ID NO: 207469 - DNA, 736 bp, Homo sapiens
  misc_feature: GYAE6OF01AC145.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagacgccgtggggcctcagtgaaggtcctccgtgcgaaggtcttcgtggacttactaccgtttacctctaagtagttactcgaacgtgggtgccggaccgtaggcccgtcgtacgggaaccaacgtaccgtgggaacggtggacgtgggacgtacggggacccgaaacccttaacgacgttaggggtctacgacgtaggtcgtccgttacccacccgtaagttcccggtaccgggactaacgtaccttaacgcttacccgaaccaccgttaactacccctacctaaacaaaccctcgaaccgtacctaacgtacgtacgggtaagttacgggacggtacaccgtacggtaactaccgtacgtaggaacccggacgtacccgggtacctttacgttaggttaccgacggttaggaccgtaaggtacccgttaccccgaaggttacccggtccgggttaagcccgttaaccgggaccggtccgttaacggggccggtttacccttttacgggtaccggtttcggacccggggg

SEQ ID NO: 207470 - DNA, 833 bp, Homo sapiens
  misc_feature: GYAE6OF01BT43K.17.25.C03.1.454.CMB.1.raw
  modified_base (337)..(337): a, c, t, g, unknown or other
  misc_feature (337)..(337): n is a, c, g, or t
tcagcgtagactagcacgaccggtgctcgatttagtagtgtagatttgggtttggggactcaacaaccacatctgtcctctagaagaaaaccctgtgagcacagctcctcaccatggactggacctggaggatcctcttcttggtggcagcagctacaagtcgcccactcccaggtgcagcgtggtgcgtagtcgtggggctggaggtaggaacgaacggccgtcggggtcctacgaggtacggaacggttcctccgtgacgtaacggtcttcggtaggtacttaccgttaacggtttaccctacgttaatagttactacgtaacgttcggggtacncggaccgacggccgacgtacggaaccgaaccgtccgtggacggtaggaggttacggggacgtcggggaacccgttaaaccccgtaacgtcggtacgggttacggtactaacgtacggtttccgttacctttacccgtaaccccttacggttacccggtaaccccgggtaactaacggttaaccccgtttaaacccaccgttaaccggaaccccgtaaccgtaacccttacctaaaccctaaacgttaaaacccgaacccgtaaccgtacccgtaaacgtaacggttacggtaaggttaccgggaacgccggtaccgtacgtaacgtacgtcggtaacggaacccgtacccggtacccggtacccgttacgttaacgttacgtcggtacggtaaccggtacggtacccgtacccggtacgtaccgggtaccggtaacggtccggccgaacggtccgtacgggtcccgttacggtttcggtccggttcgggaccgggg

SEQ ID NO: 207471 - DNA, 926 bp, Homo sapiens
  misc_feature: GYAE6OF01BOINN.17.25.C03.1.454.CMB.1.raw
tcagcgtagactagcacgaccggtgctcgatttagtagtgtagatttgggtttgggactcaacaaccacatctgtcctctagagaaaaccctgtgagcacagctcctcaccatggactggacctggaggactcctcttcgttcggtggcagcagctaacaagtcgccccactcccgaggtgacagcgtggtgcagtcgtggggctggaggtgaaagacgccgtggcctcgagtggaacgtctcctgacgtaggtcttcgtgacttccacgtttccctacgttatacgtatccaacgttgggtacgcgctacgggcccgtcgtaacgggaaccaaaccggtccgtaggtaggttacggtaggttacgggacgtaccgggggaaccgtaaaaccccttaaccgtaggttcgggtaccgttacggaccgttaagggtttcttacccctttaaccgaacccccttacggttaccccgggtaaccggggtaacctaaccgggtttaaacccctttaccggaacggtttaccccggtaaaccccggtaaacccgttaacccccgttacccgttaaaccccaaaccgtttaaaaaccccgaacccggtaaaccccggtacccttaaaacggtaaccggttaacggggttaacggttttaaaccggggaaccgggttaacccggttaccgggtaaccgttaaaccggttaccggtacccgttaaccggggtaaacccgaccccgggttaaacccgggtcccgttttaaacgttaccggttaccgttacgggtaccgtaaccggtaccggttaccccggtaccgtaacccggttacgggttacccgggaccggttaacccggtacccggtaacccggtccggaacccgggttccgttacccgtttacgggtcccgggtttccgggaacccggggg

SEQ ID NO: 207472 - DNA, 714 bp, Homo sapiens
  misc_feature: GYAE6OF01ATLT0.17.25.C03.1.454.CMB.1.raw
  modified_base (215)..(215): a, c, t, g, unknown or other
  misc_feature (215)..(215): n is a, c, g, or t
  modified_base (251)..(251): a, c, t, g, unknown or other
  misc_feature (251)..(251): n is a, c, g, or t
  modified_base (265)..(265): a, c, t, g, unknown or other
  misc_feature (265)..(265): n is a, c, g, or t
  modified_base (304)..(304): a, c, t, g, unknown or other
  misc_feature (304)..(304): n is a, c, g, or t
tcagcgtagactagcacgaccggtgctcgatttagtagtgtagatttgggtttggggtacgtcgaacaaccacatctgtcctctagagaaacctagtgagcacagctcctcaccatggactggacctggaggatcctcttcttggtggtcagcagtctacgaagtcgccccacctccctaggtgccaggctggtcgactagtcggtgggctaggnggtagaagagccgtggggactcgagtgaagtctcgngcaggtcttgtggnttacgtacttacctactactagtactcaacgtggtgacnccgtacggcctaggtcggacctaaacgccgtaggtccgtagggacgttgggacgtcgggaccgtaaccgtaacacggtggtacgttacaaccggtaggttcgtcgtaccctaaacccttcgccggtttacccggacgtaccgttactaccgacgttccgaacccgtacgtaactccctacgtaacaaacctacgaactaccgtacgtaacgtgggtacgttacgggacgtacgaccgtacgtactaccgtacgtacggtaacggtacccgtaaacccggtccgttacgttacgttccgttaacggcggttacggcctaccgggttacccacggtacccgttacggggactccgggtaccaacgggtcccgtagggtcccgtagtttccccggtcgttacggtcccggggg

SEQ ID NO: 207473 - DNA, 794 bp, Homo sapiens
  misc_feature: GYAE6OF01B8V4E.17.25.C03.1.454.CMB.1.raw
  modified_base (370)..(370): a, c, t, g, unknown or other
  misc_feature (370)..(370): n is a, c, g, or t
  modified_base (690)..(690): a, c, t, g, unknown or other
  misc_feature (690)..(690): n is a, c, g, or t
  modified_base (751)..(751): a, c, t, g, unknown or other
  misc_feature (751)..(751): n is a, c, g, or t
tcagcgtagactagcacgaccggtgctcgatttagtagtgtagatttgggtttggggactcaacaaccacatctgtcctctagagaaaccctgtgagcacagcctcctcaccatggactggacctgggaggtactccttcttcgttgggtggcagcagactaacgaacgtcgccccactcccgaggtcgcagctggtgactgtcggtgggctggaggtagaacgacgtcgtcggggcctgagtagtacggtcctcgtagacgtaggtcttgtaggtactttaccgtaccgttttaccacttaagtagtacgtacgtaaccggtgggcgccggaccggaggcccgtacgtacggaacctaaccggtaccgnggtaaggtggaaggtcgggtaacgtaaccgggggaaccctaaaaccccgtaacggtacggttcgggtaccgtaaccgtaaagttacgggtttccttaccccgtttaaacccaacccgtaaccggtttacccggacccggggaaacttaaccggtaacccttaacaaccggtacccgaacccgttaaccgacccttaaccctaaccgtaaaactaaacccggaccctaccgaaaccgtagtacgtaagggtacgttaacggaggacctccgtaagactacgtcgacgacctaacgggtccgttacgtactacgtctacggngtaaccgtacgtaccgtaccgaggtacccggttagggccgtaaccggtccaacgggtaccncgggttacccgttgtttaacccggtggttcccggggaaccggg

SEQ ID NO: 207474 - DNA, 742 bp, Homo sapiens
  misc_feature: GYAE6OF01C48MS.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactgacctggaggatcccttcttggtggcagcagactactaagtgccccactcccaggtgcagcctggtgctagtcgtgggggctgaggtgaacgacgccgtggggcctcgaagtgaacggtcctccgagcaacgggtcttctagggtattactaaccggttttcctaccgttatacgtacttacgaacgtcgggtagccgaccacgggtcctcgtaccgggaacctaaacggccctggaggtaggtaggagggttacggaccgggtaaccgaaaccctaaaccggttaccggtacggtcgtaccacgacggttcgttacctcccgaacctacgtaccccggcgttaaccaacgtaccttacccgattaaccggaacctaccgaacctacccgtaaccttaacaaacgtccaacgtacctaacgtacgaccggttagttacggaacgtacgacctacgtacgtactacgttaccgaacgtaacccggaccggtccgggttaaccttacgttaactttcggaccgtaggacccgttaacgacccgtaacgtacggtacccggagttcccggcgtaaccgccggtaccgtcggttacctttaggtacccgtcgggtcggtaacccggg

SEQ ID NO: 207475 - DNA, 718 bp, Homo sapiens
  misc_feature: GYAE6OF01B64BD.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcaggtcgtggggctggaggtgaagaacgcgtgggctcgagtgaagtctcgtgcaaggtcttcgtggattccgtacgttttacctctatagtatacaacgttgggtgcctaccgaggtcccgactcggaacctaacgaccgtgaaggtacggagttacggggatacggggacccgtaaaacccgtaacgtacggtaggtcgtaccgacaggtttcgtaccttacgaccccaacgtccgtaccggggaatacgaaccttacgactacgaacctaccgaaccttaccgtaccaaactaaaacccgaacttaccgacctaaacgtacgtaacgggtagttaacgggacggacgtacccgtagaactagttaacgcgaaccgtacgaccgggtacctacgttaacgttccgtagggtaccgaggtaacggtacccttaacccggacgtaaccgggttaccggacggaccggtacccgtaacggacccgtaacggggttccctaacccggtttttcggaacccggtttggaccccggggg

SEQ ID NO: 207476 - DNA, 819 bp, Homo sapiens
  misc_feature: GYAE6OF01BH5K7.17.25.C03.1.454.CMB.1.raw
tcagcgtagactagcacgaccggtgctcgatttagtagtgtagatttgggtttggggactcaaacaaccacatctgtcctctagagaaaaccctgtgagcacagctcctcaccatggactggacctggaggatcctcttcttggtggcagcagctacaagtgcccactcccgaggtgcagctggtgcagtcgtggggctggaggtgaagagccgtggggcctgaggtgaaggtcctccgtgcgaaggtcttcgtggtacttccgtaccgttttaccctcctaagtacgtatacctaacgtgggtgccgtccgacggtcccgcgtacgggaaccaaccggaccgtggaggttggagtggggacgtcggggaacctaaaccccgtaacgacgttcgggtacgtacaacgtagttacggtccttaccaccccgtaacgttcccgtaccggggaactacgtaacctttaacccagttaccgaacccgtaacccgtaaccttaccccttaacctaaaccgtaaaacccaaaccgtaaccggtacccttaaacgtacgttaggggtaacggtttaagggaacgggtaccgtacgtacggaacctacgtacgtaccggaaccgaacccgggaaccgggtttcccgttaccgtttaacgtttaccgggtttacggtcggtaaccgggtaccggttaaccccggttaccccggtaacggttaacccgggtcccggggtttacgggaacccggtacccgggttaaccgggccgtaacgggttcccggtttaccgtttacggtaacccggtttccggggtacccgggggg

SEQ ID NO: 207477 - DNA, 803 bp, Homo sapiens
  misc_feature: GYAE6OF01D1OUY.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggaccgtggaggacttccttctttcgttgggtggcagcagctacgaagtcgaccccactcccgaggtgcgagcgtgggtcgctaggttcggtggggtccgtagggaagggtacggaaaggtaacggccggtcggggccctacggaggtacggtaacggtccttccgaggacgtaacggttccgtttacggtaggtactttaccgttaccgttttaccctacctaattagttactacgtaacggtgggtcgccgaccggacggccggacgtacggacgtaacgccgtaggacggtggacggtggacggtacgggaacccctaaacctacgtacgtaggtactacgtagtacgttcgtacctacccacccgtacgtcccggtaccgtacactaccgtaccgtacgtaccaacctacccgtacctaccctaacctaaacgtaaccaccgtactaccctaagtacggtaggtacggtacggacgtcgaccgttaacactaccgtcctaaccgggaaccgtacccgaccgggttaccttaacgttacgttaccggagtaccggtacggaaccggttacccgaaccggtaccgggtacccggttacgggacgtaacccgggtcccggttaccgacgggttaaccgggtccctttacggtacccggttacgggtccggggtaaaccggggg

SEQ ID NO: 207478 - DNA, 831 bp, Homo sapiens
  misc_feature: GYAE6OF01A66Q5.17.25.C03.1.454.CMB.1.raw
  modified_base (290)..(290): a, c, t, g, unknown or other
  misc_feature (290)..(290): n is a, c, g, or t
tcagcgtagactagcacgaccggtgctcgatttagtagtgtagatttgggtttgggagtcagtctcagtcaggacacagcatggacatgagggtccccgctcagctccgtaggggctccgtgctactctggctcgagctgccagatgtgacatccagtatcgacctagtctccactcctcctgtcgtcgtcctggtggtggggtaccagtgtaccacgacttcgacgttcggaccggtaactacgtccggaacggttaaccgttaaaacttagtttaaacgtggttaacncgacggaacaaacggtaaccgaacggaaaccgcccgtaggtaccctcgtagtacttcgtacggtggttaccgaccgttaaccgtccctaacgtcgtacggtacggtaaccggtcggtacccgtaccgaacgtttcgggaaggtttaacgagggttcgtagtaaccggtgggtaacctcgggtaacggtacttacggttacttacggtaccttacgtaaccacctacgttaaccgaacccttaccgttcggtaacctacccggtaaggtttcggtaacgttacgttcgaacctttaccgtaaactttccggtaacgttccctagtaaaaccggtcgttaccggtttaaacgcccttaccccgtttccttaaccgggtccgtttttaaccggaccgggttaaaaccgggtaccggttaaaccgtttaagggggacttaaaacccggggttctaaaaccccggttaagggttgggttaaacccgggttccttaaaccgtccgggttaacccttaaaggtcccttaacggttctttaaaccccgg

SEQ ID NO: 207479 - DNA, 880 bp, Homo sapiens
  misc_feature: GYAE6OF01DUBHB.17.25.C03.1.454.CMB.1.raw
  modified_base (105)..(105): a, c, t, g, unknown or other
  misc_feature (105)..(105): n is a, c, g, or t
tcagcgtagactagcacgaccggtgctcgattttagtagtgtagatttggggtttggggactcaacaaccacatctgtcctctagacgaaaaccctgtgagcacngctcctcaccagtggactcggacctgggaggtacttccttctttcgttgggtggcagcagctacaagtcgcccacgtcccagggtcgcagtcgttggcgcgtagtcggtggggctggaggtaggaaagacggccggtggggccctgtaaggtcggtaacggttcctccgtaggacgtaacggtccgtttagttacggtactttttccgtaacccggtttttaccttacttaagttaacgtaacgttaccgtaacggtcgggtacgacccggaccgtacggggcctaccggtaacggtaacccgaaccgtaccggttgggaacggttcgggtaaggtacggggtacggtaaccgggtaacccgtaaacccgtaagtaccggtttcggttacgtacctacggtaccgtttcgttaccttaccccgaacccgttaccgtaccccggtacgggtaacctaccggttaaccctacgtactacccggaaccgtaaccgtacctaccctaaccgtaacctaaccgacgaaccgtccgtaaacgtaggttagggtaacggttacgggtacgaccgtacccgtagaacttaccgtcgaacggtaacccggaccggtaccgggtttacccgtacgttttacgtacgttcgggtaacgtacggggtaccgaaccccggttaccgaaccggttaccgggttaccggaccgggtaacgttcccgggtaccggaccggtaccgggttaccgggttttccttaccgggtaacgttcggggggtacccggg

SEQ ID NO: 207480 - DNA, 811 bp, Homo sapiens
  misc_feature: GYAE6OF01C0JYM.17.25.C03.1.454.CMB.1.raw
  modified_base (191)..(191): a, c, t, g, unknown or other
  misc_feature (191)..(191): n is a, c, g, or t
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
  modified_base (629)..(629): a, c, t, g, unknown or other
  misc_feature (629)..(629): n is a, c, g, or t
  modified_base (637)..(637): a, c, t, g, unknown or other
  misc_feature (637)..(637): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactccttcttcttgggtggcagcagctaacaagtcgcccacctcccgaggtgcagcgtggncgagtcgnggggntggaggtagaagacgccgtggggccctgagtggaacggtctccgtgacgtacggtcctgtagtacttaccttaccgtttacctacctaagtttactaacttaccgtaacggttcggggtacgtaccggccgaaccgggcccgtaccggtaacggaaacccgtaaacccggtccggttaaggagggttagggtacggttagggggaaccggttaacggggaaaccccgttaaaacccccgtaaggtacgttacggtacgttaccaacgttacggtttccgttacccttaacccgaaccccgtaccgttaccccggaccgggaaccttaacgttacccttaagacctacgaaccgaaccctaactccctaaaccgtaactaaacgacctaacctaacctagtacggtaggtacgtagggaccgtacnccgttacncgtaacgtcgaaccgtaacgaccgtacgttacccggacctttacttaacgtttgggcctaacgggaccgtaaccggtacccgtaaccgaaccggttaccggtaccggtacggaccccgtaccggtaccggcgttaacggtccgtttacccgttcgttacccgggttacccgggg

SEQ ID NO: 207481 - DNA, 698 bp, Homo sapiens
  misc_feature: GYAE6OF01AZ2TL.17.25.C03.1.454.CMB.1.raw
  modified_base (240)..(240): a, c, t, g, unknown or other
  misc_feature (240)..(240): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacagtgcccactcccaggtgcagtcgtggtgcagtcgtggggctggaggtagaagacgccgtgggcctcgagtgaaggtctcgtgngaggtcttcgtggtactcctacgtttacctcctagtagtacttacaacgtgggtgccgaccgtaggcctacggtggaacaccgactaggacggtggagtggggattacggggaccgtaaaacccctaagtacgttcgggtacgtccaacgtgttcgttcccttaccaaccccgtacgttccccggtaaccgggacctacggtaccctttaaaccgaacgtttaccggaaccccgaacgttaaacccttcccaaccgtaaaactaacccaacgtaccgtaccctagacgtgtaggtcggaagccgtctagacttacgctaaccgacacggtaccggtaccttatacttggtactggaaccggtacggtacccgtccccgaggtacccgttaccgggtcgaacccgtccggtacggcccggtagtccccggttcgttaccgtggttaccgggtaccgggg

SEQ ID NO: 207482 - DNA, 794 bp, Homo sapiens
  misc_feature: GYAE6OF01A1AHI.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctggaggtgaagaagccgtggggcctcgagtgaaggtctcctgcaaggtcttcgtggtacttcgtaaccgttttacctccgtattacggtactacgaacgtggggtcgccgtaccgacggcccggtcgtacggggaaaccaaaccggtacccgttaggaagggttacgggagtttacgggggaataccgggggaaccctaaaacccccgtaaacggtacggttacgggttcgtaccaacgttaggttacgttccttaacccgaaccccgtacgttccccggtaaccggggtaacctaaccggtaaccctttaaaccgacgtaccgaaccccgaaccgttaaccctccctaaccctaaactaaacccaacgtaaccgtaccctaacgtaacgttacgggtacgtttaagggaacggaccgtacctaggtaaccctacgttacgttaacggaaccgtaaccgggtacccggtcccgtttaattaccgtttcgtaggtacgacggtaccgtaccgtacccgacgtaccggtacgggcgtaaccggccccgtacggacgtaccggtacccggttactttcgggtaccttccggggtacccggg

SEQ ID NO: 207483 - DNA, 685 bp, Homo sapiens
  misc_feature: GYAE6OF01AT60U.17.25.C03.1.454.CMB.1.raw
  modified_base (294)..(294): a, c, t, g, unknown or other
  misc_feature (294)..(294): n is a, c, g, or t
  modified_base (306)..(306): a, c, t, g, unknown or other
  misc_feature (306)..(306): n is a, c, g, or t
  modified_base (530)..(530): a, c, t, g, unknown or other
  misc_feature (530)..(530): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcgagtgaaggtcctccgtgccgaaggtcttcgtggtacttctacgtttacctcctatagtatcaacgtgggtcncgccgaggccgngtggaaccaacggacctggagtcggagtggggatcgggaccgtaaaccctagaccgtggtcgtacgacgtagttcgtccttccaacccgtcttaccccggtacggggacctaacggtaacccttaccgagttacccgaaccccgtaccgtaaacccgttccccttaaccaaacttaaacccgacctacgtaccctaacgtagttacgggtagtacgaggtaccnccgtagacctagtccgtagaaccggtccgaccgggtccctttacgtaattaccggttggcgacggtacgtacccgtacccgtacgggtccgtacgggtgtccggacccgacggcgaccggttccggttaccctttggtacccgttgggacccggg

SEQ ID NO: 207484 - DNA, 968 bp, Homo sapiens
  misc_feature: GYAE6OF01EJP32.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagcgtggtgcagtcgtggggctggaggtagaagacgccgtggggcctgagtgaacggtctccgtgcgaaggtcttcgtggtactttaccgtaccgtttacctccttaagtaagtacgttaccgtaacgttgggggtcgcccggtaccgaccgggtccccggtacgttaaccggggtaaaccctaaaacccggggtacccgttagggaaccggggttaggggtaacgggttacggggggtaacggttaccggggggggtaaccccctaaaaaacccccggtttaaaccggtaaccgggtttacgggggtaccgtttaaccgaaacccggtttaagggtttcccgtttaccccgtttaaccccgaaccccccgtaacggtttaccccccgggtaaccccggggggtaaacctaaaccggtttaaccccgtttaaaccccgtaaacggttaccccgggtaaaacccccgtaacccggttaaaccccttcccccgtaaaccctaaaaccgtaaaacccaccgtaacccggtaaccccttaaacgacggtttaacggggtaacgggtttaaccgggaacggggtaccgtacccggttaacgaacccgtaagttaccggtaacgggaacccgtacccggtacccggggtacccttaacgtttacgtaccggttacggcggtaaccggtaaccggtacccggtaccccgtaggtacccggttaccgggtacggtacccgacccggtacggaccgtacgggtcccgttaccgtttacgtcccggttcgggtacccgggg

SEQ ID NO: 207485 - DNA, 695 bp, Homo sapiens
  misc_feature: GYAE6OF01BEEKP.17.25.C03.1.454.CMB.1.raw
  modified_base (284)..(284): a, c, t, g, unknown or other
  misc_feature (284)..(284): n is a, c, g, or t
  modified_base (410)..(410): a, c, t, g, unknown or other
  misc_feature (410)..(410): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaggtcttcgtggattctaccgtttacctcctatagtatcaactgggtncgccaggcccgctggaacacgacctggagtggagtgggagtcgggaccgaaaccctaacacgtgggttgtccacgtaggttgtccttccaaccccacgtcccgttcgggaaccacgacctttaccntaccggtaaccaccgtaacctaccctaccaataaaccgaaccacgtccctaactacggtacgggacggtttagaacgggtacgtaccctcggaactacgtcctaccgggaaccgtacccgtaaccgggtacccgttacgttaacttaacggttcggtagaacccgggtagtaccccggtaccccgaccggtaccgttacccgggtacgaaccgggtaccccgttagggaccggtacccggtaccgggttacccttttcggaacccgttttcgggtacccgggggg

SEQ ID NO: 207486 - DNA, 862 bp, Homo sapiens
  misc_feature: GYAE6OF01A26QV.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgctaggtcgtggggctggaggtgaagagccgtggggcctagaggtagaggtcctccgtgacgagtcttagtggacttacctaccgtttacctaccgttaatagttactaccgtaacggttgggtacgaccgtaccgacgggcccgtacggtacggtaaaccgaaccgtaccgttagggtacggtacgggaggttacggggacgtaccggggaaaccccgtaaaccccgttaacggtacggttcgggtacgtaccgaacggttacggttacggtttcccgttaaccccgacccgtaaccgggttaccccgggttacccggggaaacgttaaacccggtaaccccttaaacccggtaacgttaccccggaaaccccgtaaaccggttaacccttaaccccaaccgtaaaaccttaaacccgaacccgtaacccgttaacccgtaacggtacggttaaccgggtttacgggttaacggaacggggttacccgtacctaacggaacgtaaccgttcgtaaacgacccggtaaccggtcgtacccgttataacgttcggtacgtacggacggtaaccgtcccgtaaccgacggtccgttaacggggtaccgtaccggcccggtaacggccgttcccggtacggtttacccgttccggtaaccgggtttccggggaacccgggg

SEQ ID NO: 207487 - DNA, 849 bp, Homo sapiens
  misc_feature: GYAE6OF01A8I4W.17.25.C03.1.454.CMB.1.raw
  modified_base (463)..(463): a, c, t, g, unknown or other
  misc_feature (463)..(463): n is a, c, g, or t
tcagcgtagactagcacgaccggtgctcgatttagtagtgtagatttgggtttgggactcaacaaccacatctgtcctctagagaaaaccctgtgagcacagctccctcaccatggactggacctggaggatcctcttcttggtggcagcagctacaagtcgcccactcccgaggtgcagctggtgcagtcgtggggctggaggtagaaagacgccggtgggccctgagtgaacggtcctccgtgacgaaggtcttgtaggtactttccgtaaccgttttacccactttataggttacttaccgaacggttcggggtcgccggtaccgacgggtcccgacgtacggaaccgtaaccgaccgtggtacggttagggcgtacggggtacgtaccgggaacccgtaaaccctaacggtcggttacggtcgtaaccacggtaggttccttaccgtcccgaacccgtntacccggtaccggactaacgtaccgttacacgtaccgacccgtaacgtaaccctaccgtacctaaacgtaaacctaccgtaaccgtacccgtaaagtacggtacggttaacggtacggaacggtacgtaccccgtaagaacgtttaccgtaccgttaaccgggaacccggtaacccggtaccggggttacccctttaaacgtttaaccgttaccggtttacggtaaccgggaaccgttaaccggtaaccccggttacccggtaaccgggttacccggtttacccgggaacgtaaaccccgggtcccggtaaacccggccgggttaaccggttccccgggtttaaccgttttacccggtaccggggttcgggttaacccccgggggg

SEQ ID NO: 207488 - DNA, 623 bp, Homo sapiens
  misc_feature: GYAE6OF01B6KIB.17.25.C03.1.454.CMB.1.raw
  modified_base (249)..(249): a, c, t, g, unknown or other
  misc_feature (249)..(249): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagcctggggcctcagtgaaggtctcctgcaggctcgtggtnttcacgtttacctcttatagtatcaacgtgggtcgccgccacggccgcgtggaacaagaccgtggagtggagtgggagtcgggaaccgtaacccgtaactacgtgggtactacacgagttcgtccttccaccctactcccgtaccggacagtaccttacacgtacgtaaccacgtacctccctacaactaaaccacacgacctatacgtggtagttgacggacgtccgtagactattcgaacggtaccgaccgtaccggtccgttacttaacttacggtcgtacggacgtacggaccgtacccgaggtaccgtccgggtgaccgcccggtacggcgtcggtacgggttaccttcggtccgttcgggtaccgggg

SEQ ID NO: 207489 - DNA, 753 bp, Homo sapiens
  misc_feature: GYAE6OF01ATY95.17.25.C03.1.454.CMB.1.raw
  modified_base (321)..(321): a, c, t, g, unknown or other
  misc_feature (321)..(321): n is a, c, g, or t
tcagcgtagactagcacgaccggtgctcgatttagtagtgtagatttgggtttggggacgtcaacaaccacatctgtcctctagagaaaaccctgtgacgcacagctcctcaccatcggactcggacctggaggactccgtcttcgttggtgcagtcagctacagtcgccactccaggtgcacgtctggtgcgtagtcgtgggactggaggtagaagacgcgtgggcctcgagtagtacgtcctccgtagacgaacggtcttacgtacggtacttacgtaaccgtttacctcttaagtacgtattaccgaacgtcgggtcnccgaccgtacggcccgtacgtcggaaccgtaccggtaccgttaggaggtacggacgggtacggtacgggtacgggtaaccctaacccgtaaggtacggtttcggtacgtaacgaacggttggttcgttacccgttaccgacccgttacgttccggtacccggtaactacccggttaaccttaccacgtaacccgtaccgtaaccgtacctaccctaacgtaactaaccgacgttaacgtacctaacgtaggttacgtacgtacgacggtacctcgtaacgtaactcgtacgacggtaaccgacggtaccgttacgttacgttaactacgtacggtacgaccggtacgtaccgtaccgaaacggtccgttacggacggtccgttaccgacggtaccgtcggttaccgttacgttcgcccgtttgggacccggg

SEQ ID NO: 207490 - DNA, 782 bp, Homo sapiens
  misc_feature: GYAE6OF01ECKO8.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggactcctctttcgttggtggcagcagctaacaagtcgccctacctcccgaggtcgcaggtctggtcgctagtcggtgggctggaggtagaagacgtccgtgggcctcgagtgacgtcctcgtagcgagtcttcgtggtacttccgtacgttacctacttatatactacgtacggtcggcgccgcgacggccgacgtacggaacctacgtacgtaggtaggtaggtacggtcggtacgtaccggaaccctaacccgtagtcggtcggtacgtacgtacgtacgttccgtacctaccgtacccgtacgtcccggtacgtactaccgttaacctaccgaccgtacccgtaacctacccgtaacccttaccctaaccgtaaactaaccgaccgtaaccgtaaccgttaacggtagggttacggtaaccggttacgggaccgtaccgtaccgtaacgtaaccgtacgtaccggtaaccgggtaacccgtacccggttaccgttaaccgtttacgttacggttaccggtacggtaaccggaccggtaacccgtacccgtaccggtacgggttcccggtaccgggacgtcccggtaccggccggttacgtacccgggtttaccggttaccgtttacgggtcccgggttccggggaccggg

SEQ ID NO: 207491 - DNA, 985 bp, Homo sapiens
  misc_feature: GYAE6OF01B1YLY.17.25.C03.1.454.CMB.1.raw
  modified_base (176)..(176): a, c, t, g, unknown or other
  misc_feature (176)..(176): n is a, c, g, or t
tcagcgtagactagcacgaccggtgctcgatttagtagtgtagatttgggtttggggactcaacaaccacatctgtcctctagagaaaaccctgtgagcacagctcctcaccatggactggactggaggatcctcttcttggtggcagcagctaacaagtcgcccactcccaggtncagcgtggtgcgagtcgtggggctggaggtaggaagacggccgtggggccttagaaggtggaaacggttcctccgtgacgaacggtcctttacgtcgggtaactttaccgtaacccggttttaacccttacttaaacgttacgttaactaccgtaaaccggttgggggtacgaccggtaccccggacgggtcccgtaccggtaacgggaaacccgtaaaaccggtaacccgttagggtaacgggttaggggtaagggttacgggggtaaaggttacccggggggtaaaccccgttaaaaacccccgtaaaccgtaaccggttgggtaccggttaacccaaggtaacggttttccgttacccggtttaaccccaaaccccgttaacggttaccccggtaccccgggggtaaaacctaaccggtttaaccctttaaaaccccgtagtaacccgggtaaacccttaaacccggtaacccttaacccccgttaaaccccgtaaaactaaaaacccaacgtaaaccgaaccccttaaacgtacggttaaggggtacggttaacgggaacggtaacggtaccctacggtactaacgtacggtaaccggaaccgtaacccgacccggggttaacccttaaccttaacgtttaacggtacggtacggtaccggaaacggtacccggtttaaaccccggaccggttaacggttaccccgggttaggaaacccccggtcccgggttaaacggacccgggtaaccgggttaccccggtttccgtttaaccgggttccgtttcccgggggtaacccggggg

SEQ ID NO: 207492 - DNA, 762 bp, Homo sapiens
  misc_feature: GYAE6OF01C5QPV.17.25.C03.1.454.CMB.1.raw
  modified_base (140)..(140): a, c, t, g, unknown or other
  misc_feature (140)..(140): n is a, c, g, or t
tcagcgtagactagcacgaccggtgctcgatttagtagtgtagatttgggtttggggactcaaacaaccacatctgtcctctagagaaaaccctgtgagcacagctcctcaccatggactggacctggaggatcctcttnttggtggcagcagctacaagtgcccactcccaggtgcagcgtggtgcagtcgtgggctgaggtagaagaagccgtggggcctcgaggtgaacggtctcctagcgaaggtcttcgtggtattaccgttaccgtttacccttcctaagttaacgttaacttacctaacggttggggttccgaccggacccgacgggcccgtacgtacggaaaccgtaacccgtaccgtaggaacggtggtaggtacgggggtaagttcggggaaccccgtaaaccccgttaaacggtcggttgggtaacgttccgaaggtacgtttcggttacccttacctaaccccgtacgtaccccggttaccgggactaaccggtaccttaaccattaccgaaccgaaccgtaacctccctaaacctaactaaaccacgtacgaccttaagaacgttggtacgttaacgcggactcgtacgactagtaccgtacgaccgtaccggtaaccggtccgttatttaacgttacggtcggtaacgtaccggtaacggtaccgtacccgaggtaccggtcgtacggtacccacccggttacggcccgtacgggttcccgtacgtttcgccggttccgggtacgggg

SEQ ID NO: 207493 - DNA, 928 bp, Homo sapiens
  misc_feature: GYAE6OF01DTLZ8.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttggtggcagcagctacaagtcgcccactccagtgcagcgtggtgcgagtcgtgggctggaggtgaagagccgtggggcctcgagtagacggtcctcgtgacgtaaggtcttcgtggtacttccgtaaccgttttacctcgtaattacgtactacctaacggttgggtcgccggaccgtaccgggccgtaccggtacggaaccgtaaaccggtccgttaaggggacggttagggtaacgggttaaggggtaaggtaccgggggaaaccccgttaaaaccccgtaaaccggtaccggttcgggttaaccggtaccgtaaaccggttaggtttaccgttaccccttacccgtaaccccgtacccggttaccccgggttcccgggtaaaccgtaacccggttaacccgttaacccgtaacggttaccccggtaaaccccaaccggttaaacccccttaccgtaaaccctaaaacctaaaccgaacccgttaacgtaaccccgtaaagtaacggtacggggtaacgttagggaacccgggtacgtacccgtacggtaaccttacgtaccggtaacggtaaacccggccggtaacccgggtttcccttaacgtttaacgttaccggttacggtaaccgggtaccgtaacccggggtaccccgttaaccccgggaaacgggttaccccgggtttacgggaccggaccccgtaaccccggtaccgggaccggtacccgggtttccgttaccccgggtttaccgtacccggggtttcccgggtaaccccggggggg

SEQ ID NO: 207494 - DNA, 733 bp, Homo sapiens
  misc_feature: GYAE6OF01BH2HI.17.25.C03.1.454.CMB.1.raw
  modified_base (298)..(298): a, c, t, g, unknown or other
  misc_feature (298)..(298): n is a, c, g, or t
  modified_base (371)..(371): a, c, t, g, unknown or other
  misc_feature (371)..(371): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctggaggtgaagaagccgtggggcctcgaggtgaacggtctcctgacaaggcttcgtggtacttcacgttttacctcctatacgtatactaacgtggggttcnccggtccgaggcccgcgtcggaaccaaccggaccgtggacggtggagtggggagtcgggaccgaacccgtaancgtggtcgtacacgtagttcgttccttccacccgtacgttcccgtaccggggactaacggtacctttaaccgacgttacgaaccctaaccggtaacccttacccctaccaaacttaaaccacccaaccggtacccctaagtaaccggtttagggtacgtttacgggaacggtacgtacccgtaggaacctagtccgtaacggaacccggtacgaccgggttacccgttacttaacttaccggtcgtacgggtacgtacgtacccggtaccccgaaggtccggttacccgggaggtcccggacccggttacgggcgtacgggtccgtttacccgtttcggtacccgttcggggtaacccgggg

SEQ ID NO: 207495 - DNA, 661 bp, Homo sapiens
  misc_feature: GYAE6OF01AB9XM.17.25.C03.1.454.CMB.1.raw
tcagcgtagactagcacgaccggtgctcgatttagtagtgtagatttgggtttgggactcaacaaccacatctgtcctctagagaaaaccctgtgagcacagctcctcaccatggactggacctggaggatcctcttcttggtggcagcagctacaagtgccccactcccaggtgcagctggtgcagtctggggctggaggtgaagaacgccgtggggcctcgagtgaaggtctcctgcaaggtctttcgtggtattccgtaaccgttttacctccttaagtagttatcgtaacgtggtgccgccgaggcccgacgtcggacaacgacctggtacgtggagtgggacgtcgggaccgaaaccctaacgacgtggtgtccgacgtacgtcgttccttccgacccgtacgtcccgtaccgggactacgtaaccttaccgagtaccggaacccgtaaccgtaaccgtccctaaccctaataaaccctaccgacgtaccctaacgagtgggtacgttggacggacgtccgtagtaactagtacgtacgacgaccgtacgtccgttactagttacgcgtcgtcgacgtccgtacccgacgtcgtccggtacggccttaccgcggaccgtcggtaccggtccgtttcggtacgttccggtaccgggg

SEQ ID NO: 207496 - DNA, 804 bp, Homo sapiens
  misc_feature: GYAE6OF01A9UN8.17.25.C03.1.454.CMB.1.raw
  modified_base (222)..(222): a, c, t, g, unknown or other
  misc_feature (222)..(222): n is a, c, g, or t
  modified_base (251)..(251): a, c, t, g, unknown or other
  misc_feature (251)..(251): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctggaggtgaagagccgtgggcctcgngtagaaggtcctcgtgcgaaggtcttcgnggtactttccgtacgtttaccctcgtatagtagtcaacgtgggtcgaccgccacggcccgcgtacggacgtaaccgaccgtaggacggtggaacgttgggagtcgggaacccgtaacccctaaacgtcgttcgggtacgtacgtacgtacgggttccgttcttacccgtaaccccgtacgttaccccggtacccggggtaacctaaccggttaacctttaaccccgaaacgtttaccggaaaccccgttaaccgtaacccgttacccccgttaaccctaaaccgttaaaaaccacccgtaacccgtaaccccgttaaacaacggttagggtaacggttacggaaacgggtaccgtaccgagttaccgtacctttacgtaccggtaccgaacccgaccgggtaccctttaagttacgtttaacgcggttacggacggtaccgtacgttaccccgaacggtaccgttaccgggtaccggtaccggtacccgttaccggacccgtaccggtccccggttaacctttcggttaaccccgggtttcgggtacccgggg

SEQ ID NO: 207497 - DNA, 700 bp, Homo sapiens
  misc_feature: GYAE6OF01CNOZV.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcgagtggaaggtctccgtgcgaaggtcttcgtaggtattctaccgtttacctactatagtactacaacgtgggtacgccgccgtacggcccgcgtacggaaccaccggaccgtaggacggtgggaaggtggggacgtaccggggaacccgtaaacccgtaacgacggttcgggtacgttacaacgtaggttcgttaccttacccaccctcgtacccgtaccgggactacgtacctttaccagtccgaaccgaccgtaaccctcctaacctaactaaaccaacgacgtaccctaacgtacgtagggtaacggttggacggtacgtcctagacgacttacgacgtaaccgaccggaccggttccttacttacgttacgtggtacgcggacgtaccgtacccgacggtccggttacggacggtaccgccgttacggaccgtacggtcccggttaccgtttacgccggtttcgggtacccgggg

SEQ ID NO: 207498 - DNA, 628 bp, Homo sapiens
  misc_feature: GYAE6OF01BDHVX.17.25.C03.1.454.CMB.1.raw
  modified_base (282)..(282): a, c, t, g, unknown or other
  misc_feature (282)..(282): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcagtgaaggtctcctgcaaggcttcgtggattcacgtttacctcctatagtatcaactggtncgcaggccgctggacaacgcctggagtggagtgggagtcgggacctaaaccctaacgacgtggttacgttacaggttcgtacttaccaccctacgtcccgtaccgggacaacgtaccttaccagtcgaaccgacgtaacctccctaaccaactaaccacacgtacctaacgagtaggtagtacggaggtacgaccgtagactagtcctagaccgaaccgtaccggtcctacgttacgttacgtcgtagcgtacgtaccgtacccgacggtacgtccgggtagaccggtaccgtacggtaccgacggtacccgttcgtttacgtaccgttcggccgggggtacccgg

SEQ ID NO: 207499 - DNA, 749 bp, Homo sapiens
  misc_feature: GYAE6OF01CM3XI.17.25.C03.1.454.CMB.1.raw
  modified_base (180)..(180): a, c, t, g, unknown or other
  misc_feature (180)..(180): n is a, c, g, or t
  modified_base (233)..(233): a, c, t, g, unknown or other
  misc_feature (233)..(233): n is a, c, g, or t
  modified_base (307)..(307): a, c, t, g, unknown or other
  misc_feature (307)..(307): n is a, c, g, or t
  modified_base (365)..(365): a, c, t, g, unknown or other
  misc_feature (365)..(365): n is a, c, g, or t
  modified_base (478)..(478): a, c, t, g, unknown or other
  misc_feature (478)..(478): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggagatcctcttctggtgcagcagctacagcgcccatccaggtgccagcgtggtncaggtcgtggggctggaggtgaagagccgtgggcctgaaggtgaaggtctccngacgaggtctcgtaggattccgtacgtttacctactagtacgtataccaagtgggtacgccgtacgaggcccgngtacggaaccaacgtaccgtagtaggaggtatggggacacgggacccaaacccgttanaccgtgggttacacgacgtagttcgtaccttacgaacccctaagtccccgtacgggaacctacgtaacctttaccagtaccaccgtaacgaaccttccactaaacaaacgtanaccgtactaacctaggtacgggtaagttacgggagtaaccgtcgtaaggaccgttaagtcccgaaaggaaccccggtaaccgaaccgggtttcccctagtttaaaccgtttacgtacggggttccgaaacggaaccgggtaaccgttaccccccggtaaaagggtccggtttccccgggtaaaggtaccccggtacccgggtaacccgtaacggtacgggtacccccgggttattttaacggggtaccgtttcggggtaaacccccggggg

SEQ ID NO: 207500 - DNA, 718 bp, Homo sapiens
  misc_feature: GYAE6OF01DKOJL.17.25.C03.1.454.CMB.1.raw
  modified_base (151)..(151): a, c, t, g, unknown or other
  misc_feature (151)..(151): n is a, c, g, or t
  modified_base (688)..(688): a, c, t, g, unknown or other
  misc_feature (688)..(688): n is a, c, g, or t
tcagcgtagactagcacgaccggtgctcgatttagtagtgtagatttgggtttgggggagtcagtctcagtcaggacacagcatggacatgacgggtccccgctcagctccgtgggcctcctgctactctggctccgagctgccagatgtnacatccagatcgaccctagtcctccactcctccctgtcctgccctgtagggtcgggggtcaaggactccaaccgtattaccgtacgttcggacccggaataacggtaccgaaccgggttaaaccttttaaaaaccttaagttttaaaagttacggtaactacgacgtaacaaaaccggtaaaaccggtaacgggaaaaaccctccccgaacgtacccttaccgtaggtaacttccgttcggtacgggtacacctacgtccctacgttccgtagggaaccgtaggtccggtccccgtaacctacgttaggtacggttacgaaggggtcgacgtgggtacgtagtcgggtaggaacctagttactttacgattcctaccactacaccctacctcgtactacgacctacgtaggtagtgtagtacgtaactactctaacctgtacacaagtaacgtaccttaccgtaccgttcccacgttacttaccgtacggaccgggtaacgacgttagcgaacggtaacacggtaacgacgttcggngacgtccgaactcgtacttgtaccgttacc

SEQ ID NO: 207501 - DNA, 758 bp, Homo sapiens
  misc_feature: GYAE6OF01CBP6E.17.25.C03.1.454.CMB.1.raw
  modified_base (575)..(575): a, c, t, g, unknown or other
  misc_feature (575)..(575): n is a, c, g, or t
tcagcgtagactagcacgaccggtgctcgatttagtagtgtagatttggggtttgggagtcagtctcagtcaggacacagcatggacatgagggtccccgctcagctccgtggggctcctgctactctggctccgagctgccagatgtgacatccagatcgacccagtcctccacttccctccctgtcctcgtccctcgtggtcggggggtacagtacgtccacctatcctaccgttcggaccggacaacggttccgaaccgggttaaaccgtttaaaaacctttaagttttaaaacgttggttaatacgaacgtaccgaaaacggtaaaaacccgttaacgggaaaaaacccgcccccgtaacggtacccttaccgtaggacttccgttcgttcgggttacacctacgtccctaccgttcgaccgggtcggtaacggtcgggtaccccgttccgtaacgtcggtacgggttaccgtaagggtcggacggtaggttcggacggttcggtacgggtaactagttaactttacaacttccgtaccaacctactcctacctacgtctcgactaaccgngtacggtatgtacgactaacgtctactacgtcgtaacaagtaacgttacttacccgttacccgttccctcggtaccttaaccggttcggaaccgggtaacggtaccgttaaggtacgaaggtaacctaactaaaacggtcggtatccggagtaccggacttaacccgcttccgttacttcccg

SEQ ID NO: 207502 - DNA, 798 bp, Homo sapiens
  misc_feature: GYAE6OF01D3IV9.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtcgcccactcccaggtgcagctggtgcgagtcgtgggctggaggtgaagacgccgtgggcctgaggtgaacggtctccgtggactaaggtcttcgaggtacttccgtaaccgttttaccctaccgttaagttacgtataccgtaaccggttgggtcgccgtaccgaggtcccgacgtagggaacctaaccgtaccgtggtaaggtacggtagggtagggtaacggttaccgggaaacccgtaaaccccttaacggacgtttcggggtactacgaaccggttaggttaccgttccccgtaaccctacccccgtaaaggtttcccccggacggggtaaaccctaacggttaacccctttaacggacttaccccgaacccgtaacccgtaacccgttaacccgtaacccaaaccgtaaaacccgtaaccgtaaccgtaacccgtaacgtaacggtaacgggtaacggttacggtacggtacgtaccgtacgtacgtacgttacgacgtacgaacgtaccggtaccgttacgttcgttaaaacgtcgtacgtacgacgtaccgtaccgtacgtaccgtacggtacgtacggccgtaccggaccgtacgtaccggttaccgttcgtccggttcgggtaccggg

SEQ ID NO: 207503 - DNA, 769 bp, Homo sapiens
  misc_feature: GYAE6OF01A2D1M.17.25.C03.1.454.CMB.1.raw
tcagcgtagactagcacgaccggtgctcgatttagtagtgtagatttgggtttggggacgtcaacaaccacatctgtcctctagagaaaaccctgtgagcacagctcctcaccatggactggacctggaggatcctcttcttggtggcagcagctacaagtgcccactcccaggtgcacgtctcggtgcgagtccgtggggctaggaggtagaagaagccgtggggctcagtagaaggtctctagcgaacgtcttcgtaggacttctaccgtttacctctatagtactcaacgtcggtgccgaccgagggcccgtctacgggaacctaaaccggtaccgtaggtacgggtaggtaggtacggggtacggtagggaacccgtaaacccctaaaacggtgtcgggttaggtaccacgtaggttacgtccgttacacccgtacgtcccgaccggtaccgagtaccttaaccgcgtacgaaccctacggtaaccctacctacccgtaactaaaaccgacctaacgacctaccgaagtacgggtacgttacgggagaccgtacgtacggtaactaaccgttgaaccggtaacccgtaaccgacccggggttaacccggtttacgttaaccgtttacggtaccggtcggtaaccggtacgtaaaccggttcccgaaccggtaccggttcgggttaaccgaccggttaccgggtaccggaccggttacccggacggttttaccgttcccggttaccggttccgggttaacccgggg

SEQ ID NO: 207504 - DNA, 778 bp, Homo sapiens
  misc_feature: GYAE6OF01BK7RS.17.25.C03.1.454.CMB.1.raw
  modified_base (278)..(278): a, c, t, g, unknown or other
  misc_feature (278)..(278): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccacctcccaggtgcagcgtggtgctaggtcgtgggggctggaggtaggaaaggaacggccggtcgggggccctcgaggtagtaaacgggtcctccgtgacgaagggtctttcgnggtacttccgtaacgttttaccctcttatagtatacaacgtggtcgaccgcgacggccgtcgtacggaaccgaacgaccgtggaggtcggagtggggtaagtcggggaacccgtaaaccccgtaagaccgttgggtacgtactaacgtagtaccggttcctacccaccctaccgtccgaccgggaactacgtacctaccgataccgaaccctaaccgtacctaccctaaccaacgtaaaccacgtaccgacctaacggagtgggtaacgttggaggtaccgcttacggaacctcgtcgtaaccggaaccgtaacccggtaccgttacccgttacgtttaacgttaccggttacggaccggtaccggtacgtaccccggtaacccgtacgggtaccggtacggggtacccggtaaacgtacccccgggtaccgggtacccgtacggggttacccccggttacgggtttccggtaccgggtttcccgggggaccccgggggg

SEQ ID NO: 207505 - DNA, 902 bp, Homo sapiens
  misc_feature: GYAE6OF01DG5KA.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtagaagaacgcgtggggcctcgagtgaaggtctcctgacaaggtcttcgtggaactttcgtaccgtttaacctccgttaatagtaacttacaaacgttggggtcgccgaccgacggggccgtcgtacggaaccgaaaaccggtaccgtaggtaaggtgggtaaggtagggggaacttacgggggaacccgtaaaacccccttaaaacgacccggttagggttccggttaaccaaccgttaacgggtttacgttcccgtttacccaaacccccttacgttaccccgggtacccggggtaacctaacggttaaaccccttaaccgtaaaccgttaccggaaaccccgtaaacccgtaacccttacccccttaaccctaaaacttaaaaacccaccccgtaaccggtaaccctaaaaccgtaggtaacgggtaacggttacgggaacggtacgtacccgtaacgtaaccacgttcggtaacggaacccgtaacccggtaccggggtaccccgttaaccgtttaacttttaacgggttcggtacggtaaacccggtaaccggttaaccccgggtaaccccgaaacccggttaacggttaccccggggtacgggtaaacccgtaccccgggttaccgggacccgttaaccggggtccccggttaccccggtttttagggaacccgttttcccggggtaacccgggggg

SEQ ID NO: 207506 - DNA, 776 bp, Homo sapiens
  misc_feature: GYAE6OF01C0JQ6.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggaccgtggaggatccttcttcgttgggtggcagcagctacgaagtcgcccactcccgaggtgcagtcgtggtcgcgtaggtcggtggggctagggagggtaggaaaggaacggtccggtcgggggtcctggaggttacggaacggttcctccgtgacggtaacggtcgtttcgtggttactttaccgtaccggttttacctaccgttaatttaacgtactaacggtaacggttcggggtacgtcccggaccggacggggtcccgtacggaacggtaaaccgaaccggtacggtaggtaagggtcgggttagggtacggggtaacggtcgggaaacccgttaaaacccgaacgttacgggttcggtacgtaccgtaacggtacgtttccgttacctaacccgtacccgtacgttcccggtaccggaactaaccgttacctacacgtaccgaacctaacgtaccctacctaaccaactaacacaccgtactacgaggtagtacgtaggtacgacgtcacgtactcgtacgacggaacgtaccggtcgtacctcgttacgttcgagcggtacgacgtacccgtaccgacgtaccgtcggtcggtaccgccgtacggccgttaccgggtcggttaccgttcggtccggtcggggaccggg

SEQ ID NO: 207507 - DNA, 822 bp, Homo sapiens
  misc_feature: GYAE6OF01D9C8B.17.25.C03.1.454.CMB.1.raw
tcagcgtagactagcacgaccggtgctcgatttagtagtgtagatttgggtttgggagtcagtctcagtcaggacacagcatggacatggacgggtccccgctcagctccgtggggcctcctgctactcgtggcctccgagctgccagatgtgacatccgaagatcgaccctagtcctcctacttccctccctgtctcgcctcgtggggtcggggtcaggctccaccactcctacgttcggaccggtaacacggtaccgaacgggttaacctttaaaaaccttaattttaaaagttcggtaatacaacggacctaaacggtaaaacccgtacggaaaaccgcccccaacgtaacccttcccgtagtacttccttggtacggtgaccctactcccgaacgtttccgagacggtaaaggtccggtaccgtaccccgtggtacccggtaggttacaggggtcgggtactacgggttacggtacggtaccggtacggggtaactaaggtttacctttttaaccgaaactttccctaacccgaacctactaccctaaccctagttccgtactaaccctacgggtaggtaaagggtctttcggtaactacttaaccttacgttacgttcgttaactaaccgtaacgtaacgttacccgtttaaaccgtccccgtttaccccgtacggtttacccgtttacgggttaacccggggtaccggtaacggggttaaaacttacgggttagaacggttaaaccttaaccgggaaaacgtttcggtacggacgttcgtaacccgtactaccccgtttagttccgttgttacccc

SEQ ID NO: 207508 - DNA, 799 bp, Homo sapiens
  misc_feature: GYAE6OF01CUFGQ.17.25.C03.1.454.CMB.1.raw
  modified_base (215)..(215): a, c, t, g, unknown or other
  misc_feature (215)..(215): n is a, c, g, or t
  modified_base (300)..(300): a, c, t, g, unknown or other
  misc_feature (300)..(300): n is a, c, g, or t
tcagcgtagactagcacgaccggtgctcgatttagtagtgtagatttgggtttggggacgtcaacaaccacatctgtcctctagagaaaaccctgtgagcacagctcctcaccatggactggacctggaggactcctcttcttggtggcagcagctacaagtcgcccactcccaggtgcagctggtgcagtcgtgggctggaggtgaaagagcgnggggcctcagtgaaggtctcctgacgtaggcttcgtggtacttcgttaccgtttacctcctattagtactccaacgttggggtcncgccgacggccgcgttacggaacaccggtaccgtggaggtggacggtgggacgtcgggacccgtaaaccctaccgacgttggtcgtacgtacgagtttcggttccttaccaccccttacgtccccggttacccgggactaacggtacctttaaccgagtaccgtaacccaaccgtaacccttccgtaacccctaacgtaaaaccctacgtacccgtaaccctaacgtacgttacgggtaacggtttaggacgggtaccgtacccgttagaaccgtacgtcggttacggaacccgtaacccggaacccggtcccgttaccgttaacgtttaaccgttcggttacggaccccggttaaacggtaacccgggtacccccgttaacgggttaccggtacccggggttacgggaaacccggtcccggtaacccgggaccggtaaaccgggttcccgggtttacccggtttaacgttcccgggttttacggggtaccccgggggg

SEQ ID NO: 207509 - DNA, 706 bp, Homo sapiens
  misc_feature: GYAE6OF01BD5RQ.17.25.C03.1.454.CMB.1.raw
  modified_base (148)..(148): a, c, t, g, unknown or other
  misc_feature (148)..(148): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcngcagctacaagtgcccactcccaggtgcagtctggtgcagtcgtgggctggaggtgaagaagccgtggggcctcgagtgaacggtctccgtgacgaaggtcttcgtggtacttctaccgtttacctacgtaatagtatccaacgtgggtagtccgccgaggcccgcgtcggaaccaacgacccgtgacggtggagtgggagtacgggaccgaaaccctaacgtacgtggtacgtcgaacgtaggtcgttccttaccgaccctacgtcccgtaccgggaacacgtaacttaccacgtaccgacctaacgaacccttaccgtacctaaactaaaccaaccaacgtacctaactagtagggtaagttaggaacggtacgtccgtagtactagttacgacggtaaccgaccgtaaccggtcccttacgtttaagttaccgttaggtacgtacggaccgtaccgtaaccccggtacggaccggttaccgggtacggtacccggtaccggtaccgaccggacggttcccgtttaccgttttcggaccgtttcgggtacccgggg

SEQ ID NO: 207510 - DNA, 710 bp, Homo sapiens
  misc_feature: GYAE6OF01EFUJW.17.25.C03.1.454.CMB.1.raw
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtgcccactcccaggtgcagctggtgcagtcgtggggctggaggtgaagaagccgtggggcctcgagtgaaggtcctccgtgacgaaggtcttcgtggtacttctacgtttacctccttaatatactacaacgttgggtcgccgccgaggcccgtacgtacggaaccaaccggtaccgtggaggtggagtggggagtcgggacctaaacccgtacgacgttggtacgtacacgtagtcgtccttaccgaccctacgtcccgccggggtaacacggtaaccttaccagtaccgaacccgtaacgtaaccctccctaaccgaaacttaaaaccacctaacgtaccctaacgtaggttacgggtacggtttacggaaggaccgtacgttagaaccttagttcggtaacgaaccgttacccgacgggtacccgtttattaacgttacgtcggacgtaccggagtacccggtaccctaacggtaccggtcggttacggcgtacccgaccgggacgtcgggtccgttaccgtttacggtccgttcggtaccgggggg

SEQ ID NO: 207511 - DNA, 731 bp, Homo sapiens
  misc_feature: GYAE6OF01EC8H0.17.25.C03.1.454.CMB.1.raw
  modified_base (245)..(245): a, c, t, g, unknown or other
  misc_feature (245)..(245): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagccgtgggctcagtgaaggtctccgtgcgaggtcttcgnggtacttcgtacgtttaccctccttagtagtatacaacgtgggtgtaccgccgacggccgcgtacggaacaaccgtaccgtggagtggagtgggagtcggggaccgtaaaccctaacgtacgtgggtcgttacgacgtagttcgttcctacccaaccctacgtcccgtaccgggacagtaccttacgactacgaaccaacgtaacctccctactaacgtaaacactaacgacctaacgagttcgggtagttaggacgggtagcccttagaactacgttcgtaacggtaccggaaccggtacccgggttaccgttaactttaacgttacgtacggttccgaacggtaacggtaccccgtaaccccggtaacggttacccgggttaccgggtaaccggtacccggttacccggtaccgggacccggttccgggttaccccgggtttcccggtttaccgttcccgggtttccgggggtaaccccggggg

SEQ ID NO: 207512 - DNA, 802 bp, Homo sapiens
  misc_feature: GYAE6OF01DKA16.17.25.C03.1.454.CMB.1.raw
  modified_base (159)..(159): a, c, t, g, unknown or other
  misc_feature (159)..(159): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctgggaggatcctctttcgttggtggcagcagctanaagtcgcccacctcccgaggtgacagtcgtgggtagcgtagtcgtggggctggagggtaggaaaggaacggccggtgggggcccttcgaagggtaggtaacggttcctccgtacggacgtaacggtctttcggtcggtacttttacccgttaaccgttttaccctacgtaatttaagttacttacgtaacggtggggtcgaccggaccgacgggccggtacgtacggggaacaaaccggtaccgtgggaaggtgggtacggtgggaacgtcggggaccctaaaccgtacgtaggtgggttccactagtacggttacgttacccttacccaacccgtccgacccggttacggggaacctaaccttaaccgtaaccgtactacccggaaacccctaacggtaacccctaccgttaaccaacttaaaccacgtacctaccagtacgtaggtagttacggacgcgtactagacttagtacgacgaccggtacggcccgggttacccgttaattacggtttaccgtgtaccgggtaacgtaccggacccgttaccgaaccggtaccggttcgggacggaccggtacccgttacggaaccggtccggttacccggttgtttaaccggttccggtccggggtaccggggg

SEQ ID NO: 207513 - DNA, 1002 bp, Homo sapiens
  misc_feature: GYAE6OF01DJFW1.17.25.C03.1.454.CMB.1.raw
tcagcgtagactagcacgaccggtgctcgatttagtagtgtagatttgggtttgggactcaacaaccacatctgtcctctagaagaaaaccctgtgagcacagctcatcaccatggactggacctggagttctctttgtggtgcagcagctacaggtcgtccacgtcccgaggtcctaggttggtgcaagttcgtgggctaggaggtgaacgcgtccgtgggtcctcgggtgagggttcctcgtgacgtacggtcttacggtagggacggtcctaccgttagacgtacgtaacttagtttaagtttacgtaaacggtttcggggtacgtaccgggtaccggggtccttaccgtacggggtaaccgtaaacggggttcccgttaagggtacgggttagggaaggtaagggggaacggttacggtccgttacccggttaagtcggttacaaaccgtaacccgtaaaccaaaccgttaaccgacgtaaacggtaacggtaaaccggttaccgaaacgggtaacgtaccgtaaacccgtaccgtaaaacccgtaaacggttaaaccccgggaaccggttaaaaactaaaaaccggtttaaaccggaaaacctaaccgttaaacggtttaaacgtacggttaaccggggtaacttaccggaaacggtaacccgtaacgggttacccgtttaacgtaccgtttacgttacccggtaagggtaaacccgggttaacccggttaacgggtttacccgtttttaaccccggtttaacgtttcccgggtttacgggtaccgggttaaacccggttaaagggttaaccgtttaaaacgtttaaaacccttaacggttaaaacccgtttaccccgttacgtttaccccggttttaaaccccgtttttcccgtaaaccccgttttaccccgtttaacgggttaaacccgttttccggggtaaacccgggacctttaacccggggttaaaccccggtacccccgggtttaaccccg

SEQ ID NO: 207514 - DNA, 662 bp, Homo sapiens
  misc_feature: GYAE6OF01C7MGO.17.25.C03.1.454.CMB.1.raw
  modified_base (299)..(299): a, c, t, g, unknown or other
  misc_feature (299)..(299): n is a, c, g, or t
  modified_base (377)..(377): a, c, t, g, unknown or other
  misc_feature (377)..(377): n is a, c, g, or t
  modified_base (410)..(410): a, c, t, g, unknown or other
  misc_feature (410)..(410): n is a, c, g, or t
  modified_base (593)..(593): a, c, t, g, unknown or other
  misc_feature (593)..(593): n is a, c, g, or t
tcagcgtagactagcacgaccggtgctcgatttagtagtgtagatttgggtttggggactcaaacaaccacatctgtcctctagagaaaaccctgtgagcacagctcctcaccatggactggacctggaggatcctcttcttggtgcagcagctacaagtgcccactcccaggtgcagctggtgcagtcgtggggctgaggtgaagaacgcgtggggcctcaggtagaaggtcctcctgacgaaggtcttcgtggattacctacgtttacctctaatacgtactacgaacgtgggtacncgtaccgacggccgcgtaggaacaaccgtaccgtggaagtaggaagtacgggagtcggggaaccctaaaccgtaaacncgtggtcgtacaacgtagtcgtcctacaccctntccgtcggactagacttacagtacgaaccaacgtaactcctaactaactaaacactacgacctaacagtggattacggacggactacctgaactgtacgtacgaacctacggaccggtccttacgttaacttacgtgtacggtaaccggacggacgtaccccgtaacggtaccgtccgggtanaacgggaccccgttaagggccgtaccggaccggtttacccttttacgggacccgttgggtaacccgggg

SEQ ID NO: 207515 - DNA, 891 bp, Homo sapiens
  misc_feature: GYAE6OF01CA1J3.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatgactggactggaggatcctcttcttggtggcagcagctacaagtcgcccactcccgaggtgcagcgtggtgctaggtcgtggggctgggaggtaggaaaggtacggccggttacggggcctacgtaaggtacggtaacggtcctacccgtggacgtaacggttccttcggtacggtactttaccttaccgttttcccttaccgtaagttaactactaccgtaacggtcgggtacgccgccggtacggccgtacgtacgggaaccaccggtacgtgggtacggtacggtacggtgggtactacgggaaccctaaccgtaccgtacggtacgtcgtaaacgtaccgagtttccgggtaccttacccgacccgtacgggttacccgtccgggtaaccgtaccgtaaaccgtttacccgaacgtacccggtaaccgtaaccccgttaaccgtaaccccggtacctaaaaccggtaacctaacccgtaccgtaaccgtaaccggtaggttaccggtaagggtaacggaaccgggttcgtacccggttaacgtaaccgggttaacctcggttaacccggtaacggacccggttaccggttaaccggtttaccgttaacgtttacggtccggttaaccggggaccgttaacggggttacccgtaacccggtacgggttaacccggggtacgtaccgggtaacccggttaccgggtaaccgggttccccgggtaacgttcccggtttaacggttacccgggtttgggttccccgggtaccggggg

SEQ ID NO: 207516 - DNA, 594 bp, Homo sapiens
  misc_feature: GYAE6OF01DY59D.17.25.C03.1.454.CMB.1.raw
  modified_base (443)..(443): a, c, t, g, unknown or other
  misc_feature (443)..(443): n is a, c, g, or t
  modified_base (460)..(460): a, c, t, g, unknown or other
  misc_feature (460)..(460): n is a, c, g, or t
  modified_base (507)..(507): a, c, t, g, unknown or other
  misc_feature (507)..(507): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtctcctgcaggcttctggattcacgtttacctcctatagtatcgaactgggtgcgccaggccgcgtggacaacgcctggagtggagtgggatcgggaccgaacctaagacgtggtgtcagtagtcgtccttacaccctactcccgtaccgggacacgaacttacccgatacgacccacgtaaccctccctaccaactaaacacacgacctanatgggagttcgaggacnccgtagacattcgacgaaccgacgaaccgggtccttatactttacgngtacggcgaagtccgtacccgacgtacgtccggtagacggccgtacgcgtacggtccgttacctttcggaccgttcgggtaccgggg

SEQ ID NO: 207517 - DNA, 653 bp, Homo sapiens
  misc_feature: GYAE6OF01A1S6M.17.25.C03.1.454.CMB.1.raw
  modified_base (459)..(459): a, c, t, g, unknown or other
  misc_feature (459)..(459): n is a, c, g, or t
  modified_base (492)..(492): a, c, t, g, unknown or other
  misc_feature (492)..(492): n is a, c, g, or t
  modified_base (496)..(496): a, c, t, g, unknown or other
  misc_feature (496)..(496): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagaagccgtggggcctcgagtgaaggtcctcctgcaaggtcttcgtggtattcctacgtttacctctatagtatactacgtggtcgcgccgacggccgcgtcggaaccaacggtacctggaggtaggagtggggagtcgggaccgtaaccccgtaacgacgttcggtcgtacgtaacgtaggttcgtccttccaccctacgtcccgtaccggacacgtacctacatacgaccacgacctccacctaactaaaccncacgacctatagtagtagttgacggacgcgtanactntccgagaccgtaccgaccggtccgttattaacgttccgaggtcggcggtaacgtacccggtaccccgtaacgggtaccgttccgggacggtcccgacccgggtacggcccgtaccgggtcccgttacccgtttacgtcggtttccggggacccgggg

SEQ ID NO: 207518 - DNA, 760 bp, Homo sapiens
  misc_feature: GYAE6OF01CBMKT.17.25.C03.1.454.CMB.1.raw
  modified_base (158)..(158): a, c, t, g, unknown or other
  misc_feature (158)..(158): n is a, c, g, or t
  modified_base (175)..(175): a, c, t, g, unknown or other
  misc_feature (175)..(175): n is a, c, g, or t
  modified_base (316)..(316): a, c, t, g, unknown or other
  misc_feature (316)..(316): n is a, c, g, or t
  modified_base (605)..(605): a, c, t, g, unknown or other
  misc_feature (605)..(605): n is a, c, g, or t
  modified_base (660)..(660): a, c, t, g, unknown or other
  misc_feature (660)..(660): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttgggtggcagcagctaanagtgcccactccaggtncagctggtgcaggtcgtgggctgaggtgaagagccgtgggcctgagtagaacggtctccgtgacgagtcttgtggtacttactacgtttacctacttatacgtactaccgaaggttcgggcgtaccgccgtacgggtcccncggtacggaaccaccggtaccggtaggaggttacgggtaggtacggggtagaccgggtaacccgtaaacccgtaacgacggttcgggtacgtaccgtaagtacgggtttcttacccttaacccgaaccccttaccgtaccccgggtacccgggtaatacccgtaacccgtttacacgttaaccgaacccgtaaccgttaaccctacccgttaaacctaaataaaaccctaaccgtaaccgtaacccttaacgtaggttaacggttaggtaaggacgtacgtccgttaanaccgttacgttgaccgtaaccggaccgtccgggttaccttacgttacttacggtntcgtaacggacggtccaccgtaaccgccggtagttccggacgtaccggtacggaccgttccggtcccggttcttaccgggtccgttacggggtcccgggg

SEQ ID NO: 207519 - DNA, 791 bp, Homo sapiens
  misc_feature: GYAE6OF01E258D.17.25.C03.1.454.CMB.1.raw
  modified_base (206)..(206): a, c, t, g, unknown or other
  misc_feature (206)..(206): n is a, c, g, or t
  modified_base (437)..(437): a, c, t, g, unknown or other
  misc_feature (437)..(437): n is a, c, g, or t
tcagcgtagactagcacgaccggtgctcgatttagtagtgtagatttgggtttggggactcaacaaccacatctgtcctctagagaaaaccctgtgagcacagctcctcaccatcggactggacctggaggactcctcttcgttggtggcagcagactacaagtcgcccactccgaggtcgcagcgtggtgacgtggtcgtggggngtggaggtaggaacggacgtccggtcggggcctcgaggtagtacggtcctccgtgacgtaggtcttcgtaggttactttaccgtaccgttttacctacgttaagttaacgttacttaccgtaacgggttcgggtcggacccggacgacgggtccgtacggtacggaaccctaacggtccgtagggtacggtagggtaggtcgggtacggtaccgggaacctaaccggtaanacgggtgtcgtaactacggttacgttccgtaccttaccaaccccggtacgttaccggtaccgggaaccttaacgtacccgttaacaccgtaccgtaaccccgtaactaaccctacccgtaaacctaacgaaaccctaacgggtacctaaccgtaagaggttacgggacggttacggacggaccgttccgtaacgtaccgtaacgttccgaaacggggtaacccgtacccgggtaccggtttaccctaacgtttacgttaacgcgggttaccgaacggtacgttacccgcgtaacggtccgttagggacgcgtacccggacggctcggtcctttcggtcggtcggtggggtccgg

SEQ ID NO: 207520 - DNA, 820 bp, Homo sapiens
  misc_feature: GYAE6OF01B7G5L.17.25.C03.1.454.CMB.1.raw
tcagcgtagactagcacgaccggtgctcgatttagtagtgtagatttgggtttggggactcaacaaccacatctgtcctctagagaaaaccctgtgagcacagctccctcaccatggactggaccgtggaggatccttctttcgttggtggcagcagctacagtcgcccactcccgaggtgcagctggtcgcgtagtcgtgggctggaaggtggaagacggccgtggggacctcgaggtacggaggtcctccgtgacgtaaggtcttacgtaggtactttacccgttaccgttttaaccctcgttaagttaacgttacttaccgtaaacgggttggggttaccggcccggtaccggtaaccgggccccgtacggttacggaacccgtaaaccggtacccggttaggtaagggttacgggaaggtcgggggtaacggttaccggggaaaccccgttaaaaccccgtacgttaaccgggttacgggttaccgtaacccgaaacggttacggttcgttacccgtttacccaaccccggttacgtaccccggtaccgggtaaccgtacgtaaaccccttacgacgtaaccgtaacccaaccggtaacccttacctaaccgaaactaaacccgtaaccaaccgtaaccgtaaacgtacggttacggtaagggtcgtaacgggcttacgactacacgttcgacgtaacgacgtccggtactctaagtcgtggtacgagtacgaccgtacccgtagggtaccgtcggtacggacgtacccgggagtaccgacgggttccttacgttcgaacggttcggggaaccggg

SEQ ID NO: 207521 - DNA, 790 bp, Homo sapiens
  misc_feature: GYAE6OF01AQUEO.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccgaggtgcagctggtgcagtcgtggggctggaggtgaagacgcgtggggcctcgagtgaacggtctcgtgcaaggtcttgtggtacttctaccgttacctcctatagtactacgtacgtgggtcgccgccgacggcccgtcgtacggaaccaaccggtacctggacggtggtaggtcgggtagtcgggaaccgaaccgtaagtacgtggtcgtacacgtaggttcgttaccttaccaccctcgtacccgtacccggggaactaacgtaaccctttaccgacgtacggaaccccaaccggttacccttacccctaacctaactaaacccgaccgaaccggtcctaaccgtagacgggtacggttaggaacggtacgtcccttagaccgtaacgtccgtaacggtaaccggaccgtaccgggttaccgtttaacttacgtttacgtacggttacccgggacgtaaccggttacccggtaaacccccggaggtttacccgggttaacccggggtcggttaacccccgtaaccccggggtcccggtaacccggtacccgggtttacccggggtttaccccgttttaacgggttaccccggtttaaccggggggtaccccgggggg

SEQ ID NO: 207522 - DNA, 801 bp, Homo sapiens
  misc_feature: GYAE6OF01E5J5X.17.25.C03.1.454.CMB.1.raw
tcagcgtagactagcacgaccggtgctcgatttagtagtgtagatttgggtttgggagtcagtctcagtcaggacacagcatggacatgagggtcccccgctcagctcctggggctcctgctactctggctccgagctgccagatgtgacatccagatcgacccagtcctccactccctccctgtctcgcctcgtggtgggggtcagacgtcaccatcacttcggccggacaacgtcacggtaacgtttaaaaaccttagttttaaatggtaatccgagtacaacgtaaaacccgtaggaaaaaccgccccaagtaccctcgtagactctcggtggtcgactaaccgtcccaacttcgtacggaccggtaaggtcgggtccctaccccaggttaccggtaaggttccaaggtcgggactaggtcggacttccgggagggactagtacttttacaacttcccgtaccaacctacgtacccaaccctacgttaccgtacgtacccgtaaaccgtagggtacgttacgttacggtacgtaaccgttaacctttaaccttaaccgttaaccgttacgttaaccaaaccggttaacggttaaaccggtttaacccgttacccccggtttacccccgttccgggttaacccgttttaccgggttttaacccgggaacccgggttaaaccgggggtaaccgttaaaaagggttaccggtaaacggtaaacgttaaaccgtaaaaccggttacggttacgtacgggtacctaccggtacctaaccccgtacgtttccgtcgtttacccg

SEQ ID NO: 207523 - DNA, 809 bp, Homo sapiens
  misc_feature: GYAE6OF01CFUU8.17.25.C03.1.454.CMB.1.raw
  modified_base (184)..(184): a, c, t, g, unknown or other
  misc_feature (184)..(184): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtgcagcagctacaagtcgcccactccaggtgcagcgtggtncagtcgtgggctggaggtgaagagccgtcggggcctcgaggtcgtaaggtcctcccgtgacaaggtctttcgtaggtattcctaccgttttacctcctaattacgtataccgtaacgtggggtcgcgccgtaacgggcccgtcgtacggtaccaaccggtacccgttggtacggtaggtaaggtagggggtagttaccggggaacccgtaaacccgttaaacgtaaccggtttgggtacctacgtacgtaacgggtttccggtaccctttacccgaacccctacgttccccggtaaccggggacctaacgtaacctttacccagttacccgaaccctaaccggtacccttaccctacctaaacctaaacctaaccgaccgtaacccgttaaccgtaacggtacgggttaacggtttaagggaaccgggtacgtaccggtacgtaacgtacgttaccggttacggaaacccggtaccgacccggggttacccttaatttccgttaacgtgtaccgggtacgttaaccgtacccggtacccgtaaccgggtaccgtaccgggaggtacccggtccgtacggtacggacgttcccggttattcccggttacgtccgggtacccggggg

SEQ ID NO: 207524 - DNA, 841 bp, Homo sapiens
  misc_feature: GYAE6OF01DF92B.17.25.C03.1.454.CMB.1.raw
tcagcgtagactagcacgaccggtgctcgatttagtagtgtagatttgggtttggggactcaacaaccacatctgtcctctagagaaaccctgtgagcacagctcctcaccatgactggacctggagatctcttcttggtgcagcagctacgaagtgcccactcccaggtgcagctggtgcagtcgtgggctggaggtgaagacgccgtacggggcctcgaggtgaaggtcctcgtgacgaaggtcctttgtaggtactttccgtaccgttttaacctccgtaagttagttactaccgaaagttggggacgaccggtaccgaacgggtcccgtacggttacgggaaaacccaaaccggtaccgttagggtaacggttcgggtaaggtcggggtaaacgttccgggggaaccccgtaaaaaccccccgttaaagtaccggtggggttacgttaccgaacggttaacggtttcgttaccctttacccgaaaccccgtcgttaccccggttaccggggaactaacggtaacctttacccgaagttcccgaaaccgtaaaccgtaaccctccgttaaccgaaacttaaaccgacccgacgtaacccttaaacgacggttacgggtaacgttacgggaaagggtaccgtacccgttagaccccgtaagttttacccggagaacccgggtacccgtaccgggttaccgttcctttaacgtttaccggtgtaccggaccgtaggtaaacccgtcccgaaccggttagtaccccgggagtacccgtaacccggtggaacccggtcgttaccgggtttcccctacgttaaccggttggggaaccccgggg

SEQ ID NO: 207525 - DNA, 894 bp, Homo sapiens
  misc_feature: GYAE6OF01CCGU9.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctgaggtgaagagccgtggggcctcgagtgaaggtctcctgcaaggtcttcgtggacttccgtacgttttaccctccttaagtacggttaataccgaacgttgggggttcgccggcccgaacgggtcccgcgtttacggggaacctaaaaccgggtaccccttggggtaacggttacggggtaacggttacgggggtaacggttacggggggtaaccccgtaaaaccccccgttaaacgtaacccggtttggggtaccggttacccgaaacggtagggtttcccgttacccgtttaccccgaacccccgtaaccgtttccccggttaccccgggggaaacctaacgggttaaacccctttaaacccgacgttaccgaaaccccgtaaaccggttaaccccttcccggttaacccctaaaagttaaaaccccaccggtaacccgtacccttaaacgaacggttcggggttaacgtttacgggaacggtacgtcccgtaagtaacctacgttcggttaacggaacccggtacggtacccgggttaccccgtttaattaccgtttaaccggtgggttaccggaccggtaaagggttaccccgtacccccgtaagggttacccggtaccgggacggtaccgtccccgtaacgggcgtaacggtcccgggtttacccgtttgcccggtttgggaacccgggggg

SEQ ID NO: 207526 - DNA, 730 bp, Homo sapiens
  misc_feature: GYAE6OF01A1JVA.17.25.C03.1.454.CMB.1.raw
  modified_base (251)..(251): a, c, t, g, unknown or other
  misc_feature (251)..(251): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtggaagagccgtggggcctcagtgaaggtctcctgcaaggtcttctggnttctacgtttacctctatagtactcaacgtgggtgccgccgaggccgctggaccaacgcctggagtggagtgggatcgggaccgaaccctaactcgtggtcgtacacgtagttcgtacttacccaccccgtattccccggtaccggacctacgtaaaccctttaccaacgttaccgaaccctaacccggtaacccttacccctaaccctaaacttaaaacccgaccaaccgtacccttaacgaagttcgggtaaggtttacggaacggtaccgtcccgtaagtacctaacgttcgtaacgaaccggacccgtaaccgggttcccgttacgtttaacgttacgttagtacggaccgtaagtacccgttacccgacggtaccggtttacccgggtacggtacccggtaccggtaacccgggaccgttacccgggacccggtttcccggtttaccggttaccgtttcccggggacccggggg

SEQ ID NO: 207527 - DNA, 811 bp, Homo sapiens
  misc_feature: GYAE6OF01D2PC2.17.25.C03.1.454.CMB.1.raw
  modified_base (187)..(187): a, c, t, g, unknown or other
  misc_feature (187)..(187): n is a, c, g, or t
  modified_base (253)..(253): a, c, t, g, unknown or other
  misc_feature (253)..(253): n is a, c, g, or t
  modified_base (632)..(632): a, c, t, g, unknown or other
  misc_feature (632)..(632): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttgggtggcagcagctacagtcgcccacctcccaggtgcagcgtggtncagtcgtgggctggaggtagagacgcgtcgggcctgagtggaacgtctccgtgacgacggtctcgngacttactaccggtttacctcttaagtacgtatacgaacgtgggtcgaccgcccgaggtcccgtgtaaccggaccaaccggtaccgtaggacggtggtagggtggggtaacgtacggggaaaccccttaaacccgtaacggtaccggttacggtacgtaccgtaacgttacgggttcctttacccggtcctaacccccggtaacgttccccggtaacccgggaacgtacccgtttaaccctaaacctaaccgttaaacccggaaccaacccggttaaacccctacccgtaaacccgtaaaccgttaaaaccaaaccccggtacgtaaccctaaacgtcggtacgggtttaaggaccgggttaacggacgtacccgtaanaccgtacttaccgaacggtaaccgtaccggaccgttaccgttacttaagtttaccgtcggtacgaccggtaacgttacccgacccgtacgggtaacccgttacggggccgtacgaacccggtcgggacgttacccggggcgttaccccgtttaaggtcccgggttccggacccgggggg

SEQ ID NO: 207528 - DNA, 737 bp, Homo sapiens
  misc_feature: GYAE6OF01ATJGE.17.25.C03.1.454.CMB.1.raw
  modified_base (182)..(182): a, c, t, g, unknown or other
  misc_feature (182)..(182): n is a, c, g, or t
  modified_base (703)..(703): a, c, t, g, unknown or other
  misc_feature (703)..(703): n is a, c, g, or t
tcagcgtagactagcacgaccggtgctcgatttagtagtgtagatttgggtttggggactcaacaaccacatctgtcctctagagaaaaccctgtgagcacagctcctcaccagtggactggacctggaggatcctcttcgttggtggcagcagctacgaagtcgcccactcccgaggtgcngctggtgcgtacgtcggtgggcgtggaggtagaagacgccgtcggggcctcgaggtagtacggtcctaccgtgcgtaaggtcttcgtaggtacttccgttaccgtttacctccgttatatacgtcgtaacggtggtacgccggccgacggccgtacggtacggaaccgtaaccgaccgtggtacggtagggaggttcgggacggtcggggtaacccaaacccgtaacgtacggtcggtacgaccgtacgtacgttcgttacccttaccaccccgttacgtcccggtacccggaactacgtaccgttacaccgaccgtacccgtaacctaccgtaccctaccgaaactaaaccgtaccgaaccgtaccgtaagtacggttacggtaaggtacgggtacggacgtaccgtaacgtacgtcgtacgtaacggaacccgccggttaaccggtcccgttattacggtcgtacgaacggtccgagtacccgtaccggagttccgacgggtcctacggcgtagggacncggttaccgttagtaccgtcggttcgggaccggg

SEQ ID NO: 207529 - DNA, 728 bp, Homo sapiens
  misc_feature: GYAE6OF01E2U66.17.25.C03.1.454.CMB.1.raw
  modified_base (263)..(263): a, c, t, g, unknown or other
  misc_feature (263)..(263): n is a, c, g, or t
  modified_base (302)..(302): a, c, t, g, unknown or other
  misc_feature (302)..(302): n is a, c, g, or t
tcagcgtagactagcacgaccggtgctcgatttagtagtgtagatttgggtttgggggagtcagtctcagtcaggacacagcatggacatgagggtcccccgctcagctcctggggctcctgctactctggctccgagctgccagatgtgacatccagatcgacccagtctccatccctccctgtctgcctctggtgggggtcagagtcacatcacttgccggacaagtccacggtacgttaaaaccttatttaaattggtancagcaagtaaaccaggaaaaccgccccaagaccctctanactctcgtgtgcactcccactcgtcgacgtaacggtcggtcctcccgaagttccggaggttcgaggtggacgaggttggacttcggtagggaactacgtaacttttaccgaacttcctaccaaccctactacccaacccgtacctcgttaccgacccgtaaaccggttaggaggttacgttacgtacgtacctaaactaccttaaccgttaacttacggtaacctaacgtaaggtaaccgttaacccgtacccggtttaccccccttagtacccgttttacggtttacccggggaaccggtaaccgggggtaacctaaaacgggttacggtaaaccgtaaccgtaaacgtaaaccggttaccggttagggttacccggtaccgtaccggtaccctaaccctttaccgtttacgtcgttttaccccg

SEQ ID NO: 207530 - DNA, 638 bp, Homo sapiens
  misc_feature: GYAE6OF01D8289.17.25.C03.1.454.CMB.1.raw
  modified_base (248)..(248): a, c, t, g, unknown or other
  misc_feature (248)..(248): n is a, c, g, or t
tcagcgtagactagcacgaccggtgctcgatttagtagtgtagatttggggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagcctggggcctcaggtgaaggtctcctgcaaggtcttcnggattcaccgtttacctcctatagtatcaacgtgggtgcgccaggccgctggacaacgaccgtggaggtggagtgggagtcgggaccaaccctaagcgttgggtgtacgacgtaggtcgtccttccaccctatcccgtaccggggacaggtaccttaccatcgacccacgaacctccaccaactaaacacacgacctacgacgtaggtagttggaaggtacgccgtacgaactagtcgtacgaaccgaccgtaccgggtccgttacttacgtttacgtggtcgtaccggacgtaaccggtccccgtaacggtacgttaccgggcggaccggtacccgtacggacgtaccggcccgggttacctttcggtaccgttcggggtacccggggg

SEQ ID NO: 207531 - DNA, 750 bp, Homo sapiens
  misc_feature: GYAE6OF01CDBP1.17.25.C03.1.454.CMB.1.raw
  modified_base (573)..(573): a, c, t, g, unknown or other
  misc_feature (573)..(573): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgccccactcccaggtcgcgacgcgtggtgcagtcgtaggggctggaggtagaaggacgccggtggggcctagaggtggaacggtcctccgtgaccgtaaggtcttcgtaggtactttccgtacgttttaccctaccttatagtactacgtaacgtgggtcgccgaccgacggccggtctacgggtaccgaaccggtccgtaggtacggtacgggtaggtacggggacgttcggggaacccgtaaccccgtaacgtacggttacgggtacgtacaacggtcgttacgttaccctacccgacccgtaccgtcccggtaccggactacgtaccttacacgtacgactaccgaacctcctacctaactaacaccgtaactccgtaatacgtaggtacgttaggacgtacgccgtanacgttacgtacgtaccggaccgaacccgccggttaccgttagttaaccgtttcgtggtacggacccgtaaggtacccgtaccggtaccggtccggttaccggacggtaccgtacccgggttacggccgtaccgggttcccggttacccgtttccgtcggggtcccgggtacccgggg

SEQ ID NO: 207532 - DNA, 724 bp, Homo sapiens
  misc_feature: GYAE6OF01B7E0J.17.25.C03.1.454.CMB.1.raw
  modified_base (188)..(188): a, c, t, g, unknown or other
  misc_feature (188)..(188): n is a, c, g, or t
  modified_base (238)..(238): a, c, t, g, unknown or other
  misc_feature (238)..(238): n is a, c, g, or t
  modified_base (592)..(592): a, c, t, g, unknown or other
  misc_feature (592)..(592): n is a, c, g, or t
tcagcgtagactagcacgaccggtgctcgatttagtagtgtagatttggggtttgggggactcaacaaccacatctgtcctctagagaaaaccctgtgagcacagctcctcaccatggactggacctggaggatcctcttcttggtggcagcagctacaagtcgcccactcccaggtgcagcgtggtncgagtcgtggggctggaggtgaagacgccgtgggcctgagtgacggtccnccgtgactaaggtcttcgtacggtattacctacggttttaccctcttaagttaacgtaacgttaccaaacgttgggggtgacccggtcccggaacggccccggtcgtttacgggaaccctaaaccggtacccgttgggaacggttagggaacgttggggaactcggggggaacccctaaaaccccttaacggaacgtttgggtacgttaccacgtaggttccggttcctaccgaacccctagtcccgtacggggacaacgttactaaccctataccgaaccaacgtaccttccaacctaaactaaaccaccgaacgtccaagtagtacgggtaagttcggagaaccgtcgtaanacctagtactggacctacggccggtaccttactaagttccgtgcgacggtacgtcgtacccgaagtccgttaccggagaccgtccctacggacgtaccggccggttccgtttacgaccggttcgggaccggg

SEQ ID NO: 207533 - DNA, 783 bp, Homo sapiens
  misc_feature: GYAE6OF01AZMDR.17.25.C03.1.454.CMB.1.raw
tcagcgtagactagcacgaccggtgctcgatttagtagtgtagatttgggtttggggactcgaacaaccacatctgtcctctagagaaaaccctgtgagcacagctcctcaccatggactggacctggaggactcctcttcttggtggcagcagctacaagtgcccactcccaggtgcagctggtgctagtcgtggggctggaggtgaagacgccgtggggcctcgagtggaacggtctcctgcgaaggtctttcgtaggtacttcgtaccgtttacctcctatagtactcaacgtgggtcgccgccgaggcccgcgtacggtaaccaacgtaccgtgaggtggagtcgggtacgtacggggaccaacccgtaacgtcgtggtcgtacacgtagttcgtccttaccgaacccgtacgtcccggtaccgggacacggtaccttaccagtaccgaacctaaccgtaaccctcctaccaacgtaaaccacgacgtaccctaagagtacggtagttggaacggtcgtccgtaagaccgtacttcggtaacgaaccggtaaccgaccggggttacccgtttacgtttaacttacgggtacggttacggaaccgggtaaacggttaccccggttacccggtaaaccgggttaccgggttacccgggggtacggtaaacccgggttaccccggttaacccgggtaacccgggtacccgggggttacccggttttaccccgggttttaccgggttaacccgggttttcccggggggtaacccccggggggg

SEQ ID NO: 207534 - DNA, 549 bp, Homo sapiens
  misc_feature: GYAE6OF01BALGQ.17.25.C03.1.454.CMB.1.raw
  modified_base (338)..(338): a, c, t, g, unknown or other
  misc_feature (338)..(338): n is a, c, g, or t
  modified_base (429)..(429): a, c, t, g, unknown or other
  misc_feature (429)..(429): n is a, c, g, or t
  modified_base (456)..(456): a, c, t, g, unknown or other
  misc_feature (456)..(456): n is a, c, g, or t
  modified_base (499)..(499): a, c, t, g, unknown or other
  misc_feature (499)..(499): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttcgtggattcacgtttacctcctatagtatcaactgggtgcgccaggccgctggacaacgacctgagtggatgggatgggacgaccctaacactggtntcacgagtgtcttcaccctatccctcgggacagtactaccatcgaccacgaactcctaccaataaaccacacgcctacatggagttgagancctgacatctgacgacgacggtccgtntacttactgtcgacgaggtaccgtcccgaaggtctacccgggngaccgtccgtaccggacgcgtccggtcctttgaccgttcggtaccggggg

SEQ ID NO: 207535 - DNA, 758 bp, Homo sapiens
  misc_feature: GYAE6OF01ENWM1.17.25.C03.1.454.CMB.1.raw
  modified_base (185)..(185): a, c, t, g, unknown or other
  misc_feature (185)..(185): n is a, c, g, or t
tcagcgtagactagcacgaccggtgctcgatttagtagtgtagatttgggtttggggactcaacaaccacatctgtcctctagagaaaaccctgtgagcacagctcctcaccatgactggacctggaggatcctcttcttggtggcagcagctacaagtcgcccactcccgagtgcagcgtggtnctagtcgtgggctggaggtagaagagccgtgggcctgagtgagtctccgtgacaggtcttgtggacttccgtaccttacctctatagtactacgtaggtcggcgccgtccgcggccgacgtacggaaccacggtcgtggtaggtaggacggtagggtagtacccgggtaaacctaaacccgtagtcggtcggtactaaccgtagttacggttcctaccctaaccgtacccgtaccggtaccccggtaacggtaactaccgttaaccgtaacgtaacggtaacccgtaaccctaacccgttaaccctaccctaaactaaacctaaaccgtacccggtaacctaacccgtaaggttacggtaggtaaccggtacggtaacgtcccgtacgtaacgtactacgtaccaaccggaacccggtaccgtacccggttaacgttacgttaaccgttcgtaccggtacgaaccgggtacctacccggtacccgtaggtacccgggtacggtaacggtacccggtcccgagtaccgggtcccgttacccggttacttcccggttcgggtccggggtaccggg

SEQ ID NO: 207536 - DNA, 880 bp, Homo sapiens
  misc_feature: GYAE6OF01DWFNO.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtagaagagccgtggggcctcgaggtagaggtctccgtgacgtaggtcttcgtgtacttccgtaaccgttttacctacttatagtactacgtaacggtcgggtcgccggtccgacgggtcccgtacggtacggaaaccgtaaccggtaccgtagggtagggttacgggtaggttaggggaacggttaccggggaaccccgtaaaaccccgttaaacgtccggttacggggtaccgttaaccgtaacgttacggttaccgtttacccgttaaccccgtaaaccccctaccgttaccccgggtacccggggtaacctaaccggtaccctttaaccgaacgtacccgtaacccgaaaccgttaaccccttccctaaacccgtaaaacctaaacccgaacccgtaaccgtaacccgttaacgtaacggttacggggtaacggtttacgggaacgggtaccgtcccgttaacgaaccgttaccgtacgtaccggaacccggtaaccggtaccccgggttaccttacgtttaaccgttacgttcggtaccggtaacggtaccggtacccgttaacccgacccggtaccgttaccggggtaccgtacccggtaccccggtaaccgggtacgtacccgggttacccggttaccgttttacggtcccggttcccggggtaccggggg

SEQ ID NO: 207537 - DNA, 763 bp, Homo sapiens
  misc_feature: GYAE6OF01ECYUW.17.25.C03.1.454.CMB.1.raw
  modified_base (237)..(237): a, c, t, g, unknown or other
  misc_feature (237)..(237): n is a, c, g, or t
  modified_base (289)..(289): a, c, t, g, unknown or other
  misc_feature (289)..(289): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcaggtcgtggggctggaggtgaagaagccgtgggcctcagtgacgtctccgngcaggtcttcgtggacttctacgtttacctctagtagtatacacgtgggtcncgccgacggccgcgtacggaacaacggtacctggaggtgggaggtggggtacgtacggggaaccgtaaaccccgtaaacgtacggttcggtacgtccgtaacgtaggttcgttcccttaccgaacccctaccggttcccggtacccggggtaacctaaccggtaaacccgttaacccgacgttaaccgaaccccgtaaccggtaaccccttacccctaacgtaaaccttaaaccgacccgaacgtacccttaagaccgtttaggggtaaggttacggacgtaccggtcccttaaggacctagtccgacgggaaccgacccgtaccgggtaccttactttacgttacgtgggttcgaccggtaagtacccgtacccgttacgggtaccgttcccgggtaggtccccggaccggtcgggacccgtacggggttcccgttacccggtttaacggtccgtttccgggaacccgggggg

SEQ ID NO: 207538 - DNA, 945 bp, Homo sapiens
  misc_feature: GYAE6OF01C4MSI.17.25.C03.1.454.CMB.1.raw
  modified_base (183)..(183): a, c, t, g, unknown or other
  misc_feature (183)..(183): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggagatccttcttcgttgggtggcagcacgtctacgacgtccgaccctaccgtaccgnggtcgacgtgtcggtcggtcgtacgtcggtgggtacggtaggtagggtaaggtaggaaccggtcggtccgggtcggtacgtacgttacggtacgttccgtacgtcgttacgtaccgttcgttacgttcgttaccttacgtttaccgttacaacgttaagtcgttacggaaccgttcgggtccgtccggccgacggaccccggtacctgggttaaaccggaaccggttaacctgggttaagggcggggttaacgggtcggttaaacgggtacccgttaacccgtttaaaccgtccgtaagggttccggtttaccgttaccgttacccgttaccgtaccccgtttaacccgtacccctaacccccggttcgtaaaacccgggttccccgaaacttcccgtttaaacccgtaaccctaaccggtaaaccctaaacccccggtaccttaacgtaaccctaaccgttacccgtaaaccgtacgttacgtacggtacgtacggttagggtacgtacgtaccggtaccgtacgtacccggtaaccgttaccggtaccggtacccgttcccggtaacccgtttccgttaaccggtacgtaccggttacggtacccgtaccgggtacctaccgggttcccggtaacgggtcccggttagggttcccggtaaacccgggttccgggttaccggttcccgggttacgggttcccggtttaaccgggtccgggttaccgggccgggttacccggtccggtcccggttacccggg

SEQ ID NO: 207539 - DNA, 760 bp, Homo sapiens
  misc_feature: GYAE6OF01CZMBU.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtgcagcagctacaagtcgcccactcccaggtgcagcgtggtgcaggtcgtggggctggaggtaggaagaacgtccggtacgggggtcctacgaggtaggaacggttccctcccgtaggaccgtaacgggtcctttcgtacggtactttacccgttaacccgttttaccctaccttaagttaacgtacttaccgtaaacggtggggtacgccgccgacggccgtcgtacggaaccaaccgtacgtaggtaggtgtaggtgggtacgtacgggaacctaaccgacgtacgtggtactcgtactacgttcgttacctcccgacctacgtcccgtaccggggactacgtaaccttacacgtaccgaacccgtaacgtaaccctccctaacctaaactaaacctaaccgaaccgtaccgtaaactcggttacggtaggttacggaacggtccgtacgtacactacgtcgaaccgtaccgaccgtaccggtccgttaacttacgttcgtacgtacgtaccggagtacccgtccgtaccggcggttaccggacggtaccgacccggtacggacggtaccgggtacccggttagtttaccggtcggttcccggggtacccgggg

SEQ ID NO: 207540 - DNA, 777 bp, Homo sapiens
  misc_feature: GYAE6OF01DZ4M1.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcgagtgaaggtctccgtgcgaaggtcttcgtggatttcctaaccgttttaccctccttaatagttactacgtaacgtggggtcgccgcccgacggcccgacgtgggaaccaaccggaccgtgaggtggagtcggggagtcggggacctaaaccctaacgtacgtggtcgtacacgtaggttcgtccttaccaccctacgtcccgtaccgggactaccggtaacttaccgagtaccgaaccctaaccgtaaccctaccctaccgtaactaaaacccacctaaccgtaaccctaacgtaggtacgggtaggttacggaacggtaccgtccgtacggaactacgttaccgtacggaaccgtaacccggtacccgggtacccgttactttaaccgttaccgttacgggtcggaaccggtaacggtacccgttaaccccggtaacggttaacccgggttacccgggtaacggtacccggtaccccggtaccgggacccgggtaccgggttaccccgggtttacccgttttaacggaccccggtttcgggtaaccccgggggg

SEQ ID NO: 207541 - DNA, 867 bp, Homo sapiens
  misc_feature: GYAE6OF01A3PVF.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacagtgcccactcccaggtgcagctggtgcagtcgtggggctgaggtgaagagccgtggggcctcgagtgaaggtctccgtgacaaggtcttcgtggtacttacgtaccgtttaccgtccttaataagtactaccgaacgtggggtacgtccggcccgacgggcccgtcgtaccgggaaccaaaccggtacccgttgggaggtacggggtaggtacggggagttacggggacccgtaaacccttaacggtacgttacgggtacgtacgtacgtaaggttcgttaccttacccgaaccccgtacgttaccccggtacccggggtaacgtaacggttaacccttaaccgaaccgttacccggaaccccgttaaccggtaaccccttccccgtaacccgtaaacttaaaaaccccgacgtaaccgtaccccgtaaacgtacggttaacgggggtaacggtttaacggaagggtaacccggttaccgtacggaaccttaaggttcccgaaggtaacccggtacccgacggggtacccctttagtaaccggtttataccgggttacgaccggttaaccggtacccggtaaccccggtacggttaacccggttacccggggttgaaccccgggtacccgggttaaccgggaccgttaacccgggggttccggttttaccccggtttacggttacccgggtttccgggtacccggggggg

SEQ ID NO: 207542 - DNA, 704 bp, Homo sapiens
  misc_feature: GYAE6OF01DU4R5.17.25.C03.1.454.CMB.1.raw
  modified_base (257)..(257): a, c, t, g, unknown or other
  misc_feature (257)..(257): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtccagttggtgcaatctggggctgaggtgaagacgcctgggtcctcggtggagggtctcctgcaggtcttctggaggcacctnagcgactatagtttcaagttgggtgcgaccgggcctcgtgggacaacgggcctttaggaggtggagtggggaagactcgtccctagtcggtgacctacgaaccaaactcgcaacgagtaacgttccagggccaagacctcacccagtaacccggtacggaaactaaacttaacgaacaacgtaagttaatcgtaggagactagaactacggtcctagtaccgacttcgtacgggaacgtacccggtacggggtacctttaccgttaccgttacggtcggttacgggtacccggtaaagggttaaccgttaaatttaaaccgtaaactaaacccgtacttccggtacccttttaccctttttaacccgaacccccgtttcccgtttacggtaaccttttaccgggaccggggtacccctaacgtaccccggggtacccccgtaacccg

SEQ ID NO: 207543 - DNA, 778 bp, Homo sapiens
  misc_feature: GYAE6OF01D940E.17.25.C03.1.454.CMB.1.raw
  modified_base (244)..(244): a, c, t, g, unknown or other
  misc_feature (244)..(244): n is a, c, g, or t
  modified_base (281)..(281): a, c, t, g, unknown or other
  misc_feature (281)..(281): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttgggtggcagcagctacaagtcgcccactcccaggtgcagctggtgcagtctgggctgaggtgaagaagcctggggcctgagtgaggtctcctgcaggcttcngattcacgtttacctcctatagtactacacgtgggtnccgcgacggcccgagtacgggaaccaacggacctggacggtagggagttcggggacgtggggacccaaaccccgtaacgacgtgggtcgtacacgtagtttcggtaccttaccgaccccacgtaccccggtaccggggtaaccaacggtaaccccttaaccgattacccgggaacccaaacccggtaaacccttcccctaaccgaaacttaaaacccaacgtaacccgtaacctaaccgaacgtacggggttaacggtttacgggaagggtacgacccgttacggaaccctacggttacgtaccgggaacgtaacccgggaccgggttaacccgttacggttaaccttaggtaccgggtacgtaccgggacggtaccgttaaccccggaacggtaaccggttcccgggtacggtccgtaccccgggtaccgggacccgtacggggttaccccggttacccgttttaccgggtaccctttcggggggtaacccggggg

SEQ ID NO: 207544 - DNA, 768 bp, Homo sapiens
  misc_feature: GYAE6OF01D7475.17.25.C03.1.454.CMB.1.raw
  modified_base (156)..(156): a, c, t, g, unknown or other
  misc_feature (156)..(156): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctanaagtcgcccactcccaggtgcagctggtgcaggtcgtggggctggagggtagaaagacggccgtcggggcccttcgaggttaggaacggttcctcccgtgacgtaaggtctttcgtaggtactttccgttaccgtttacctccttaagtagttactacgtaaccggttggggtcgccgggtacgacgggtcccgtacgtaggaacccgtaaccggaccgtaggaggttagggaggtgggtacggtacgggaacctaaacccgtagtacggtggtacgtaccacgttagttcgttacccttacccaccctacgttcccgacccggggactaacggttaccttaacacgtaaccgaccctaaccgtaacctacccgtaacctaacgtaaaccagtaaccgtaccttaacgacggttaggtaacggttaggaccgtacgtccgtacgtacctatcgacgtaaccgtacggaacccgttcgttacttacgttacgtacgtcggtaacggacgtacccgaaccggtaccggtacggttaccgggacgtaccggtacccggtacggtccggtacgggttaccgttcccggttttacggtccggttacgggtaccgggg

SEQ ID NO: 207545 - DNA, 777 bp, Homo sapiens
  misc_feature: GYAE6OF01CAC6D.17.25.C03.1.454.CMB.1.raw
  modified_base (401)..(401): a, c, t, g, unknown or other
  misc_feature (401)..(401): n is a, c, g, or t
  modified_base (604)..(604): a, c, t, g, unknown or other
  misc_feature (604)..(604): n is a, c, g, or t
  modified_base (641)..(641): a, c, t, g, unknown or other
  misc_feature (641)..(641): n is a, c, g, or t
  modified_base (757)..(757): a, c, t, g, unknown or other
  misc_feature (757)..(757): n is a, c, g, or t
tcagcgtagactagcacgaccggtgctcgatttagtagtgtagatttgggtttggggactcaacaaccacatctgtcctctagacgaaaaccctgtgagcacagcctcctcaccagtcggactggacctggaggtactcctcttgttggtgcagcagctacagtcgccctactcccgaggtcgcgagcgtgggtcgaccgtaggtccggtggggtacttagggaagggtaggaaacggtaaccgggtcccggttacggggggaccctacggtaacgggttagggaacgggttcctcccggtaggacgtaacgggttctttacggtacggttactttccgtaaccgttttacccgtcttaagttacggttacttaaccgacggttggggtcgccggaccggnggcccgtagacggaaccgtaaccggtcgtaggaggtggtacggtacgggaacggtaccggggaaccctaaacccggttagtaccggttggtacgtacgaaccgttgttcgttaaccctcgaaccccgttcgtacccggacgggtaaacacgtttacaacgacgtaccgaaccctaacgtaaccttaccgacctaaacgtaacnctaacgacccgtaataggtaggcgtaaggacggtacnccgtagtactagtacgacgaacgtacgccgttatccgtaatcgggatcggacaccggtactcccggaagtccggtaggcacccggtcggtaccgaccgtcgggtaccttacccgtntcccgggttaggggacccgg

SEQ ID NO: 207546 - DNA, 915 bp, Homo sapiens
  misc_feature: GYAE6OF01E438F.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactcggacctggaggactcctctttcgttggtggcagcagctacaagtcgcccactccgaggtgcagctgggtgcaggtcggtggggtctaggagggtagaacggacggcccggtcgggggcccttcgtaggtaggtaacggttcctccgtcggacgaggttccttcggtacggtacttaccgtaacccgttttacctaccgttaagttacgtactacgtaacggtggggtaccggaccgtccggacggtacccggcgtaccgggaaccaaacccggtaccgtagggtagggttacggggtacgggtacgggggttacgtaccgggggacccctaaaacccttacgtacgggttacggtccgtaaccgtaacggttagggtttcccttaaccccgttacccggaaccccgttaccggttacccccggtaccgggtaacccgtaacggttaaccccttaacggaccgttaacccgaacccgtaacccgtaacccgtacccttacctaaacgtaaaccctacggtaacacccgttaacgtaggttaacggtagggttaccggaacgggttaccgaccggttaacggaaccttacgtaaccgcggtaaccccgggtacgtacccggggttacctttaccgttacgtttacggtacgggtaccgtacgggtaaccggtacccgtaccccggtaagggttccggtacccggggttaacggtcccggtaacccggtaccggtacccggtccgggttaacccgtttcccgggttaacggtttcccggggttcgggtacccgggggg

SEQ ID NO: 207547 - DNA, 794 bp, Homo sapiens
  misc_feature: GYAE6OF01C4YHV.17.25.C03.1.454.CMB.1.raw
  modified_base (729)..(729): a, c, t, g, unknown or other
  misc_feature (729)..(729): n is a, c, g, or t
tcagcgtagactagcacgaccggtgctcgatttagtagtgtagatttgggtttggggactcaacaaccacatctgtcctctagagaaaaccctgtgagcacagctcctcaccagtggacctggacctggaggatccttcttcttgggtggcagcagctaacaagtcgccccactcccgaggtcgcagcgtgggtgcgtaggtcggtgggggctggaggtacgaaaggacggtccggtcggggcccttacgaggtaggtaacggtcctccgtagacgtaacggtcgttcgtacggtactttaccgttaaccgttttacccttaccgttaattaacgtacgtaccgtaacggttcggggtcgaccggccgacgggacccgtaaccggtaaacggaaaaccgtccgttagggacggtagggtacggtagggaacggtaccgggtaacccgtaaaacccgtacgtaacggttcggtacgaaccgtacgttacgttccgtacccttacccgacccgtacgtcccggaaccggtacacgttacctaaccgtatacccgaacctacgtaaccctaccctaacctaaactaaaccgacaacgtacccgtaatagggtacggtaagttacgggaacggtacctacgtagtaaccacggttacacggaaccgtaccggtacgtacgttactacgttcgcgtaggacgtaacgtaccgccgtacggtcgtacccgggtanaacccggtcccgacggtacgccggttccgttaccgtttaggaccggttcgggtccggggaaccgg

SEQ ID NO: 207548 - DNA, 704 bp, Homo sapiens
  misc_feature: GYAE6OF01C282U.17.25.C03.1.454.CMB.1.raw
  modified_base (266)..(266): a, c, t, g, unknown or other
  misc_feature (266)..(266): n is a, c, g, or t
  modified_base (300)..(300): a, c, t, g, unknown or other
  misc_feature (300)..(300): n is a, c, g, or t
  modified_base (323)..(323): a, c, t, g, unknown or other
  misc_feature (323)..(323): n is a, c, g, or t
  modified_base (336)..(336): a, c, t, g, unknown or other
  misc_feature (336)..(336): n is a, c, g, or t
  modified_base (408)..(408): a, c, t, g, unknown or other
  misc_feature (408)..(408): n is a, c, g, or t
  modified_base (513)..(513): a, c, t, g, unknown or other
  misc_feature (513)..(513): n is a, c, g, or t
tcagcgtagactagcacgaccggtgctcgatttagtagtgtagatttgggtttggggactcaacaaccacatctgtcctctagagaaaaccctgtgagcacagctcctcaccagtgactggacctggagactccttctttcgtggtggcagcagctacgaagtcgcccactccgaggtcgcgagtcgtgggtcgccgtaggtcggtcggggctagggaagggtagaaaggacggtccggttggggccttgaggtagacgttctcgngacgaggtcttgtggtacttccgtacgtttaccncgtatagtactcgacgtgggtcncgtccgaggccgngtacgactaccgcgtggacggtaggagtcgggtacgtaccggacccgtaaacctaacggtcgtacgggttanacgtaacgttagggtttccctaccgttaacccaacccgttcgtacccggtacggaactacgtaaccgtacacgtcgaaccctacgtaccctctaacgaactaacncgtacacctacgaggtcggtagtaggaccgtcgtacctagactacggtcgcgaaccggtccgacggttctaagttcgttacggtcgaacgtcggtaacgtacccgtacgtaacgtcgggtccggtaccgtccgtccggaccgtcgtaccggttccggttacctttacggggcccgttggggtacccggggg

SEQ ID NO: 207549 - DNA, 739 bp, Homo sapiens
  misc_feature: GYAE6OF01C7OME.17.25.C03.1.454.CMB.1.raw
tcagcgtagactagcacgaccggtgctcgatttagtagtgtagatttgggtttgggactcaacaaccacatctgtcctctagagaaaaccctgtgagcacagctcctcaccatggactggacctggaggatcctcttcttggtgcagcagctacaagtcgcccactcccaggtgcagcgtggtgctagtccgtggggactggaggtcgaaagaacgccgtcgggggacccttgaaggtaggaacggttcctccgtgacgtaaggtcttacgtggtactttccgtaccgttttaccctccttatagtactaccgaagtcggtacgcgccgacggccgtacgttacggaacctaaccgtccgttaggaacggtggagttgggaacgttcggggacccgtaaaccctaacgtacgttgggtacgtaccgacgtacgttcggtaccttccgaaacccgtacgttcccgtaaccgggactaacgtaccttaacacgttacggaaccctaaccgtaaccctacccgttaaccaaactaaacctacgtaaccgtaaccttaacgacgtagggtaggttacggaacggaccgtaccgtagaacctagttacgtacgaaccgtaccgtacccggtacgttacttagtttaccgcggtacgtacggacgtaccggtacccgacgtaccggtccggtagccgtaccgtacggcgtaccggtccgtcgtttacggccgtttcgggaccggg

SEQ ID NO: 207550 - DNA, 597 bp, Homo sapiens
  misc_feature: GYAE6OF01D0LI0.17.25.C03.1.454.CMB.1.raw
  modified_base (298)..(298): a, c, t, g, unknown or other
  misc_feature (298)..(298): n is a, c, g, or t
  modified_base (321)..(321): a, c, t, g, unknown or other
  misc_feature (321)..(321): n is a, c, g, or t
  modified_base (471)..(471): a, c, t, g, unknown or other
  misc_feature (471)..(471): n is a, c, g, or t
  modified_base (483)..(483): a, c, t, g, unknown or other
  misc_feature (483)..(483): n is a, c, g, or t
tcagcgtagactagcacgaccggtgctcgatttagtagtgtagatttgggtttgggagtcagtctcagtcaggacacagcatggacatgagggtccccgctcagctcctgggcctcctgctactctggctccgagctgccagatgtgacatccagatcgacccagtcctccatcctcctgtctgcctctggtggggtcagacgtcaccatcacttgccggacaacgtcacggtacgttaaaacctattaaagttggtactcaagtacaacgaaacctaggaaaacgccctagacctcngatctcgtggtgcactccacctntagcgtaagtcgggcctacccagtcgaggttcgagtgcgtaggtgatcggtggactagtacttcaaacttcacctacataccacctactctcgactacctagagattgactactacgtactatacgtacgtacacgtaagacgttaaccncccgtttacccncgtacttaaccgtttcggacgtaaccggggaactaaagggttaacgagtaaacgtaacgtaaacgtaaactacgggtacgcgttacgacccaacttacgttcctagtttacccg

SEQ ID NO: 207551 - DNA, 854 bp, Homo sapiens
  misc_feature: GYAE6OF01EALIM.17.25.C03.1.454.CMB.1.raw
tcagcgtagactagcacgaccggtgctcgatttagtagtgtagatttggttttggggactcaacaaccacatctgtcctctagagaaaaccctgtgagcacagctcctcaccatgactggacctggaggatcctcttcttggtggcagcagctacaagtcgcccactcccgaggtgcagcgtggtgcagtcgtggggctggaggtagaagaacgccgtcggggcctcgaggtaggtaacggtcctcccgtggacgtaacggtcctttacgtagggtactttaccgttaccgtttaccctacgttaacgttaacgttaacgttaaccggtaacggttacgggtaccggaccggaccggtaccgggtacccggtaccggtaaccggtaaaccgtaaccggtaccggtaggtaggtacgggtacgggtagggtacggtaccgggtaacccgtaacccgtaacgtacggtacggtacgtacgtacgtacgttccttacccgttacccgtacccgtaccggtacccggtaacccggaaccgtaaccgtaaccgttaaccgtacgtaacccgtaacccgtaaccgtaaccccttacccgtaaacccaaacctaaaccaacccgtacctaacccgtaacgtaacggtacgggtaacggttacggaaccggtacgtccgtaagtacctacgtacgtaccggaaccgtacccgtaccggttaccgttacgttacgttacggtacggtaccggacgtaaccgtaccgtacccggtaccggtaccggtaccggtacggtaccggtacccgtacggtaccggtaccggtaccggttaccgtttaccggtccggtcgggtaccgggg

SEQ ID NO: 207552 - DNA, 796 bp, Homo sapiens
  misc_feature: GYAE6OF01D1M33.17.25.C03.1.454.CMB.1.raw
tcagcgtagactagcacgaccggtgctcgatttagtagtgtagatttgggtttggggactcaacaaccacatctgtcctctagagaaaaccctgtgagcacagctccctcaccatggactggacctggaggatcctcttcgttggtggcagcagctacaagtcgccccactcccgaggtgcagctggtgcgagtcgtgggctggaggtagaagacgcgtgggcctgagtgagtcctctgacgaggtctcgtgtacttctacgttacctactagtacgtactacgacggttggcgccgtacccgacgggcccgtacgtacggaacctaaccggtaccgtggtaacggtcggtaggtcggggtacggtaaccggggacctaaaccccgtaacgtcgttagggacgttccgaagtacgttcgtaccttacccgaacccgtaccgtccccggtaccgggactaacggttaccctaccgtacgaccgtaaccccgaaccgtaacctcccctaaacctaaacgtaaaaccacccggtaaccgtaacccgttaaacgacggtttaaccggggtaagtttaccggggtaaccgggtaaccgtttcccgtaacggtaaccttacgtaccggtaaacgggtaacccgtaaacccggtaccggggttaccctttaaccgtttacgttaacggttcggttaacggtaccgtaccgtaacccgcccggtacgtccggtaccggtacggtaacgtcccggtacggaccgtcgggtaacccgttgtttaccggtcgtcccgggtaccgggg

SEQ ID NO: 207553 - DNA, 830 bp, Homo sapiens
  misc_feature: GYAE6OF01C0U3V.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggactcccttcttgttgggtcgcagcagtactaacgagtccgacccctaccctccgaggtcgacgacggtcggtggtcgacgtacgggttcggtcgggtcgtagggtagggaaggaaacggaccgtccgggtcggggacctacggtaggtacggtacgttcctcgtacgacgtacggttcttcgagttacttaccgttaccgttacctacgtagttactactacgacggttcggcgccgcggccgcgtacggaccgaacgaccgtagtggaggtggtaggaggtacgtaccgggaaccctaaaccgtaggtcgtaggtactacgacggtacgttcttacccaccctaacttcccggtaaccggtaaccggactaaccgttaccgtaactcgtaacccgaacctaaaccgtaccccctttacccgaaactaacctaaaccacgtacccgttaaccgtaaggttacgggtagtttacgggaacggtaccggaccttacgtaacgtacttaccgtacgaccggaacggttaacccgtccggttaacttaggttaacttacggtcggaacccgaccggttaaccgaccccgttaccggtaccggttacccgggtccggttaacccgggtaccgtaccccggggacgaccccggttacggttccggttttacccttaacgggtcccggggttccggggtacccgggg

SEQ ID NO: 207554 - DNA, 782 bp, Homo sapiens
  misc_feature: GYAE6OF01CJ7KN.17.25.C03.1.454.CMB.1.raw
  modified_base (331)..(331): a, c, t, g, unknown or other
  misc_feature (331)..(331): n is a, c, g, or t
  modified_base (378)..(378): a, c, t, g, unknown or other
  misc_feature (378)..(378): n is a, c, g, or t
tcagcgtagactagcacgaccggtgctcgatttagtagtgtagatttgggtttggggactcaacaaccacatctgtcctctagagaaaacctgtgagcacagctcctcaccatggactggacctggaggactcctcttcgttggtggcagcagctacaagtcgcccactcccaggtgcagctggtgcgtagtcggtggggctggacgggtagaagaacgccggtcggggcctagaggtagtaacggtctccgtgacgtacggtcttgtacggtacttccgttaaccgttttaccctcttaagtacgttactaccgtaacggttcggggtcnccggccggacgggcccggtacgtacgggaaacctaacgaccgtaggnggtacgggaagtggggagttccggggaacctaaacccgtaacgtcggtgggttaccactaacggtcgtttcgtccctttaccaccccttacgtcccggttaccgggaactaaacggttacccttaacgactaaccggaaacccgtaaccgtaacccgttaccctaacctaaacaaaccctacgtaacccgttaacctaacggtagggttacgtaacggttacggaaccggtacgtaccgttaacgactagttacccggcgaaacccggttaccggtacccggtacttaaccgttacttcggtacgtacgggacgtaccggtaccgtaccgaacgggtccgttacgggccacggtaccggtagcccggtactccgggttaccttcggtggtcccgggtaacgggg

SEQ ID NO: 207555 - DNA, 771 bp, Homo sapiens
  misc_feature: GYAE6OF01C2LIW.17.25.C03.1.454.CMB.1.raw
tcagcgtagactagcacgaccggtgctcgatttagtagtgtagatttgggtttggggactcaacaaccacatctgtcctctagagaaaaccctgtgagcacagctctcaccatggactggacctggaggatcctcttcttggtggcagcagctacaagtcgcccacgtcccaggtcgacagctcggtgcagtcgtgggtctggaggtgaagacgccgtcggggccttcgaggtggaacggtctccgtaggacgaaggtcttcgtggtactttctaccgtttacctctatagtactcgtaagtggtcgcgccgacggccgcgtacggaacaaccgtaccgtgaggtggtagtgggagtcgggaacctaacccgtaacgtcgtggtcgtacacgtagtcgttccttaccgacccgtacgtccgtaccgggactacgtaccttaccgagtaccgaccctaacgtaacccttaccctaaccaaaacttaaacccgacaaccgtacccttaaacggacgttagggtaacgttacgggaacgggtaccgtacccgtttaggtaaacctatttacccgggtacggaaaccccggtaacggtacccccggggttttacctacgttttaaaccgttacggtccgttaggggaccgtaaacgttccccggttaacccggacgttaacccgggttcccggtaggaaccccgttccggtaaccgggacgttacccgggtaccgtttcccgtttaacgggttccggttccggggtaaccggggg

SEQ ID NO: 207556 - DNA, 729 bp, Homo sapiens
  misc_feature: GYAE6OF01ERFY2.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtggaagacggccgtgggggcctcgaggtcggaaggttccgtaccgtggacgtaagggtctttaccgtgggtactttaccgtaaccgttttaccctaccttagtaacgttactacgtaacggtgggtcgccgtaccgacggtcccggacgtcggaaaccaaccggtaccgtaggacggtagggacggtgggagtcgggaccgaaacccgtacgacgtggtacgtacacgtagtcgttcctaccacccgtcgtcccgtacggacacgtactaccgatacgaaccctacgtaacctcccaacaaactaacacgacgtacctagagtaggtgtacggacgtacgcccgtagacagtaccgacgaaccgggactaccgggtcctttaacgttcgttaagcggttacgggaccgtaacgtacccggtacccgtaacggtccggttcccggggtagaaccccgtacccgggacccgacggtacccgggttccccggttaagttttccgaaccccgggtttgggacccccggggg

SEQ ID NO: 207557 - DNA, 600 bp, Homo sapiens
  misc_feature: GYAE6OF01BAIAW.17.25.C03.1.454.CMB.1.raw
  modified_base (245)..(245): a, c, t, g, unknown or other
  misc_feature (245)..(245): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaggcttctggnttcacgtttacctcctatagtatcaacgtgggtcgcgccgaggcccgctgggaaccaaccggacctggacgtggagtggggagtgggaccgaaaccctaacgacgtggtcgtacacgtagtcgttccttccacccgactccgtccgggacacgtaccttacatcgacccacgaacctcctaccaataaacacacgacctacgatagggacgttgagggcacctgacatcgacgaccgacgccggtccgttacttacttacgtcgtcgacgtaggaccgtaccccgacggtacgtcccggagaccgcccgtaacggccaggtcccggtaccgtttcggtaccgttcggtaccgggg

SEQ ID NO: 207558 - DNA, 830 bp, Homo sapiens
  misc_feature: GYAE6OF01BUO6M.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtcctcctgcaaggcttgtggtattctaccgtttacctcctatagtactacaacgtgggtgcgccgacggccgtcgtcggaacgaccggtaccgtggaggtggaggtgggacgtcgggaccgtaaccctaacgaccgtaggttcgtccaacgtacggtcgttaccgttacccaccccttacgtaccccggtacccgggaccgtaacgtaaccctttaaacccaggttaaccgaaccccgtaaccgtaacccgttacccctaacctaaactaaaacccaacccgtaacgtaaccccttaacgtaacgtacgggttaacgggtttacggaaccggggtaaccgtcccgtaagtaacctagttaccggtacggaacccggtaacccggacccggggttacccctttactttaaacgttaccgtttacgggtacggtaaccgggtaaacgtaccccgggttaccccgaaaccgggtttaccggttccccggggttaacgggaacccgggttaacccccgttaacccgggggaccccgttaaggggtcccccggttttaccgggttttacccggtacccggttttcggggggtaaccccgggggg

SEQ ID NO: 207559 - DNA, 713 bp, Homo sapiens
  misc_feature: GYAE6OF01DBDTQ.17.25.C03.1.454.CMB.1.raw
  modified_base (277)..(277): a, c, t, g, unknown or other
  misc_feature (277)..(277): n is a, c, g, or t
tcagcgtagactagcacgaccggtgctcgatttagtagtgtagatttgggtttgggactcaacaaccacatctgtcctctagagaaaccctgtgagcacagctcctcaccatgactgacctggagatcctcttcttggtgcagcagctacaagtgcccactccgaggtgcagcgtggtacgctagtccgtggggctaggaggtagaagaacgccgtggggccttcgagttgaacgtctccgtgactaaggtcttgtggtactttcaccgttttaccnccttaagttacgtataccgtaagttgggtacgtcgaccggaggcccgtagtaccggaactaaccgtaccgtaggtaacggtggtacttggggaaaccgttgggaaccccgtaaccccgtaaagccggttagtccgtacgtacgtacggttctacccgttccgaacctcgaccggtcgggaactagaccttacacgtacggaaccctaacgtaacctcccgtactaacgaaaccgtcaacggtacctaacgtgtacgggtagttacggacggacgtccgtagaaccgttactcgacggtaccgacgtaccgggtaccttatacgttacgtacgtcggaccgttacgacccggttacccgacgtacccggtcgtaacgtcccgtacccgtacggtcgtaccgttccggttccttaacggtccgttcgggtaaccgggg

SEQ ID NO: 207560 - DNA, 740 bp, Homo sapiens
  misc_feature: GYAE6OF01DI8IB.17.25.C03.1.454.CMB.1.raw
  modified_base (212)..(212): a, c, t, g, unknown or other
  misc_feature (212)..(212): n is a, c, g, or t
  modified_base (277)..(277): a, c, t, g, unknown or other
  misc_feature (277)..(277): n is a, c, g, or t
  modified_base (503)..(503): a, c, t, g, unknown or other
  misc_feature (503)..(503): n is a, c, g, or t
  modified_base (510)..(510): a, c, t, g, unknown or other
  misc_feature (510)..(510): n is a, c, g, or t
tcagcgtagactagcacgaccggtgctcgatttagtagtgtagatttgggtttgggagtcagtctcagtcaggacacagcatggacatggacgggtccccgctcagctccgtggggctcctgctactctggctccgagctgccagatgtgacatccagatcgaccctagtcctccactccctccgttgtctcgtccctgtggtggggtcagngtcacatcgactcggacgtagaacgtcgaacgggtaactttaaaactatttaaacgttggttaancaacgacaagtaaaaccgtaacgggaaaccgccccaagtacccttacgacggttaacttcgtcggttaggtacacctacctacccgttaacctcggtacgtaccgggtaaggtccggtacccgtacctaggttacgggtacggttacgaggtcggtacgtaggtcggtacgtccggtaagggtactagttaccttcaatcctaaccgaactacctacaccttaccnccgttanaacccgtagtaacggtagtatcggtactacgtaactactagtacgtagtactaaacgtacgtaaccgttacctaccggtttaccccgcgttaccgttaccgggtttacggaacccgggttaaaccggggtaattaaaaccgggtagggtaaaacgaccgttaaaccgtaaaccggttccgttggtaccccggtaacgtccaacccgttacgtacttacgttccgttaccc

SEQ ID NO: 207561 - DNA, 659 bp, Homo sapiens
  misc_feature: GYAE6OF01EUN0D.17.25.C03.1.454.CMB.1.raw
  modified_base (182)..(182): a, c, t, g, unknown or other
  misc_feature (182)..(182): n is a, c, g, or t
  modified_base (191)..(191): a, c, t, g, unknown or other
  misc_feature (191)..(191): n is a, c, g, or t
  modified_base (318)..(318): a, c, t, g, unknown or other
  misc_feature (318)..(318): n is a, c, g, or t
  modified_base (537)..(537): a, c, t, g, unknown or other
  misc_feature (537)..(537): n is a, c, g, or t
tcagcgtagactagcacgaccggtgctcgatttagtagtgtagatttgggtttggggactcaacaaccacatctgtcctctagagaaaaccctgtgagcacagctcctcaccagtggactggacctggaggacttcctctttcgttgggtggcagcagctaacagtcgcccactccgaggtncagcgtggngcagtcgtgggctaggagggtagaagacggccggtgggcctgaggtgtaacggtcctccgtggacgtacggtcttgtaggtacttcgtaccgttttccacttagtagtactacgtacgtggggtacnccgcgaccgggccgtcgaacggaccgtaaccggacgtagggtacgtgggacggtacgggtagaccggggtaaccccaaaccctacgtcggttaggccgtacaacggtacttcggtttacctaccacccgttacgtcccggacggactacgtacctacgactacgacctacgactacctacaacaacacacgactagacgtgtagtcgagcgtcagtacncgcacgaccgacgccgtcttacgtaactcgtacgcgtacgaccgtaccgaccgacggtcgtccggtaggcccgtacgtaccggccgtacggttccgttacgtttcgcgggtcggtaccgggg

SEQ ID NO: 207562 - DNA, 720 bp, Homo sapiens
  misc_feature: GYAE6OF01EHES3.17.25.C03.1.454.CMB.1.raw
tcagcgtagactagcacgaccggtgctcgatttagtagtgtagatttgggtttgggactcaacaaccacatctgtcctctagagaaaaccctgtgagcacagctcctcaccatggactggacctggaggatccttctttcgttggtggccagcagctaacgaagtcgcccactcccgaggtcgcgagcgtggtgctagtcgtgggctggagtagaagacgcgtcgggcctacgagtagacgtcgtccgtgacgaggtcttcgtgtacttcgtaccgttacctctatacgtactacgaacgtggtcgccgacgccggcgtacggtacggaaccgaaccggtccgtaggtaggtaggtagtggggtacgtacgggaacccgtaaccgtacgtgtacggtcgtacgagtagtacgttctaccgacctcgtccgacgtactacgtaacctaccgataccgaacactaccctaccctaaccgaactaactacaaccgtacagtacgtaggtacgtacggacggtaacgtcccgtagtaacctgttaccgacggtaacccggtacggtaccccggttaccgtttacttaacggtttccgagggttaccggaaaggtaaccgtacccggtaacccgtacgggtccgttaccgggtaccggaccggtaccgggtacccggcgttaccgggtccgttaacggtttccggtcggtttccgggacccgggg

SEQ ID NO: 207563 - DNA, 729 bp, Homo sapiens
  misc_feature: GYAE6OF01D30C8.17.25.C03.1.454.CMB.1.raw
  modified_base (313)..(313): a, c, t, g, unknown or other
  misc_feature (313)..(313): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctaacaagtcgcccactcccgaggtgcagctggtgcagtcgtggggctaggaggtagaagagccgtggggcctgagtgaaggtcctccgtagcgaaggtcttcgtggactttcgaccgtttaaccctcctaatacgtacttaccgaaggttggggtaccnccggaccgacggggtccgtacggtacggaaaccgaaaacccggttaccggagggtacggttagggtaggtacggggtaacgttaccggggaacccgtaaaaccccgtaacgtacggttcgggtacgtaccgacgtagttacgtctacccaccgtacgtcccgtaccgggactaacgtactaccagtaccgaaccacgtaaccctacctaccaactaaaccgtaacacactaactacgtagtaggtacggacgacgcgacgactactcgaacgaccgaaccggaccggtaccgttacttacgtacgtcgtcggtacggacgtccgtacccgaccggtacgtacctacgggggggggtccaccggtaccggacgtcggtaccggttaccgtttccggttccggttccgggtaccgggg

SEQ ID NO: 207564 - DNA, 752 bp, Homo sapiens
  misc_feature: GYAE6OF01DXNDH.17.25.C03.1.454.CMB.1.raw
tcagcgtagactagcacgaccggtgctcgatttagtagtgtagatttggggtttggggactcaacaaccacatctgtcctctagagaaaaccctgtgagcacagctcctcaccagtggactggacctggaggactccttcttcgttgggtggcagcagctaacgaagtcgacccactccaggtgcagcgtggtgcgaggtcgtggggctggagggtacgaaggacggccggttcggggacctcgtaaggtacggaacggttccgtccgtggaccgaaaggttcttcggtacggtactttccgttaaccgttttaccctaccttaattagtactacgtaacgttgggtacgccgaccggacgggccgtacgtacggaaccgtaaccgaccgttagggtaggtagggaggtaggggtacgtaccgggaccctaaaaccgtacgtacggttggacgtacgaccgttaagttccgtaccttaccgacccgtaccgtcccggacggtaactacgtaccctacgacaccgaaccaaccgtacctacctaacctaactaaaccacgtactacgtacgtagtcggtaagtaggacgtacgacgtaacgctacgtgaccggaaccgtacggacccgttacgttactacgttacgtacggacgacgtacgtaccgtaccggtacggtccggtacggacggtcgacccggtacggacccgtacggttccggttaccgtttacgggtcgggtccggtaccgggg

SEQ ID NO: 207565 - DNA, 811 bp, Homo sapiens
  misc_feature: GYAE6OF01CGXJQ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatccttcttcgttggtggcagcagctacaagtcgccactccgaggtgcagcgtggtgcgtagtcgtgggctaggaggagaagacgtccggtcggggcctacgaggtacggtaacgggttcctaccgtcggacgaaacggttcgttcgtaggtactttacgttaccgtttacctaccttatacgtactacgacgttcgggtacgtccggaccgcggtccgtacggacggtaaccgaacggtccttaggaggtaggggacgttacggggacggaccgggaacccggtaaaccaacggtagtcggtacggtacacgtagttccgtaccttacgacccgtctacccggtacgacgtacgtaaccttaccgacgttacccgaaccgtaaccgtacctaccctaccgtaaactaacacgtacgtacctaagtacggtaggtaccgttagggaccgtacggtaccttaacggactacgtacgtaccgtaaccggtcccgtaaaccggttccgttaacgtttacgttaccggtacggtaacggtcccgggtaaactacccgggtaacccgaacccggttccggttaaccgggtacggttaccccggaaccggttaccgggtaaccggtaacccggggttcccggtttaaccggttttaccgggttcccgggttacggggtacccggggg

SEQ ID NO: 207566 - DNA, 793 bp, Homo sapiens
  misc_feature: GYAE6OF01CJ20X.17.25.C03.1.454.CMB.1.raw
  modified_base (198)..(198): a, c, t, g, unknown or other
  misc_feature (198)..(198): n is a, c, g, or t
tcagcgtagactagcacgaccggtgctcgatttagtagtgtagatttgggtttggggactacaacaaccacatctgtcctctagagaaaaccctgtgagcacagctccctcaccatggaccgtggaccgtggaggactcctctttcgttcgggtggcagctagctaacaagtcgcccactcccaggtgcagcgtggtncgtagtcgtgggctgggagtagaagacgccgtggggcctagaggtagacggtctccgtgacgtaaggtcttcgtacgggtattaccgttaaccgtttaccctacttaagtaacgtattaccaacggttggtccgccgtccggacgggcccgacgtaaccggaaccgaaccggtaccgtaggacgggttacgggacggttacgggacggtaccggggacccgtaaaaccctaacgtacggtcggtactaccgaacgttacggtccgttccgtaacccgtaccccctggtaccccggtacccggtaactaacggtaacctttaccgaagttacccgtaaccggtaacctaaacccttcccgtaaaccgtaaactaaccgaacgaccgtaccttaacggacggttacggtacggtttaggaacggtacgtaccctaggtaacacgttacgtaacggacgaacccggtaccgtaccgttacgttactacggtcgtagtaccggtaacggtaccgtacccgaacggtccgttacgggtacggtaccgaccggtaccgacgtacccggtcggttacgtttaccggtccgttcgggaccggg

SEQ ID NO: 207567 - DNA, 643 bp, Homo sapiens
  misc_feature: GYAE6OF01CPWIX.17.25.C03.1.454.CMB.1.raw
  modified_base (198)..(198): a, c, t, g, unknown or other
  misc_feature (198)..(198): n is a, c, g, or t
  modified_base (205)..(205): a, c, t, g, unknown or other
  misc_feature (205)..(205): n is a, c, g, or t
  modified_base (280)..(280): a, c, t, g, unknown or other
  misc_feature (280)..(280): n is a, c, g, or t
  modified_base (353)..(353): a, c, t, g, unknown or other
  misc_feature (353)..(353): n is a, c, g, or t
  modified_base (440)..(440): a, c, t, g, unknown or other
  misc_feature (440)..(440): n is a, c, g, or t
  modified_base (486)..(486): a, c, t, g, unknown or other
  misc_feature (486)..(486): n is a, c, g, or t
  modified_base (511)..(511): a, c, t, g, unknown or other
  misc_feature (511)..(511): n is a, c, g, or t
  modified_base (514)..(514): a, c, t, g, unknown or other
  misc_feature (514)..(514): n is a, c, g, or t
  modified_base (518)..(518): a, c, t, g, unknown or other
  misc_feature (518)..(518): n is a, c, g, or t
  modified_base (539)..(539): a, c, t, g, unknown or other
  misc_feature (539)..(539): n is a, c, g, or t
  modified_base (544)..(544): a, c, t, g, unknown or other
  misc_feature (544)..(544): n is a, c, g, or t
  modified_base (574)..(574): a, c, t, g, unknown or other
  misc_feature (574)..(574): n is a, c, g, or t
  modified_base (586)..(586): a, c, t, g, unknown or other
  misc_feature (586)..(586): n is a, c, g, or t
  modified_base (594)..(594): a, c, t, g, unknown or other
  misc_feature (594)..(594): n is a, c, g, or t
tcagcgtagactagcacgaccggtgctcgatttagtagtgtagatttgggtttggggactcaaacaaccacatctgtcctctagaacgaaaaccctgtgagcacagctccctcaccataggactcggaccgtgggaggacttccttctttcgttggtcggcagcacgctaacgacgtccgcccactccgaggtcgacngcgtggngacgtacggtcggtgggcgtaggaaggtacggaaacggtacggccggtcggggtcctagaggtaggaacgttccnccgtagacgtacggtcttcgtacgttacttaccgttaaccgttacctattaagtatactacgtaggtgggtcnccggccgacggtcctacgtacggaacacgtcgtaggaggtggaggcgggtagtaccgggaacccaacgtaggtcgtgtaacgtacgngtacgtctcctaaccaccgtcgaccgacggtacacgttaccacganaccgacctacactacaacaacacanacnctanaggtagtgacgactacaccgngtacngcggacgacgccgtaccgtcctaatcgtancgacgacgtacnccgtaacnccggacgtcggacgccgacgcgtacgcgttctacgttgcggtcggccgg

SEQ ID NO: 207568 - DNA, 708 bp, Homo sapiens
  misc_feature: GYAE6OF01A5MFX.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcagtgaggtctcctgcaaggcttcgtggtacttcgacgttttacctcctatacgtagtccaacgttggggtcgcgccagggcccgcgtgggacctaacggaccttggacggtgggactagggggacgtcggggaccctaaacccgtaagacgtcgggtcgtacgaacgtaggttcgttccgttaccaaccccgtgtacccgttacccggggaacctaacggttaccctttaacccaagtccggaaccctaaccgtacccttacccgtacctaaactaaacccgactaaccgtaccctaactacgtacgggtaggtttacggaaacggccgtcctacgtactacttaccgtacgaccggaccgtaccgggtcccgtttactacgtttaccgtaggtacggcgtaacgtaccggtccccgaaaggtccgtccgggtgaccgcccggtacggcgtaccggtcggttccgtttacgaccgtttcggacccgggg

SEQ ID NO: 207569 - DNA, 744 bp, Homo sapiens
  misc_feature: GYAE6OF01DL6SV.17.25.C03.1.454.CMB.1.raw
  modified_base (707)..(707): a, c, t, g, unknown or other
  misc_feature (707)..(707): n is a, c, g, or t
tcagcgtagactagcacgaccggtgctcgatttagtagtgtagatttgggtttgggactcaacaaccacatctgtcctctagagaaaaccctgtgagcacagctcctcaccatggactggacctggaggatcctcttcttggtgcagcagctacaagtcgcccacctccaggtgcagctggtgcaggtcgtggggactggaggtagaaggaacgccgtggggccctacgaggtagaacggtcctccgtgacgaaggtccttcgtggtactttccgtacgttttaccctcctaattagtactcaacgttgggtacgccgccgacggtccgtcgtacggaacaaccgtaccgtggaacggtggacgtggggtaagtcggggaaccctaaaccccgtaaacgtacgttgggtactaccgaacgtacggtttcgttccttacccgaaccctacgtcccggtaccgggactacgtaaccttacacgtaccgaaccctaacgtaaccttccctaaccgtaaactaaacccgacgacgtaccctaaagcggttagggtagttacggaacggacgtccgtaagaacctgttacggtacgaacccggtaaccgtacccggggttcctttaaacgttacgtttaacggtggttacgaacccgggtaagtcccggttaacccgacggtaacgttcccgggagtaccgtaccgtacggntaccggttaccgtctttacggcgttccgggaccgggg

SEQ ID NO: 207570 - DNA, 911 bp, Homo sapiens
  misc_feature: GYAE6OF01DXSHM.17.25.C03.1.454.CMB.1.raw
  modified_base (178)..(178): a, c, t, g, unknown or other
  misc_feature (178)..(178): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggagatcctcttcttggtggcagcagactaacaagtcgcccactcccaggtcncagcgtggtgcgaggtcgtgggctaggaggtagaacgacgtccggtcggggtcctacgaaggtacgtaacggttccttacccgtaggaccgtaaacggttccgtttacgttacgggtaaccttttaccgttaacccggtttttaaccccttaccgtttaaagttaacggttaaaccttaccggtaaacggttcgggggttaccgacccggtacccgaaccggttacccgaacggttaacgggaaacccgttaaaccggtccggttaggtaacggttagggaacgggttacggggacgtaaccggggtaaacccctaaaccccgtaacggtacgttcgggtaacgtaccgtacgtacgtttccgttcccttacccaccccgttacgtcccgtaccgggtaaacctacgtaacccttaaccgacgtaaccgaacccgtaaccgtaacccttacccctaaacgtaaaccgtaaacccgtaccgaaccgtaccgttaagtacggttagggtacgttaacgggacgtaccgtacctagtactccgttacgaaccgtaaccggacccgttacgggtcctttaacgttacgttacggtacggtacggaaccgtacgggttaaccccaacccggtacgtaccggttcccggggtaacctacccgggaccccggttaccggaccggtaccggtttacccgggttacccgttttacggtccgggttcccggggtaacccgggg

SEQ ID NO: 207571 - DNA, 806 bp, Homo sapiens
  misc_feature: GYAE6OF01BO3O6.17.25.C03.1.454.CMB.1.raw
tcagcgtagactagcacgaccggtgctcgatttagtagtgtagatttgggtttgggactcaacaaccacatctgtcctctagagaaaaccctgtgagcacagctcctcaccatggactggacctggaggatcctcttcgttggtggcagcagctacaagtacccactcccaggtgcagctggtgcagtcgtggggctggaggtagaagacgccgtggggcctcgaggtgaacggttcctccgtgcgtacgccgttccgtggtactttacctaccggttttaccctaccttagttaagttacttaccgtaacggttggggtcgcccgaccgtacggacccgtcgtacggaccgaaccggtcctagggtaggtcggtaaggtcggggtacggtacggggaacctaaaccccgtaacgtaccggttggtcgtacgacgtaggttccttacccgttaccctaaccccgcgttaccccggtaacccgggaacctaccgtaaacccgttacctaacgttaacccggaacccgtaacccgttaacccgttacccctaacctaaaccaaaccctaaccgtaacctaccgtaaccgtagttacgggaggtttggaacggaccgttccgtacgaacgttcgtacgtaccgggaaccgtacccggaccggttacccgttacgtttaaccttcggttacggtacggtacggaaccggtccgtacccggtaccggtacggtccgggtacgcccgtaccggaccggacggtaccggtaccggtttccgttaggtcccgttccggggtcggggtacccggg

SEQ ID NO: 207572 - DNA, 827 bp, Homo sapiens
  misc_feature: GYAE6OF01DMIRJ.17.25.C03.1.454.CMB.1.raw
  modified_base (322)..(322): a, c, t, g, unknown or other
  misc_feature (322)..(322): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggagggtagaagaagccgtcggggcctcgaggtagaaggttcctccgtgacgtaaggtcttcgtggtatttcctaaccggttttacctccttaagttacgtacttaccgtaaacgttggggtacnccggtccgaacgggtcccgtacggtacggaaccgaaccgtaccgttgggacggttgggaggtacggggagttccgggggaaccctaaaccccgtaacgtaccggttggtctacgaaccgtaggttcgttcccttaccaccctagtccccggtacgggactacggtaaccctttacgagtaccgaaccaaccgtaaccctccctaacctaactaaaccaccgtaccgtaccgtaacgtaggtacgggtaacggttacggacgggtaacctcccgtaagaacccgttacgttacgaccggtaacccggtaacccggtacccgggtttacccttacgttttaacgtttaccggttaggtacgggtaacccgtaacggtaccccgttaacccgtacgggttaaccgttaccggggtaccggtaacccggttaccccgggtaacggtacccgtaccggggttccccggtttacgtttacccgggtacggttttcccggggaacccggggg

SEQ ID NO: 207573 - DNA, 760 bp, Homo sapiens
  misc_feature: GYAE6OF01DQJOZ.17.25.C03.1.454.CMB.1.raw
  modified_base (153)..(153): a, c, t, g, unknown or other
  misc_feature (153)..(153): n is a, c, g, or t
  modified_base (188)..(188): a, c, t, g, unknown or other
  misc_feature (188)..(188): n is a, c, g, or t
  modified_base (570)..(570): a, c, t, g, unknown or other
  misc_feature (570)..(570): n is a, c, g, or t
tcagcgtagactagcacgaccggtgctcgatttagtagtgtagatttgggtttgggactcaacaaccacatctgtcctctagacgaaaaccctgtgagcacagctccctcaccatggactggacctggaggatcctcttcttggtggcagcanctacagtcgcccactcccaggtgcagctggtcgcnggtcgtggggctggaggtagaagacgccgtggggcctcgaagtgaaggtcctccgtgacaggtcttactggtattctacgtttaccaccttatagtaacttcaacggtttgggcgccgaccgacggtccgacgtcggaaccgtaaccggacccgtaggacgggttggtaggtaggggtaagtaccgggaccgtaaaaccccgtagaacgttgggtacgtcgtaacgtacgtttacgttccttaaccgaccctaccgtcccggtaccggggaactacgttaacctacggtactaacgtaccaaccgtacctaccctaacctaaacgaaaccactaacgtacccttagaacggttagtacgttagggaacggtacaccggttanaactacctggtaaccgaaccggtaccgtaacccgggtccgtttaacgttaacgtttcgttaggtaccggaacgttacgggtacccgtaaccggttacggaccggtacccgttacgggtaccctacccgggttaccgacccgtaccgggtacggttaccggttttaccgccgggtttcgggtaacccgggg

SEQ ID NO: 207574 - DNA, 706 bp, Homo sapiens
  misc_feature: GYAE6OF01DOYWB.17.25.C03.1.454.CMB.1.raw
  modified_base (377)..(377): a, c, t, g, unknown or other
  misc_feature (377)..(377): n is a, c, g, or t
  modified_base (398)..(398): a, c, t, g, unknown or other
  misc_feature (398)..(398): n is a, c, g, or t
  modified_base (405)..(405): a, c, t, g, unknown or other
  misc_feature (405)..(405): n is a, c, g, or t
  modified_base (412)..(412): a, c, t, g, unknown or other
  misc_feature (412)..(412): n is a, c, g, or t
  modified_base (613)..(613): a, c, t, g, unknown or other
  misc_feature (613)..(613): n is a, c, g, or t
tcagcgtagactagcacgaccggtgctcgatttagtagtgtagatttgggtttggggactcgaacaaccacatctgtcctctagagaaaaccctgtgagcacagctcctcaccatcggactcggacctggaggtactcctcttcgttggtcggcaggcgagtctacgaagtccgcccactcccggaggtgacacgcgtggtgcgagtcggtcgggctggtaggtaggaagtaacggccggtacggggtcctacgtaggtaggtaaccggtccttccgacggtacgaaggtcttcgtacggtctttaccgtacgtttaccgtctagttagtctacgacgtggcgccgacgcggctgtcgaacacgtcgtgcgaggtgnggagtcggacctaaccgtagngtgtacncgtaacncgtctcctaccaccgtcgaccggtacgactaacgtacccttacactaaccgcgtaaccaccgtactaaccgtaactaacacccgtacgacctaacgtacgtacgtacggttacgacggtacgtccgtagtactaccgtacgacgaacccggacgtacccgggtaccttacgttaacttccggagtaccgtaacgggtaacnccggtaccttacgggaccgttacggtacggtaccgtaccgtacggaccggtccgttaacccgtttgtaacccggttcggtcgggtaacccggg

SEQ ID NO: 207575 - DNA, 717 bp, Homo sapiens
  misc_feature: GYAE6OF01E35R3.17.25.C03.1.454.CMB.1.raw
  modified_base (253)..(253): a, c, t, g, unknown or other
  misc_feature (253)..(253): n is a, c, g, or t
  modified_base (301)..(301): a, c, t, g, unknown or other
  misc_feature (301)..(301): n is a, c, g, or t
  modified_base (316)..(316): a, c, t, g, unknown or other
  misc_feature (316)..(316): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagcgtggtgcagtcgtggggctggaggtagaagacgccgtggggcctgagtgacgtcctacctacgaggtcttcgnggtattcctacgtttacctcctaatacgtactacgaacgttggggtcnccgaccgagggcccncgtggaaccaaccgtaccgtggaggtgggagtaggggacgtcggggaacccaaaccccttaagtacggtcgggtctaccgaacgtacgttcgttccttacccacccgtagtccccggtacgggaactacgtacccttaacgagtaccgaacccaacgtaccctccctaacctaaactaaacccgacgaacgtccctaacgtacggtagggtacgttacggaacggtaccgtcctaggacctagtccgacgaccgtaaccgcccggtactactttacgtactggtcgacgtacgtcccgtacccgaacgtcccggtaccgggagacccggtcccggtacggcccggtaccggttcccgggtttactttaccgggtccgtttccggggccgggggtacccggg

SEQ ID NO: 207576 - DNA, 740 bp, Homo sapiens
  misc_feature: GYAE6OF01D644E.17.25.C03.1.454.CMB.1.raw
  modified_base (186)..(186): a, c, t, g, unknown or other
  misc_feature (186)..(186): n is a, c, g, or t
  modified_base (232)..(232): a, c, t, g, unknown or other
  misc_feature (232)..(232): n is a, c, g, or t
  modified_base (237)..(237): a, c, t, g, unknown or other
  misc_feature (237)..(237): n is a, c, g, or t
  modified_base (240)..(240): a, c, t, g, unknown or other
  misc_feature (240)..(240): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtcgcagtctggtncagtccgtgggctgaggtgaagagccgtgggcctcagtgagtctcngcagntcngtatcgacgttacctctatagtctacaacgtggtcgaccgtcgacgggtccgcggtaggaccgtaacgacccgtggaggtggtaagtcgggtaagtcgggaccgtaaccttaacgacgttcggtatccagtagtgtccttccacccgtacgtcccgaccgggactacggtaacttccctaacgtcgaacccgtaaccgtaaccgtacccgttaaccaacgtaaacccacgtaaccggaccttacgaacgttcgggtaacggtttaggacggtaccgtcgtacggaacctcgttaccgtacggaaccgtacccggaccggttacccgttagtttaaaccgttccggttcgggttaacgacccggtaacgggttacccgtacccgtaacggtaacccgggtacccgggttaacgacccggggtacccgttcccggggacgttaccccgggtaccggtttaccccgtttccggtaacccgggtttcggggtacccccgggggg

SEQ ID NO: 207577 - DNA, 831 bp, Homo sapiens
  misc_feature: GYAE6OF01DAF2W.17.25.C03.1.454.CMB.1.raw
  modified_base (598)..(598): a, c, t, g, unknown or other
  misc_feature (598)..(598): n is a, c, g, or t
  modified_base (637)..(637): a, c, t, g, unknown or other
  misc_feature (637)..(637): n is a, c, g, or t
tcagcgtagactagcacgaccggtgctcgatttagtagtgtagatttgggtttggggactcaacaaccacatctgtcccctagaagaaaaccctacgtgagcacagctcctcaccatggactggaccgtggaggatcctcttcttggtggcagcagctacaagtcgcccacctcccaggtgcgagcgtggtcgcgacggtcgtggggtcgtaggaggtaaggaaggaacgccggtcggggccgtacgaggtaggtaggtcctcgtaggaccgtaaggttcgttcgtaggtacctttacgttaccgtttaaccttacctaattaagttaactccgtaaacggttggggccgaccgccgacggccgtccgtaggaaccgtaaacgtacctggaggttaggaggttcggggaacgtccgggtaacccgaaaacccgttaacccgaggttgggtccgtaacgtaaccgagggtttcttaccgttaacccaccccgaccgttaccccggtacggggaaactacggttaaacccttaaccgacgtaacgaccccgttaaaccgaccctttacccaaccgaactaaaccgacgtacgactaacgngttaacggaggttacgaacggtacctacgtacgtaaacncggtaactacggaaccgacccggttaacgtccccgttaacgttaatttacccgggtagtacgggaaccttaccgaaccggtcccgtaaccgggttaaccgtcccggggtggtaaaccgtcccggggttaccgaccgaacgggtcccgttaacccgtttacgggttaccgtttcgggggacccgggtaaccgggg

SEQ ID NO: 207578 - DNA, 852 bp, Homo sapiens
  misc_feature: GYAE6OF01EXDR4.17.25.C03.1.454.CMB.1.raw
  modified_base (223)..(223): a, c, t, g, unknown or other
  misc_feature (223)..(223): n is a, c, g, or t
  modified_base (253)..(253): a, c, t, g, unknown or other
  misc_feature (253)..(253): n is a, c, g, or t
  modified_base (307)..(307): a, c, t, g, unknown or other
  misc_feature (307)..(307): n is a, c, g, or t
  modified_base (725)..(725): a, c, t, g, unknown or other
  misc_feature (725)..(725): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcgttggtggcagcagctacaagtcgcccactcccaggtgcagctggtgcgagtcgtgggctgaggtagaagagccgtagggccncgtaggtgagtcctcgtgacaggtcttcgnggtacttacgtaaccgtttacctacgtaataagttactacctaacgtggggtcnccggacgacgggcccgtcgtacggaaccgtaaccggtacctagggagggtagggaggtacggggacgttacggggaaaccctaaaaccccgtaggtacggttacgggttacgaacgtaacgtacgggtttccgttaccttaccctacccccgtaacgttaccccggtaccgggtaaactaccggtaaacccgttaaccgtaagtaacccgaacccgtaacgtaaccccttaccctaacccgtaaaactaaacccgtaacgtaaccgtaacccttaaacggtacggttaacgggttaacgggtaaccggaaacggggtacctaccccgttaagggaaccctttacgtaaccggttaaccggaaacccggtaaaccggttacccgggtacccggttttaaccgttaaggtttaacccggngtttaaccggaaccgggtacgtaccccgtacccgaacggtacgggttccgtaacggacccgacccggttaacggccgtaaccggttcccggttaccgtttaccggtaccgttccgggaaaccggggg

SEQ ID NO: 207579 - DNA, 691 bp, Homo sapiens
  misc_feature: GYAE6OF01B5NBG.17.25.C03.1.454.CMB.1.raw
  modified_base (516)..(516): a, c, t, g, unknown or other
  misc_feature (516)..(516): n is a, c, g, or t
tcagcgtagactagcacgaccggtgctcgatttagtagtgtagatttgggtttggggactcaacaaccacatctgtcctctagagaaaaccctgtgagcacagctccctcaccagtggactggacctgggaggactcctcttcgttggtggcagcagctacaagtcgcccactccgaggtggcacgcgtggtcgcaggtcgtggggctggaggtagaaggacgccgtcggggcctacgaggtgacggtctccgtgacgtaggcttcgtaggtacttccttaacgtttacctctaatacgtactacgacggtggcgccgcgcggcgcgtacggaacacgtacgtggagtggagtgggtgtacgggaacctaccgtaactcggtggtagtacagtacgttcgtaccctccaccgttacctccggacggtacacgtacctacactaccgaaccgtactaccttacccaactaaacacccaacgactcctagacgtggtacgtggacgtcaccgtagacngtaccgagccaccggccgttacgttactacggttcgtagaccggtaccggaacgttcccgtaacccgtacggggttccctaggtacccgggtaaccggtccccgggtaacccgggtacaaccggggtttcccgtttacggtttaaccggcccgggtttaacgggggggaccccgg

SEQ ID NO: 207580 - DNA, 730 bp, Homo sapiens
  misc_feature: GYAE6OF01A8NV2.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggcctcagtgaaggtctcctgcaggtcttcgtggtacttcacgtttacctcctatagtatacaacgtggggtcgccgccgacgggcccgcgtacgggaccaaaccggacctggacggtggagtgggagtcgggaccgtaaaccctaacgtacgtgggtcgtacgacgtaggttcgttccttaccaaccccgtagttccccggtacccggggtaacacggttaaccttacccgaagtaccgaaccctaaccgtaacccttccccgtaaccaaactaaaccacctaacgtccctaaacgtagtcgggttaagttacgggacggtaccgtccgtagaacctagtccgtaacggaacccggtaacgaccggggtcccttacttacgtttaccgtggttaccggacggtaacgacccggttaccccgaaaggtcccggttaccgggtacgacccgggtcccgtaacgggccgtaccgggtcccggttacctttacgggttcccggttcggggtaccggggg

SEQ ID NO: 207581 - DNA, 698 bp, Homo sapiens
  misc_feature: GYAE6OF01DDNN1.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtgcagcagctacaagtgcccacctcccaggtgcagctggtgcagtcgtggggctgaggtgaagaagccgtggggcctcagtgaaggtctcctgcaaggtcttcgtggattacctacgttacctcctatacgtatcaacgtgggtcgccgcacggcccgcgtacggaacaaccggtaccgtaggaggtggacgtgggacgtcgggaccaacccgtaactgtcggtactcgacgagttcgtcttaccaccctacgtcccgtaccgggactacgtaaccttaccaacgtaccggaacccaacgtaaccctacctaacctaaacgtaaaccacgactacctaacgaggtaggacgttagacggtacgtccgtagacctagtacgacggaccgaacccgtacgggtacccttacttaacgtttacgtcgtcggtaaccgaacggtacccgttaccccgaacggtaaccggtcccgggtacggaacgggtccccgtaaaccgggtacgaccggttacccgggttaccgttttaccggtaccggtttggggtaccccggggg

SEQ ID NO: 207582 - DNA, 800 bp, Homo sapiens
  misc_feature: GYAE6OF01BC2OV.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagccgtggggcctcgagtgaacggtcctccgtgaccaaggtccttcgtggtacttcctaccggtttacctcctaatacggtattactaacgtggggtacgccggtaccgacgggcccgtcgtacgggaaccaaaccggacctggaggtgggagtcgggagtcggggaccgaacccctaacgacgtcggtacgtacgactaggtcgttacccttccgaacccctacgtccccggtaccgggaactacgtaacctttaacccgattaccgaaccctaaccgtaacccgttccctaaccgtaaacctaaaacccgtaacccgaccgtaccccttaactacggtacgggtacgtttagggaacgggtaccgtccgtacggtaacctagttaccgtacggtaacccggtaaccggtacccgggtacccggttacgtttaacgtttaacgtcggttaccgggaccgtaacggtacccggttccccggaaaccgggttacccggttacccggggtagggtaccccgggtacccgtaccgggccggtacgggtaccccggtttaccgtttacgggttccggtttcccggggtacccgggggg

SEQ ID NO: 207583 - DNA, 708 bp, Homo sapiens
  misc_feature: GYAE6OF01COBHE.17.25.C03.1.454.CMB.1.raw
  modified_base (294)..(294): a, c, t, g, unknown or other
  misc_feature (294)..(294): n is a, c, g, or t
tcagcgtagactagcacgaccggtgctcgatttagtagtgtagatttgggtttggggactcaaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagacgccgtggggcctcgagtgaaggtcctccgtgctaaggtcttgtggtacttctaccgtttacctcctatagtatcaacgtgggtcnccgccgacggccgtcgtaggaacaaccgacctggaggtggagtgggagtcgggacctaacctacgcgtggtctacgacgtacgttcgttcctaccaccctacgtccgtaccgggactaacgtaccttacagtaccgaacccgtaacgtaccctcccgtaacctaaactaaaccaccctacgtacctaacgtagttaggtaggttacggacggtacgtccgtacgactaccgtacgtacggaacgtaccgtaccgggtacccttacgttaacgtttaccggttaggaccggtacgggtaaccgtacccggtacccgacggtaccggttacggggtacgtaaccggtacccggtaccgggacgtaccgggttcccggttaaccttttcgggacccggtttcggggtaacccggggg

SEQ ID NO: 207584 - DNA, 835 bp, Homo sapiens
  misc_feature: GYAE6OF01D5FDG.17.25.C03.1.454.CMB.1.raw
  modified_base (304)..(304): a, c, t, g, unknown or other
  misc_feature (304)..(304): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtgacagcagctacaagtcgcccactcccaggtgcagtctggtgcagtcgtgggctggaggtgaagagtccgtggggccttcgaggtgaacggtcctcgtgacgaaggtcttcgtgtacttcgtaccgtttacctcctataagttctacaacgtggggtacnccgccggtacggtcccgcggttaggaaccgtaacgacccgttaggtacgggtcggaaggtggggtacgttggggaacccgtaaaacccgttacgaccgttcggggtactacgacgtacggttacgttccgttaccgacccctacgtccccggtaaccgggactaaccgggttaacccttaaaccgtaccgtaaccgaaccccgtaaccggtaaccttacccccgtaactaaactaaaacccgtacgaaccgttaaccgttacgtaacgtacggggttaacggttacgtaacgggaccgtacccgtacgtaacccgtattaacccgggttggaaacccggtaccgggttaacccggtacccgtttaccgtttaaacgttttacggaccggttcggtaacggaaaccggttacccgtaaccccggaacggtttaccggtaccccgggttaacgtaccggttacccggaaccggtaccgggtacggttccccggttacggtttaccgttcccgggttacgggtaccccgggggg

SEQ ID NO: 207585 - DNA, 705 bp, Homo sapiens
  misc_feature: GYAE6OF01DBFI9.17.25.C03.1.454.CMB.1.raw
  modified_base (135)..(135): a, c, t, g, unknown or other
  misc_feature (135)..(135): n is a, c, g, or t
  modified_base (232)..(232): a, c, t, g, unknown or other
  misc_feature (232)..(232): n is a, c, g, or t
  modified_base (248)..(248): a, c, t, g, unknown or other
  misc_feature (248)..(248): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggagatcctnttctggtgcagcagctacaagtcgcccactcccaggtcgcagcgtggtgctagtcgtgggctggaggtgaagagccgtgggcctgagtgagtcctcncgcaaggtccttacgnggtacttcgtacctttacctctatagtactacgtacgtggtcgccgtcgacggtccgcgtaggacctaacgaccgtggtaggaggtgtgggacgtacgggaacctaaccccgtaagcggttagacgtacctacgtagggtttctacccgttaccgaaccccgtaccgttcccggtaaccgggaaccgtaccgttaaaccttcccgtaaatcccggtaacccaactaaccccctcccgttaaacccaaactaaaccgtactaccgacccttaagtaccggtagggtaacgttaggaacgggtctactacgaactgttaccggactaacccgacgtcccgggttactacgtttaacgtcgtacgtccggaacgtcgtaccgtacccaaacgggtcgtcgtacggacgtacccgtaggacctcggttacccgtacctttcgggtcgtcggggtacccggg

SEQ ID NO: 207586 - DNA, 753 bp, Homo sapiens
  misc_feature: GYAE6OF01DC3J5.17.25.C03.1.454.CMB.1.raw
  modified_base (616)..(616): a, c, t, g, unknown or other
  misc_feature (616)..(616): n is a, c, g, or t
tcagcgtagactagcacgaccggtgctcgatttagtagtgtagatttgggtttgggactcaacaaccacatctgtcctctagagaaaaccctgtgagcacagctcctcaccatggactggacctggaggactccttcttcttggtgcagcagctacgaagtcgcccactcccgaggtgcagcgtggtgctaggtcggtgggctaggaggtagaagacgtccggtcggggcctagtagtaggacgtcctcgtggacaagggtccttgtaggtacttccttaccgtttacctacctagttagtactacgacgttgggtcgcgaccgacggtacctacgtacggaaccgtaaccgacgtaggtaggtacggtaggtagggacggtacgggaacctaacggtaaccgttaacgtaggttcggttacgacctaaacggtcgttcggttaccctaccgaccctcgtacccgtaccggactaacgtacttacgctacgacctaccgacctaccgaactaacgtaaacccactacgtactaagagttggaacgttaggacgtacgtaccgtacgactacgtacgacggaccgaccggtacccgttaccttagttaccgttacgngggttaaccgtaccggtaacgtacccgtacccggttaacccggtacgggttacccggtacggtacccggtaacccgttaccgggtaccgttaccgggtcccggttttaccgttccgggttacccgggttcccggggg

SEQ ID NO: 207587 - DNA, 676 bp, Homo sapiens
  misc_feature: GYAE6OF01BTSPB.17.25.C03.1.454.CMB.1.raw
  modified_base (532)..(532): a, c, t, g, unknown or other
  misc_feature (532)..(532): n is a, c, g, or t
  modified_base (543)..(543): a, c, t, g, unknown or other
  misc_feature (543)..(543): n is a, c, g, or t
  modified_base (618)..(618): a, c, t, g, unknown or other
  misc_feature (618)..(618): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctaacaagtcgcccactcccgaggtcgcagcgtggtgcagtcgtgggctggaggtagaagaacgccgtggggctcgagtgaagtctccgtgcaaggtcttcgtgattcctacgtttacctctatagtatcgaacgtggtcgccgtaccgaacggcccgacgtcggaaccaaaccgtaccgtaggaagtgggaagttgggacgtacggggaacctaaacccgtaaactacgttggtagtaccaagtacgtcgtaccttaccaacccgtacgtcccggtacccgggaactacggtaaaccttaacccgactacggaacccaaccgtaacccaccttaacaaactaaacgaccacgtacctaagatagggtagtagagtacnccttagaactntcgacgtaacgaaccgtcgcctttattacgtacgtacgtagaccgaacgttaccacccgaagttccgtaccgggntaccggtaaccgaccggacgtacgggtccgtttacgttcgtacggttcggaaccgggg

SEQ ID NO: 207588 - DNA, 720 bp, Homo sapiens
  misc_feature: GYAE6OF01CF2XK.17.25.C03.1.454.CMB.1.raw
  modified_base (165)..(165): a, c, t, g, unknown or other
  misc_feature (165)..(165): n is a, c, g, or t
  modified_base (177)..(177): a, c, t, g, unknown or other
  misc_feature (177)..(177): n is a, c, g, or t
  modified_base (185)..(185): a, c, t, g, unknown or other
  misc_feature (185)..(185): n is a, c, g, or t
  modified_base (195)..(195): a, c, t, g, unknown or other
  misc_feature (195)..(195): n is a, c, g, or t
  modified_base (215)..(215): a, c, t, g, unknown or other
  misc_feature (215)..(215): n is a, c, g, or t
  modified_base (246)..(246): a, c, t, g, unknown or other
  misc_feature (246)..(246): n is a, c, g, or t
  modified_base (256)..(256): a, c, t, g, unknown or other
  misc_feature (256)..(256): n is a, c, g, or t
  modified_base (298)..(298): a, c, t, g, unknown or other
  misc_feature (298)..(298): n is a, c, g, or t
  modified_base (305)..(305): a, c, t, g, unknown or other
  misc_feature (305)..(305): n is a, c, g, or t
  modified_base (312)..(312): a, c, t, g, unknown or other
  misc_feature (312)..(312): n is a, c, g, or t
  modified_base (331)..(331): a, c, t, g, unknown or other
  misc_feature (331)..(331): n is a, c, g, or t
  modified_base (374)..(374): a, c, t, g, unknown or other
  misc_feature (374)..(374): n is a, c, g, or t
tcagcgtagactagcacgaccggtgctcgatttagtagtgtagatttgggttggggactcaacaaccacattctgtcctcgagacgaaaaccctgtgaagcacagtctcctcaccagtggactcggaacctgggaaggatccttcttcgtggtgcagcagcctanaagtcgaccctntcccaggncagtctaggnccgagtcgtgggctggaggngaacgagcctaggggccttgagtgaagtccnctagcaggtntcgtggacttcacgtttacctcgtatacgtatactaagtggncgaccgngccggtntacggaacacgtactaggngtaggtaagcgggagacggtactaacccgtagagtcggttacncgaacgtcgtcgttaacccgttccgaaaccccgtgttccccggtacggggaactaacggaacttacccgacgtacgtaaccgtaaaccggtaccctaaccgtaacctaactaaacgacgaaaccgtaccgtaaaccgtagtaccgggtaaggttacgaacggtacgacccgtaaggactaacgtacgacgacccgaccgttaaaccggtcgttactacgtaacgtgtaccgaacggtaccgacgtacccttaacgggcgtacccgggtagtaccgggtaccggtaaccgttaccggacgttacccccggtttaaggcccgttaacgggttcccgggtaaccggggg

SEQ ID NO: 207589 - DNA, 817 bp, Homo sapiens
  misc_feature: GYAE6OF01D23QH.17.25.C03.1.454.CMB.1.raw
  modified_base (135)..(135): a, c, t, g, unknown or other
  misc_feature (135)..(135): n is a, c, g, or t
  modified_base (607)..(607): a, c, t, g, unknown or other
  misc_feature (607)..(607): n is a, c, g, or t
  modified_base (627)..(627): a, c, t, g, unknown or other
  misc_feature (627)..(627): n is a, c, g, or t
  modified_base (634)..(634): a, c, t, g, unknown or other
  misc_feature (634)..(634): n is a, c, g, or t
tcagcgtagactagcacgaccggtgctcgatttagtagtgtagatttgggtttggggactcaacaaccacatctgtcctctagagaaaaccctgtgagcacagctcctcaccatgactggacctggaggatcctnttcgttgggtggcagcagctacaagtcgacccactcccaggtgcgagtcgtgggtgcgtacggttcggtggggtacgtggtaagggtaggaaaggaacggtcccggtggggtcccgtacgtaaggttagggaaacggttccgtaccggtacgtaccgaaggttcctttaggtacggttaacgtttccgtaaccgttttacccgtaccttaagttaacgtaactacgtaacggtgggtacgccggaccgacgggtacccgacgtacggaaccgtaaccggtaccggtaggtacggtacgggtaggtcggggtaacgtaccggtaaccgtaaacccgttaacgtacggttcggttagtacgagtacgtcgtacctaccgaccgtacgttcccgtaccggatacgtacctaaccgtacgaaccgttaacccaacgtaaccttcccaaccgtaactaaaccaccgaatacctaagnggtacgtagtacggagtccnggtaacncgatacgtagaccgtacgacgtcgttaacttagtaccggttgaccgggtaacgtaccgtaccgggaccctaaccgggttacgtacccggggtaacgtaaccggtccccggtaaaccgggtacggttcgggttaaccccgggttacgttttaccggtcccggggttaaccgggttacccggggg

SEQ ID NO: 207590 - DNA, 780 bp, Homo sapiens
  misc_feature: GYAE6OF01ED6UJ.17.25.C03.1.454.CMB.1.raw
  modified_base (336)..(336): a, c, t, g, unknown or other
  misc_feature (336)..(336): n is a, c, g, or t
tcagcgtagactagcacgaccggtgctcgatttagtagtgtagatttgggtttgggggggagtcagtctcagtcaggacacagcatggacatgagggtcccccgctcagctcctggggctcctgctactctggctccgagctgccagatgtgacatccagatcgacccagtcctccactccctccctgtctcgccttcgtggtcgggggtcagagtccaccatcacgttcgccgacaagtcgaacggtacttaaaaccttatttaaagttggtatcgagacaacgtaaaccgtaggaaaaccgccccaagaccctcgtagtactcgttcgtgggtnacctataccctacttcgtcggacgtaacggtcggaccgtaccgagttccggtacggttacgaggtcggactaggtcgtagtcgggtacggaactagtactttacgaaacttcctaacctaccacttaccctacctaaccttcgtaccgtaacccgtaaccgtaggtaacggttagttacggtacgtaaaccgttaacgttacctttaaccgttaaccgttacgtaaacctaacgtaacggttaaccgtttaacccggttaaccccgttttcccccggtaccgtttacccgtttaaccgggtttaccgggtaacccgggtaaccggggttaaaacccgttaaacgggttaaccgtaacggttaactaaacccggtaaaaaccggtcgttaacgggtaccgtaccgttactacccgtaaccgttacctttccgttaccgttacccg

SEQ ID NO: 207591 - DNA, 660 bp, Homo sapiens
  misc_feature: GYAE6OF01C5P82.17.25.C03.1.454.CMB.1.raw
  modified_base (195)..(195): a, c, t, g, unknown or other
  misc_feature (195)..(195): n is a, c, g, or t
  modified_base (278)..(278): a, c, t, g, unknown or other
  misc_feature (278)..(278): n is a, c, g, or t
  modified_base (481)..(481): a, c, t, g, unknown or other
  misc_feature (481)..(481): n is a, c, g, or t
  modified_base (514)..(514): a, c, t, g, unknown or other
  misc_feature (514)..(514): n is a, c, g, or t
  modified_base (579)..(579): a, c, t, g, unknown or other
  misc_feature (579)..(579): n is a, c, g, or t
tcagcgtagactagcacgaccggtgctcgatttagtagtgtagatttgggtttgggactcaacaaccacatctgtcctctagagaaaaccctgtgagcacagctccctcaccatggactggacctggaggactccttcttcgttggtggcagcagctacaagtcgcccactcccgaggtcgcagcgtggtcgcgngtcgtgggctggaggtgaagacgccgtgggcctcgagtgacgtctccgtgacgagtcttcgtgtacttcgtaccgttttaccncttatagtactcgtaacgtggtcgcgccgagggccctcgtacggaaccaccggacgtggaaggtcgggaagtgggacgtccgggaacctaacccctaaggcgtggtaccgtacgagtacgggttctcctacccaacccgtgttcccgaacgggactacgtaaccttacgatccgtaaccaccgtaccacctacaacgtaaccncacgtacacgagtaggagttcgaggctaccgtnacgcgttaacgccgaaccggtaccgacccgggttctaacgtttcgttacctggacgtaccgaacncccggtaaacgaccggtcggaacgttcgacccggtacgtcgcgacggttcccgtacgttccggtacgtcgggtaaccgggg

SEQ ID NO: 207592 - DNA, 833 bp, Homo sapiens
  misc_feature: GYAE6OF01CU9H8.17.25.C03.1.454.CMB.1.raw
tcagcgtagactagcacgaccggtgctcgatttagtagtgtagatttgggtttggggactcaacaaccacatctgtcctctagacgaaaaccctgtgagcacagctcctcaccagtggactggaccgtgggaggactccttcttcgttggtggcagcagctaacaagtcgcccacgtcccgaggtgcgagcgtggtgacgtggtcggtcgggcgtggaggtaggaacggacggtccggtcggggcctacggaggtaggacggttcctccgtacggacgtaacggtctttacggtacggttaccgtttaccgttaccgtttttaccttaccgttaacgttaacgttacgttaaccgtaacggttcggggttccggaccggaccgacgggccgtacggtacggaaccgtaaccggtacgtggtacgggtacgggtacggtacgggtacgggtacgggtaacccgtaaacccgtaacggtacggttacgggttacgtacgtaacggtacgttccggttacccgttaccgtaaccccgttaccgttacccggtaccggtaaccgtaaccgttaaccgtaccgtacggttaacccgaacccgtaacctacccgtttaaccaacctaaaccttaaccaaccgtaccgtaccgtaaacgtacggttacgggacgttagggaaccgtacgtacgtcgtaacgacgtcggacgaacccgtcggaacccggttctttaacttacggtacttcggaccgtagtacccgtaccgtaccggcgtacgggcccgtagtcccggccgaacgtcgaccggttcttaaccggtcgttcggcgggtaccgg

SEQ ID NO: 207593 - DNA, 667 bp, Homo sapiens
  misc_feature: GYAE6OF01DN6IZ.17.25.C03.1.454.CMB.1.raw
  modified_base (225)..(225): a, c, t, g, unknown or other
  misc_feature (225)..(225): n is a, c, g, or t
  modified_base (646)..(646): a, c, t, g, unknown or other
  misc_feature (646)..(646): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttgggtggcagcagctacaagtcgcccactcccaggtgcagctggtgcagtcgtggggctggaggtgaagaagccgtggggcctnagtgaaggtctccgtgacaggcttctggattctaccgttttacctccttatagttactactaacgtgggtcgccgccgtacggcccgcgtacggacaaccgaccgtggaaggtgggacgttggggacgtcgggaacccgtaaaccctaacgacgtggtcgtaccagtagttccgtctttaccgaccctagtcccgtaccgggaactacgtaaccttacgacgtaccgtaaacctacccgtaaaccctccgttaacccaaacttaaaaccgaacctaccgaccttaacgaacggttaggtagttacgggaacggtacgtccgtagactagtcgtaacggactacggccggtcttcttacttacgtgtcgacgaacgtcctcccgacggtacgtccggtagcgcccgacgcgacgtcccggtntttcggcgttcgggcccgggg

SEQ ID NO: 207594 - DNA, 670 bp, Homo sapiens
  misc_feature: GYAE6OF01E2BH2.17.25.C03.1.454.CMB.1.raw
  modified_base (371)..(371): a, c, t, g, unknown or other
  misc_feature (371)..(371): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactccaggtgcagctggtgcagtcgtggggctggaggtgaagagccgtggggcctcgagtgaaggtctcctgcgtaaggcttcgtggtacttcaaccgttttacctccgtatagtactctaacgtgggtcgaccgtccacggccgacgtcgggacaacggacctggacgtggatgggatggggaccaaacccctaacgactgggtntacgacgtagttgtcctaccaccctatcccgtaccgggacacgtacttaccgatacgaccaacgtaacctcccgtaccaataaacccacacgtacctaacgagtacgggtagttacggaggaccgtccgtacgaaccgtacgtacgtcgaaccggaaccgacccgggttcgttaccgttaattaccgtaggtcgacgtaacgtaccggacccgtaacggtacggtacccgggttagtacggcccggttaccggacgtacgggtccggttacctttcggtaaccgttccggtaccggggg

SEQ ID NO: 207595 - DNA, 816 bp, Homo sapiens
  misc_feature: GYAE6OF01ASCJA.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttgggtggcagcagctacaagtgcccactcccaggtgcagctggtgcagtcgtgggctgaggtgaacgtagccgtggggcctcgagtggaaggtcctccgtgacaaggtcttcgtaggtacttctaccgttttacctccttatacgttacttacaacggttggggttcgccgaccgtacggcccggtcgaggaccaaccgtacctggaggttggagttaggggcgttacggggaccgtaaaaccgtacgtaacgttcgggttgtacctagtacgttgttaccttacaaccccgacttcccggttaaccggggacctaggtaccttaccagtaccgtaccaaccggtaaccttccccgtacctaaacgtaaacccaactcgtaaccctaactacgtaagggtacgttacggaggtaaccggtccttacgaactacgttaccggaacggtaacccgggtacgtaaccccgggggttacccctttacggtttaacccgtttaacggtcgggttacggtacccgggtaccggttaaacccggtaccccccgtaacgggtacccggttttacccgggaccgggtaccgtttacccccgggaaacggttccccggaaacgggttccccggtttaccggttttaacccgggttacccgggtttcgggttaaacccccgggggg

SEQ ID NO: 207596 - DNA, 657 bp, Homo sapiens
  misc_feature: GYAE6OF01BLSBB.17.25.C03.1.454.CMB.1.raw
  modified_base (102)..(102): a, c, t, g, unknown or other
  misc_feature (102)..(102): n is a, c, g, or t
  modified_base (138)..(138): a, c, t, g, unknown or other
  misc_feature (138)..(138): n is a, c, g, or t
  modified_base (145)..(145): a, c, t, g, unknown or other
  misc_feature (145)..(145): n is a, c, g, or t
  modified_base (149)..(149): a, c, t, g, unknown or other
  misc_feature (149)..(149): n is a, c, g, or t
  modified_base (250)..(250): a, c, t, g, unknown or other
  misc_feature (250)..(250): n is a, c, g, or t
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
  modified_base (346)..(346): a, c, t, g, unknown or other
  misc_feature (346)..(346): n is a, c, g, or t
  modified_base (352)..(352): a, c, t, g, unknown or other
  misc_feature (352)..(352): n is a, c, g, or t
  modified_base (440)..(440): a, c, t, g, unknown or other
  misc_feature (440)..(440): n is a, c, g, or t
  modified_base (513)..(513): a, c, t, g, unknown or other
  misc_feature (513)..(513): n is a, c, g, or t
  modified_base (560)..(560): a, c, t, g, unknown or other
  misc_feature (560)..(560): n is a, c, g, or t
  modified_base (636)..(636): a, c, t, g, unknown or other
  misc_feature (636)..(636): n is a, c, g, or t
  modified_base (652)..(652): a, c, t, g, unknown or other
  misc_feature (652)..(652): n is a, c, g, or t
tcagcgtagactagcacgaccggtgctcgatttagtagtgtagatttggggtttgggagtcagtctcagtcaggacacagcatggacatggacgggtccccnctcagcctcgtgggcctcctgcctactctggctcgnctgcagntggnacacgtccagtctacgacctagtcctacctctccctccgtgtcctcgtccttcggtggggtacggggtacagtcaccaacctctctacgttcgaccggtanaagtccgtaacggtaactttaaaacttagtttaatggtaatcgacgtacaagaaccgtaggaaacctcccgctaccgtctagtcctnttcgngtcncctacnctactggactacggaggttcgaccctcgagtaggtttcggcgtagggtcgataggtcgactacggggactaagttacttctaactaanccctaccgaacctacctccaacgccttacactactaacggcggttagtactggtactaactcttaacctaacncgttaactacgtaacggttactaaccgttactacccgttccgttacncgtttacgggaaccgtcgggaaccgtacgtaacggtagtaacgtaacgtacgtaaacgtccggtgtaccacggtanaccttaagcttacgtnttccg

SEQ ID NO: 207597 - DNA, 527 bp, Homo sapiens
  misc_feature: GYAE6OF01BDHRC.17.25.C03.1.454.CMB.1.raw
  modified_base (340)..(340): a, c, t, g, unknown or other
  misc_feature (340)..(340): n is a, c, g, or t
  modified_base (345)..(345): a, c, t, g, unknown or other
  misc_feature (345)..(345): n is a, c, g, or t
  modified_base (486)..(486): a, c, t, g, unknown or other
  misc_feature (486)..(486): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaggcttctggattcacgtttacctcctatagtatcaacgtggtgcgccaggccgctggacaacggacctggagtggatgggatgggacaaccctaacacgtggtntcacngtgtccttcaccactccgtcgggacagactacatgaccacgactccacataaacacacgacctatatggtagtaggagacgctgacatcgtagacgacacggtccgtatacttatggtgcgagtcgacccgacgcgtcggngcgtccgacgacctcggcgtcttcgtacgttcggtccgggg

SEQ ID NO: 207598 - DNA, 869 bp, Homo sapiens
  misc_feature: GYAE6OF01D3G9G.17.25.C03.1.454.CMB.1.raw
tcagcgtagactagcacgaccggtgctcgatttagtagtgtagatttgggtttggggactcaacaaccacatctgtcctctagacgaaaaccctgtgagcacagctcctcacatggactggacctggagactcctctttcgttggtggcagcagctaacgtaagtcgaccctactcccgaggtgacgacgcgttggagcgtaggtcggtggggacgtaggagggtagaacggacggtccggtcggggccctaggtagtacgtaacggttcctccgtgacgtaggtacttcgtacggtacttaccgttacgtttaccctacgttaagtacgttaactacgtaacgggttcggtcgaccgaccggtaccgggcccgttaggtaaccgggacctaaaccggtaccggtttaggggaacggttacggggtagggttacggggtaacgggtacccgggtaaaacccgtaaacccgttaaccgtccggtttagggaccgttaaccgaaaccggtttcggttacggtttaccccttaacccgaaccccgttaacccggttttaccccgggaaccgggtaacctaaacccggtttaaaccctttaaccgacgttaaacccggtacccgaaacccctttaacccgttacccctaaaccgtaaacctaaaacctaacccgtacgttaacccgtaagacggttacggtagtacggtaacgcggttaccacgtactaccgtacgtaacgtaccgacggtacccgtactttacgttacgtacgtcgtaacggtacccgtacgtacccgaccgttacggaccgttacggacggtacctacggtacgacggtcggttaccgtcggttaactggtccggtacggg

SEQ ID NO: 207599 - DNA, 924 bp, Homo sapiens
  misc_feature: GYAE6OF01EK9RU.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgagggtgaagaagccgtggggcctcgagtgaaggtctcctgcaaggcttctggattactacgtttacctcttaatagtatcaagtcgggtgtaccgccgacggcccgtcgtacgggaaccaacggtacccgtaggtacggtaggtaaggttgggaaacgtcggggaaccgtaaaaccccgtaaacgtacgttcgggttggtaccaacggttacgggttacgttacccgtttaacccaaccccgtaacgttacccgtacccgggggaaacttaaaacccgggtaaacccttttaaacccgtaaccgggttaccggtaaaaccccttaaaccccggtaaaaccccgtttacccccgtttaaacccgtaaaacgttaaaaaaaccccccgaacgttaaaacccgggtaaccccttaaacggtaaggtttaaccgggggtaaacggttttacggggtaaacgggaacccgttaccccggttagggttaaacccgtacgtttaccgtacgggaaaccgaacccggtaacccggggttacccttaacgttaacgttttaaccgtgggtaaccggtaacggtaaccgggttacccgttaaccccggaaccgggttaaccggttacccgggtagggtaaacccggttccccgggtaaaacccgggccggtaaacggggtccccgggtttaaaccctttttacgggtaccccggtttagggttaccccgggggggg

SEQ ID NO: 207600 - DNA, 759 bp, Homo sapiens
  misc_feature: GYAE6OF01B8CXU.17.25.C03.1.454.CMB.1.raw
  modified_base (174)..(174): a, c, t, g, unknown or other
  misc_feature (174)..(174): n is a, c, g, or t
  modified_base (246)..(246): a, c, t, g, unknown or other
  misc_feature (246)..(246): n is a, c, g, or t
  modified_base (367)..(367): a, c, t, g, unknown or other
  misc_feature (367)..(367): n is a, c, g, or t
tcagcgtagactagcacgaccggtgctcgatttagtagtgtagatttgggtttggggactcaacaaccacatctgtcctctaagagaaaaccctgtgagcacagctcctcaccatggactggacctggaggactcctcttctggtgcagcagctacaagtgcccactccaggtncagctggtgacagtcggtgggctagagggtagaaggaacgtccgtcggggcctcgaaggtacggaaggtccnctggacgtaaacgggtctttcgtagggtactttaccgacgttttaccctaccttaagtaacgtaattaccgaacggttggggtcgccgccgaggcccgtacgtacgggaacaaccggtacngtacggtggaagtgggaagtaccggggaccgtaaacccctaagtaccggtggttacgaccgtagacggttcgtaccgttaccacccgtacgtacccggtacccgggaataaccgaacctttacaaccgtttacgaacccgtaaccgtaacctacccttaaccgaaaccttaacgaaaccacgtacctaaacgagtaccgggtagttaagacgggtacaccgaagacctagttcgaacgggaccaacggtacgtaccgaacgtttacgttaactggtacggtaacgtaacgaccgggtaaccccaacggtaccggtttaccgggacgtacgggcccgtaaccggcggtaccggtaccggtttcgttaaaccgtccggtacgggtaaccggggg

SEQ ID NO: 207601 - DNA, 741 bp, Homo sapiens
  misc_feature: GYAE6OF01A79UZ.17.25.C03.1.454.CMB.1.raw
  modified_base (196)..(196): a, c, t, g, unknown or other
  misc_feature (196)..(196): n is a, c, g, or t
  modified_base (368)..(368): a, c, t, g, unknown or other
  misc_feature (368)..(368): n is a, c, g, or t
tcagcgtagactagcacgaccggtgctcgatttagtagtgtagatttgggtttggggacgtcaacaaccacatctgtcctctagagaaaaccctgtgagcacagcgtccgtccaccatggactcggaccgtggaggactcctcttcttggtggcacgcagctacaagtcgcccactcccgaggtgcagcgtggtcnctaggtccgtggggcctaggtaggtacggaaacgacggtccggttacggggcccttacgaagggttacggaaacggttccgtcccgtaggaccggtaacggtcgttcgtagggtacttctaaccggttttacctcttagtagtactacgtaacgttgggacgaccggtaccngggtacccgcgtaagggaacctaacccgccgtaggtaggtcgtaggtcgggaacgttccgggaacctaaaccgtactcggttcggtacgtacaggtacgtcgtacctccaccgtagttcccggacgactagtacctaagagtcgaaccgtacgtacctacccgtactaaacaactaccgaacgtaccctaagtacgtacgggtagtacggagacctcgtacgactacgtaccgtgaacccgtaccgtaaccggttccttaagttaaccgtagtacgtacgaaccgtaggtcccccgtacgtaacgccggtttcggacgaccggtaccgacggtaccgcggttaccgttacgtaaccgtcggtacgggtccggg

SEQ ID NO: 207602 - DNA, 936 bp, Homo sapiens
  misc_feature: GYAE6OF01CLTFB.17.25.C03.1.454.CMB.1.raw
tcagcgtagactagcacgaccggtgctcgatttagtagtgtagatttgggtttggggactcaacaaccacatctgtcctctagaagaaaaccctgtgagcacagcctcctcaccagtggacgtcggacctggaggactccttcttcgttgggtggcagcagctaacgaagtcgcccactcccgaggtgcgagtcgtggtcgcgtacggtcggtcggggtacgtaggagggtaggaaacggaacggtccgggtcgggggccttacggaggttacgggtaacggtttcctaccgtacggaccgtaacgggtccgtttacggttacggttaactttacccgtttaacccggtttttaaccctaccgtttaaagttaacggttaacgttacccggttaacggttcgggggtccggacccggccccggtaccggggaccccgtcggtaaccgggaaaaccgtaacccggtaccggttaggggaaggttaggggtacggtacggggtaacggtaccggggtaaacccctaaacccggtaaccggtacgttggggtacctaccgtagttacggttcccgttaccttacccgaaccctacggtaccccggttaccgggaactaacgttacccttaacgtacgacccggtaacctaacccgttacccttaccctaaccaaacgtaaaccacccgacgtaaccttaacgagggtttacgggacgttaagggacggtaccgtaccgtacgaacttgtaacgtaacggacccgtaaaccggtcccggtacgttacgttaaccttagggtccgaaacgggtcaacccgggttaccgtacccggtaacggtcggttaacccgggcgggtaacccggaccccgggtacgtaccggggtaacccttccgggttttaccccggttagggtcccggttcggggggaaccccggg

SEQ ID NO: 207603 - DNA, 719 bp, Homo sapiens
  misc_feature: GYAE6OF01B6XIM.17.25.C03.1.454.CMB.1.raw
  modified_base (665)..(665): a, c, t, g, unknown or other
  misc_feature (665)..(665): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgccagctggtgcagtcgtggggctgaggtgaagagccgtggggcctcagtgaaggtctcctgacaggcttcgtggtacttctaccgtttaccctcctaatacgtactccaacgttggggtacgccgtcccgagggccccgcgtacggaaccaaccggaccgttagggaggtacggggaggtacggggacggttacgggacccgtaaaccccgtaacgaccgttgggacggttaccaagtacggttcgttcctacccgtaccccgtacgtcccggtacccggggaactacggtaacccctttaccgataccgaacccgtaaccgtaacccgtcccctacctaactaaacccaccgaaccgtaccctaactagttacggggtagttacggacgggtacgtccctacgaccgtacttcggtaccgaacggaccgtaccggtccgttactacttacgtgacgtcgacgtaccgtaccgaccgtcgtcggtacgnggtccccgtaggaccgtacggcccggttcgtttacgtccggtggttacccgggg

SEQ ID NO: 207604 - DNA, 1059 bp, Homo sapiens
  misc_feature: GYAE6OF01EJOZP.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggagatcctcttcttggtggcagcagctacaagtcgcccactcccaggtgcagctggtgcaggtcgtggggctggaggtagaagagccgtgggcctagagtgaagtcctctgcgaggtctcgtggtcttccgtacgtttacctactatacgtatacgaacgtcgggtcgccgaccgtacgggcccgtacgtacggaaccgtaaccggtaccgtagggtacggtacgggtaaggttacgggggacgggttacccggggtaaacccgtaaacccccgttaaaaccggtaaccgggtttacggttaaccggtttaacccggtaaaccggttaaacggggttttcccgttttaccccggttttaaccccccgaaaccccgttaccccgggtttaaccccccggggtaacccggggggtaaaccccgttaaaccggttaaaccccccgtttaaaccgtaaacccggtttaacccggaaaaccccccccggttaactttaaaccccccgttaccccggttaaaacccccttaaaacgtaaaaaacccccgtacccttaaaccgggtaccccctttaaaagggtacgggttaacgggtttaacggtttaaacgggggaacgaaccccggttcccgtttaaacggaccgtttaaacccgttacgggtaaaccccgggtaacccgggtaaccccggttaacccggggttaaccccttttaacgttaaccggttttacccgggttacgggttaaccggaaccgggttaccccggtaaaaccccccggggttaccctaaacccgggttccccggggttaaaccggggtcccgggtaaaccccgggtacccccgggttaaacgggcccccgggtttccggttacccccggggtttaaaccggtttttcccgggtaacccgggtttcccgggggaccccgggggggg

SEQ ID NO: 207605 - DNA, 719 bp, Homo sapiens
  misc_feature: GYAE6OF01BVS5X.17.25.C03.1.454.CMB.1.raw
  modified_base (250)..(250): a, c, t, g, unknown or other
  misc_feature (250)..(250): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactccaggtgcagctggtgcagtcgtggggctggaggtgaagagccgtggggcctgagtgaacggtctcctgcgaaggtcttcgnggtacttcgtaccgtttacctacctatagtactacgtaacgttgggtcgacgtccgacgggcccgtcgtacgggaaccaacggtaccgtggaggtcggtaagtgggtagtaccgggaaccgtaaacccgtaacgtacgtggtcgtacgactaggttacgtctaccacccgtacgtcccgtaccgggactacgtaccttaccgagtacgaacccgtaccgtaacccttaccctaaccgtaaactaaaccgaaccgtaaccgtaccgttaaacgacgttacgggtaacgttagggaaacggacgtaccgtacgaacgtacgttcgaacggtaccgaccgaccggggttacctacgtttactacgtacggtcggacgtagtacccgtaccgtaacggtcggtccggttacggaccgtacccggacggaccgtacggccggttaccgttcggtaccgttccggggtaccgggg

SEQ ID NO: 207606 - DNA, 719 bp, Homo sapiens
  misc_feature: GYAE6OF01C1EFX.17.25.C03.1.454.CMB.1.raw
  modified_base (550)..(550): a, c, t, g, unknown or other
  misc_feature (550)..(550): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggagatcctcttcttggtggcagcagctaagaagtcgcccactcccgaggtcgcagcgtggtgcagtcgtagggctaggaggtggaaacgaggccgtcggggcctgagtgaacggtcctccgtgacgaacgtcttacgacggtactttaccgtaccgttttacctaccgttagtagttacctacgtaacggtcgggtactccggaccggtacgtcccggacgttaccgaaccgtaaccgtaccgtgggtaaggtagtacgggtggtaacggtcggggtaaacccaacccgtaacgtcggttcgggtactaccgagttaacgttccgtcttaccccgaacttccggtacgtacccggataccggtaccttacgagtacgaacccacgtacctcgtacgaactaaccgactacgtaccagtgtaggngtacgacgtcgtccgtagacgacgttacgacgaaccgacgtaccggtaccttacgtacgttacgacggttcgcgtaacgaccgtaccgacggtacgtaccggacgtaaccgccgggtaacgtcccggtaacggtccggttccgtttacgtaccgggtggtaacccgggg

SEQ ID NO: 207607 - DNA, 901 bp, Homo sapiens
  misc_feature: GYAE6OF01E43O5.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcaggtgaaggtctccgtgcaaggtcttcgtggaggcctaccgttcgagtccgtaacttagttagtttacgaagttggggtcgccggaccgggtccttcggtacggaaccaacgggtcccgttaggacggtggacggtaggggaacggtacgttccggttacccgttagttccggttacgaacctaacccgtaaacccgtaaaacgtaccgaaccgtaacgtaaacggtaaacggtttacccggaacggggtaccaacggtaacccttaccgaaacccgtaacggtaaacccgggtaaccggaaaccttaaaaacgttaaacccgaaacgtaaaccgttaaacggtttaaacgttaccggttaagggaaccgtaccgttaaacgaaacccgtacggttacccgttaacgttactaacgttccggtagggtaaaccgggtaaccggtaaccggggttaccttttaccgtttaacgttccggttaacggtaccgggtaaccggtaacgggttaaacgttttaaaccgttaaaccgttaaaccggttaaaccgttacccggtttaacccggtttccccgtttttaaaccccgtttttaacccccgtacccccgttttaacccggtttaccggtttaaccccggtttttcccgggtaacccggggttacccgttaaaccccggggg

SEQ ID NO: 207608 - DNA, 756 bp, Homo sapiens
  misc_feature: GYAE6OF01EJ46Z.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctcgagtgaggtctcctgacgaaggtcttcgtggtacttcctaccgtttacctccttatagtatcaacgtggtcgccgccgaggccgcgtggaaccaacgaccgtggagtcggagtgggtacgtgggacccgtaaacctaacgtacgttcggtgtaccgacgtagttcgtaccttacccgacccgtacgttaccccgtccgggtaactacgttaaccttaaccgtacgtaccgaacccctaaccggtaaccttcccctaaccctaaagtaaaacccacgtaaccgtccccttaagtacgtttacggggtaacttaggaacggtacgtcccgttaacgacctaaccgtttacggacgtaacccggtaaccgtacccgggtacccgtttaacgttacgtttaccgtacgggtccggaacgggtaaccgtaccgggtacccgttaacggtaccggttccgggtaacggtccgtaaccccggttacggaccggtaccgggttcccgttaaccggttttcggttaacccgttggggtaacccggggg

SEQ ID NO: 207609 - DNA, 982 bp, Homo sapiens
  misc_feature: GYAE6OF01C2RMU.17.25.C03.1.454.CMB.1.raw
  modified_base (636)..(636): a, c, t, g, unknown or other
  misc_feature (636)..(636): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcgttggtgcagcagctacaagtcgcccactccgaggtgcagcgtgggtcgcgagtccggtgggggtctggagggtagaaacggaacggtccggtcggggcccttacgaagggtacggtaacggttccgtacccgttaggaaccgtaaacgggttccgtttaccggtagggttacctttaacccttaacccgggttttaaccccttacccttaagttaaaccggttaacttaaccgtaaacgggttcggggggttaccgacccgggaccccgtaacggggacccggtaccggtacggggtaaaaacccaacccggttaccgttagggtaagggtaacggggtagtcgggggaacgttacgggggaaacccccgtaaaacccgtaaccgtaccgggtttcgggtacgtacgtacggttaaacggttccggtttacccttacccaaaccccgttccgttaccccggttaaccggggacctaaaccgtaccgtttaaaccnccggtacgaacccgtaaaccccgtaacctacccctaaacctaaacctaaaacccgaaccgtaacccgtaacccgttaaacgaccggttacggggtaacggttacggggtaaacggtcccggtaaccgttaacgtacgtaacgttccgtaaaccgggaaccgtaaccgggtaacccgggttacccttaactttacgttaaggtaccggttaccgaacgggtaaccgtacccgtaccccggtaaaccgtccgggttaaccgggtcggaaacccgtacccggggtaaccgtaccggtaccgggtccggtttacccgtttaacgggttccgtaccggggggtaccggggg

SEQ ID NO: 207610 - DNA, 735 bp, Homo sapiens
  misc_feature: GYAE6OF01AJTXZ.17.25.C03.1.454.CMB.1.raw
  modified_base (678)..(678): a, c, t, g, unknown or other
  misc_feature (678)..(678): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtcgccccactcccgaggtgcgagcgtgggtgcgtagtcgtggggctggagggtgaagacgccgtggggcctcgaggtggtaacggtcctccgtggacgacggtcttcgtggtacttcgtaccgtttacctcctagttagtataccaacggttgggtcgccgtaccgacgggtccgcggttacggaaccacggtacctgggaggttcgggagttacgggggagtaccggggacctaaacccccgtaagaccggttgggtcgtaccgacgtaggttcgttcccttaccgaccccgtcgtcccggtacgggacctaaacgttacccttaccgagttaccgaaccctaaccgtaccctacctacaactaaaccgaccaccggtaccctaacgaggttacggtacggttaggaacgggtacctccgtagtaacgtcgtacgtaccgggacgacccgtacccgggtaccttacttaagttaccgtgtacgaccgtacgtaccgtacccaggtccggttaccggnggtacccgcggtaaccgcgtaccggtccgttcgttcgtaggttccgggtacccgggg

SEQ ID NO: 207611 - DNA, 784 bp, Homo sapiens
  misc_feature: GYAE6OF01EHIFT.17.25.C03.1.454.CMB.1.raw
tcagcgtagactagcacgaccggtgctcgatttagtagtgtagatttgggtttgggactcaacaaccacatctgtcctctagagaaaaccctgtgagcacagctcctcaccatggacctggacctggaggatcctcttcttggtggcagcagctacaagtgcccactcccgaggtgcagcgtggtgcagtcgtggggctggaggtgaagagccgtggggcctcgagtgaaggtctcctgcagcttcgtggtacttcgtacgttacctctatatactacaacgtgggtcgcggccacggccgcgtggaccgaacgaccgtggaggtggagtgggagtcgggaccgaaacccgttaacacgttcgggtagtaccgtacgtaggttcgtacctttaccgacccctaacgttccccggtaccgggtaactaccgtaaccgttaacccgacgttaaccggtaacccaaccggtaaccttaccccgtaccctaaacgttaaaacccaccgaaaccgtacccgttaaacgtaggttaacgggtaaccggtttagggaacggggtaccctaaccgggttacgacgtaaccgtaaccgtacgggtaaacccgacccggttaaacccgggttccgtttaaccggttttaacgttaacccgttgggttaaccgggaccgtaacggttccccgtaaaccggtacgtacccgggttacccgggtagtaacccggtacccgtacgggacccgtacgggtacccgttccggtttacgttccggttcggggtacccgggg

SEQ ID NO: 207612 - DNA, 645 bp, Homo sapiens
  misc_feature: GYAE6OF01ATZVO.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacagtgcccactcccaggtgcagctggtgcagtcgtggggctggaggtagaagaacgccgtggggcctcgagtgaaggtcctccgtgcgaaggtcttcgtggtattctacgtttaccctccgttataagtctctaaacgtggggtgccgacccagggcccgcgtacggacaaccgacctgaggtcggagtgggagtgggaccaaccctaagaccgtgtcgtacactaggtcgtcgttaccacccgtacgtccgtaccgggacagtaccttacagtacgaaccacgaacctccctacaataaccacacgtcctaacagttcgagttagagtacggccagtacactcgacgacgaccgaccgggtaccttcttacgttaaccgtgtacgtaccggagtacccgtacccgtacggtacgtaccggcgggtaacgcccgtaaccgggccgtaaggtcccgggttacccttttacggcgtttccggacccgggggg

SEQ ID NO: 207613 - DNA, 688 bp, Homo sapiens
  misc_feature: GYAE6OF01A16VO.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcgtggattcacgtttacctcctatagtatcaacgtgggtgcgccaggccgctggacaacgacctgagtggatgggatcgggaccgaaccctaacacgtggtcgtacacgagtgtcctcacccacgtccgtaccgggacagtaccttaccgagttcgaacccgtaacgtaaccctcccctacccgtaactaaaacccgaccaaccggtaccctaaccgtaacgttcggggtaagtttcggaaacgggtacgccccgtagacctaacgttccgtacggaacccggaccgtacccgggtacccgttacttaacgtttaccgtggtacggccggaacgtacccgtaccccgtaacggtaccgttcccggggtagtaccggtcccccgttaagggcccgtaacgggtcccggttacccgttttacggacccgtttccggggtacccggggg

SEQ ID NO: 207614 - DNA, 654 bp, Homo sapiens
  misc_feature: GYAE6OF01CS2OD.17.25.C03.1.454.CMB.1.raw
  modified_base (182)..(182): a, c, t, g, unknown or other
  misc_feature (182)..(182): n is a, c, g, or t
  modified_base (327)..(327): a, c, t, g, unknown or other
  misc_feature (327)..(327): n is a, c, g, or t
  modified_base (422)..(422): a, c, t, g, unknown or other
  misc_feature (422)..(422): n is a, c, g, or t
  modified_base (511)..(511): a, c, t, g, unknown or other
  misc_feature (511)..(511): n is a, c, g, or t
  modified_base (517)..(517): a, c, t, g, unknown or other
  misc_feature (517)..(517): n is a, c, g, or t
tcagcgtagactagcacgaccggtgctcgatttagtagtgtagatttgggtttggggacgtcaacaaccacatctgtcctctagagaaaaccctgtgagcacagctcctcaccatggactggacctggaggactcctcttcttggtcggacagcagctaacaagtcgcccactcccgaggcncagctggtgccagtcgtgggctggaggtgaagagccgtggggacctgaggtgaggtcctcgtagccaaggtcttcgtggtacttctaaccgtttcctctataagtctacgaacgtgggtcaccgcacggcctgacgaacacgacngaggtcggagtcgggagtacgggaccaaacccttagacggttcgtagttaccaacgtgttaccgtcttacccaaacctcggtacccgtacggganaaccgttacgttaccaagtcccggaaccaccgtacctacctacaacaacactacactaactgtacggacgttaggacgtagccggttanagtacncgtaacgaccggaccgtacggtcttacgtaatttcgcgttcgacggtacgaccggtaccgtaccggacgttccggacgtacccggccgttaaccgggcgacggtccgtaaccgtttcgcccggtagggttacccggg

SEQ ID NO: 207615 - DNA, 764 bp, Homo sapiens
  misc_feature: GYAE6OF01AOS06.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtcgcccactcccgaggtgcagcgtggtgcgagtcgtggggctaggaggtagaagacggccggtcggggcctgaggtagaacggtcctcgtcgacgtacggtcttcgtaggtacttccgtaccgtttacctaccgtatacgtactacgtaacggtggtcgccgcgtacggccgcgtacggaaccaaccggtcgtaggacggtggacggtagggacgtaccgggaacccgtaaaccgtacgtacggtggtacgtaccgtacgtacgtccgttaccctcccaacccgtaccggtacccggtaccggaacctaacggttaacccttaaccgacgtaaccgaaccctaaccgtaccccttacctaaacctaaacgtaacccaccgtaaccgtaccttaacgtagggttcgggaacggttacggaaccggtccggtcgaactaactcggtaacgacggaacccgaccggtcccggtactttacgtactcggtcaacgggacgaccgttaccggtaccctaacgggccggttacccggaaggcccttaccccgggtacgaccggtaccgggttccctttaggtaccgggttccggtacggggtccccgggg

SEQ ID NO: 207616 - DNA, 710 bp, Homo sapiens
  misc_feature: GYAE6OF01EZ097.17.25.C03.1.454.CMB.1.raw
  modified_base (185)..(185): a, c, t, g, unknown or other
  misc_feature (185)..(185): n is a, c, g, or t
  modified_base (234)..(234): a, c, t, g, unknown or other
  misc_feature (234)..(234): n is a, c, g, or t
  modified_base (300)..(300): a, c, t, g, unknown or other
  misc_feature (300)..(300): n is a, c, g, or t
tcagcgtagactagcacgaccggtgctcgatttagtagtgtagatttgggtttggggactcgaacaaccacatctgtcctctagagaaaaccctgtgagcacagctcctcaccatgggactggacctggaggagtcctcttcttggtggcagcagctacagtgcccactccaggtgcagctggtnctaggtccggggctggaggtgaacgagccgtgggcctcagtgaacgtcncgtgcaggcttctggacttctacgttacctcctatagtatcaacgtggtcgcgaccgaggcccgtntcggacctaacggtacctaggagtggacgtgggaactcgggactaacccgtagacgttggacttacgactagttcgtacttacgaccctacgtccgacggactacggactttaccagttacgacccgtacgtaacctacccgtaacaacttaaaccgacgtaacgtacccctaagtacggtaaggtacgttacggacggtaccggtccgttacggaaccctagtcccgtagggaacccgaaccgtaccggtaccgttaacttacgtttaccgttaggtacggaccgaagttacccggttacccgaaaccggggtacgttccccgggtaagtaccgggtaccccggttaccggaccggtaacgtcccgggtttacgtttaaccggcggttacccgggtgggggtaacccgg

SEQ ID NO: 207617 - DNA, 733 bp, Homo sapiens
  misc_feature: GYAE6OF01D2XZ2.17.25.C03.1.454.CMB.1.raw
  modified_base (627)..(627): a, c, t, g, unknown or other
  misc_feature (627)..(627): n is a, c, g, or t
tcagcgtagactagcacgaccggtgctcgatttagtagtgtagatttgggtttggggactcgaacaaccacatctgtcctctagagaaaaccctgtgagcacagctcctcaccatggactggacctggagatcctcttctggtggcagcagctacaagtcgcctacctcccgaggtgtcagcgtggtgctacgtcgtgggctggaggtagaagaacgtccgtcggggcctacgaggtagacggtcctcgtgacgaacgtcttcgtggtactttaccgtaaccgtttaccctccttaatacgtactaccgaacgttcgggtcgccgaccgacggtcccgacggtacggaaccgtaaccggtccgtaggacggtagggaggtgggtagtacgggacccgtaaacccgtacgtacgttggtacgtaccgtagtacgttctcccttaccaccctccgtcccgtaccggacctacgtaaccttaccgataaccggaccaacccgtaaccttcccaaacgtaaactaaaccgacctaccgaaccttaacgaggttacggtacgttgggaacgtcctacgtactacaacgttccgacgaaccgacccgtaacgtccgtttaacacggtttacgnggaccgagtaaccggtccctaaccggacggttacgttccgggacgtaccccggtccggagaccggcggtttccccgttacgtttcgtaccggttgggacccggggg

SEQ ID NO: 207618 - DNA, 633 bp, Homo sapiens
  misc_feature: GYAE6OF01EP0XE.17.25.C03.1.454.CMB.1.raw
  modified_base (449)..(449): a, c, t, g, unknown or other
  misc_feature (449)..(449): n is a, c, g, or t
  modified_base (489)..(489): a, c, t, g, unknown or other
  misc_feature (489)..(489): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagcctggggcctcagtgaaggtctcctgcaaggcttctggattctacgtttacctctatagtatacaagtgggtgcgcgaggccgctggacaacgctggagtggagtgggtatgggaccgaaaccctaacgacgtggtgtaccacgaggtcgtccttaccaccctacgtcccgtccggggtaacaccgtaaccttaccgaagtaccgaccctaacgtaacccttccctaccaactaaaccnctaacgacctacagtgggtagttgaacggatccgtagacntcgtgaaccgacgaccgggtccttacttacgttacgtcggtacgcggaagtccgtaccccgtaaggtaccggttccgggacggaccggtcccgtaacggcgtacgggtcccggttaccgttttcggaccgttcggtaccggggg

SEQ ID NO: 207619 - DNA, 979 bp, Homo sapiens
  misc_feature: GYAE6OF01CXFLZ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggactccttcttcgttgggtggcagcagactaacgaagtcgaccccacctcccgaggtgcgacggtcgttgggtgcgacggttccggtgggggcttaggagggttaggaaacggaacgggccccgggttacggggggtccccttaggtaagggttacgggtaacgggtttcccgtcccgttaggaaccggaaacgggttcctttacggtacgggttaactttacccgtttacccgtttaacccttaccgttaaagtttacgttaaccgttaaccgtaacgggttcggggtcgaccccggtaccggaccgggtcccggtaccggaaccggaaacccgaaccggtaccggtagggtacggggtacgggtagggtacgggggtacggttaacggggaaccccgttaaacccgtaacggttaccggtcggttaccggtacgtaaacggtacgtttaccggttacccttaccccgaaaccgttacccgtaccccggttacccgggtaaccgttaaaccgttaacccgttaaccccgaacgttaacccgaacccgtaccccgttaaacccttaccccttaaaccgaaaacttaaacccgaccgtacgtaaaccttacggacgggttaaggtacggtttagggacgtaaccgtaccggtacgtacgtaacgttcggaactaacccgggaccgtcgggttaaccgtttacgttaaccgtttacggcggtaaccgggtcgaaccgggtacccttaaccggccggttaacgggcccggttaaccggtccggaccccggttacgaccgggtaaccgggtccccgtttacgtaacgggttccccggtccggggtaacccgggg

SEQ ID NO: 207620 - DNA, 822 bp, Homo sapiens
  misc_feature: GYAE6OF01C18D5.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggactccttcttcgttgggtggcagcagctacaagtcgcccacctcccgaggtcgcagtctgggtgcgtacggtcggtgggcgtggaggtagaacgacgccggtcggggcctcgtaggtacggtaacgttcctaccgtggaccgtaacggttccgttcgttacggtacttttacccgttaacccgttttaacccttaccttaagttaacgttaaccgttaccgtaaacggtttgggggtccgcccggtacccggtacggggccctttacgggaacggaaaacccggtaaccggtaccggttagggaggtagggtacggtggggtaacggtacccgggtaaacccgtaaacccgtaaccggtacggtacggtacgtactaccggtagtttaccgtccttaacccacccgttaccgtccccgggtaccggactaaccgttaacccttaccgaacgtaccgaaccctaccggtaaaccctcccgtaaactaaaccgaaccaccgtaactacctaaagcgttagggtagtaccgggagtaccgtcgtacgactacgttcgaaccgtaccgtacccggtccgtaccgttactttacgtaacgtggacgtacgaacggtcctaccgaaggtcccgtaggttacccggacgtccggtacgcggtaccgttcgttaccgttacggtcggtacgggtccgggg

SEQ ID NO: 207621 - DNA, 938 bp, Homo sapiens
  misc_feature: GYAE6OF01DTFSF.17.25.C03.1.454.CMB.1.raw
  modified_base (159)..(159): a, c, t, g, unknown or other
  misc_feature (159)..(159): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcgttgggtggcagcagctanaagtcgcccactccgaggtgcagcgtggtgcgtagtcgtggggctggaggtagaaggacgccggtcgggtacctcgagtcggaacggttcctcgacgtacgtaaggtccgttcgtaggttactttaccgttacccgtttacccttaccttaagttaacgttacgttaccgtacgggtcgggtaccggcccggaccggtaccggggtcccgtaccggtaaccgggaaacccgtaacccggtaccgttaggggtacgggttagggtaacgggtacggggtaacgggtaaccgggtaaaccccgttaaaccccgttaacgggtaccggttacgggtaaccgttaccgtacggttacggttacccgttacccgttaccccgtaacccgtaccggttaaccccggtaaccgggtaaccgtaaaccgttaacccgttaaaccgtaccggttaacccgtaaccccgtaacccgtaacccttaacccgtaaacctaaacctaaacccgtaaccgtaacccgtaaccgtaacgtacggtaacgggttaacggttacggtaacggtaccggtaccgtacgtacgtaccgttaccggtaccggtaaccggtaccggtacccggttaccgttaccgtttaacgttcggttacggtacggtaccggtaaccgtacccggtaccgtaaccggttccgggtacccgggtacggtcccggtaacccgggtaccggtccggtacccgggttacccgttaccggtttaccgggtacgggttcccggggtaaccgggg

SEQ ID NO: 207622 - DNA, 991 bp, Homo sapiens
  misc_feature: GYAE6OF01ANITY.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttggtggcagcagactacaagtcgccccactcccgaggtcgcagcgtcgggtgccgtagtccgtgggggacctaggaggtaggaaagacggccggtgggggtccctagaaggtggaacgggttcctcccgtaggaccggtaacggtcgtttacgtaggtaacttacccgtaaccggttttaccctacgtaatacgttaactaccgtaacggtggggttcgacccgacccggtaagggtcccgtaccgttacgggaacctaaaaccggtacccgttaggtaacgggtagggtaacggttaggggaaccggttacggggaacccctaaaaccccgtaacggttcgtcggggtttactacccgtaacgtacggtttaccgttacccgttaccccaaccccgttaacgttacccccggtaaccgggggtaactaacccggttaaaccctttaccgaacggttcccgtaaacccgtaacccgtaacccgtttacccctaaccgtaaaacctaaacctaacccggtacggtaaaccccttaacggtaaacggtacggggttaacggtttaacgggaccggtacgtacccgtaacgaccgtaacggtttaacccgaaggttaaccccggaaccgggttaacccgggtccccggttttaacttaacccgggtttacgacggggttaccggaaaccgggttacggtaaaccccccggttaccccggtaaaacggggtttaccggttcccccggggaaaagttacccccgggaaccccgggttcccgggaaccggttaccgggtacccccggggttttccttttaacgggtaccccgtttacgggggggtacccccggggg

SEQ ID NO: 207623 - DNA, 831 bp, Homo sapiens
  misc_feature: GYAE6OF01CI8WI.17.25.C03.1.454.CMB.1.raw
  modified_base (315)..(315): a, c, t, g, unknown or other
  misc_feature (315)..(315): n is a, c, g, or t
  modified_base (733)..(733): a, c, t, g, unknown or other
  misc_feature (733)..(733): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagcgtggtgcgagtcgtggggctggaggtagaagacgccgtggggcctcgaggtggaacggtctccgtgactaaggtcttcgtggtacttcgtaaccgttttacctccttaattagtaactccgtaacgttggggtcnccggaccgacgggcccgtacggtacggaaccctaaccggtaccgtaggacggttacgggaacggttggggaacgttaccgggggaacccgtaaaaccccgttaaacggtaaccggtttgggttaccgttaaccgaacggttaaggtttcggttaccctttaacccgaaaccccgttaccggttaccccggtaacccggggtaaacctaacggttaacccgtttaacccgaacgttaacccgaacccgttaaacccgtaaaccccttacccgttaacctaaaacgttaaaacccaacgtaaccggtaccttaaacggtacgttagggtaacggtttacggaacggtaccgtacccaagtaactaaccgtcgtaacggaccgaccggtaccggtccgttacttacgttacgcggtaacgngttaaccggtaccgacccgtaggtccgtacgggtacgtcggacccggttagaccgtacggtaccggttacctttcgggtaccgttcgggtaccggggg

SEQ ID NO: 207624 - DNA, 898 bp, Homo sapiens
  misc_feature: GYAE6OF01BAGIQ.17.25.C03.1.454.CMB.1.raw
tcagcgtagactagcacgaccggtgctcgatttagtagtgtagatttgggtttggggacgtcaacaaccacatctgtcctctagagaaaaccctgtgagcacagctcctcaccatggactggacctggaggactccttcttcgttggtggcagcagctacgaagtcgcccactcccgaggtcgcagcgtggtcgcacggtcggtcggggcgttaggaagggtaggaaaagggaaacggtcccggttcggggggcccttacggtaacgggtagggtaaagggttcccgtccgttggacggtaacggggttcctttacggttgggtaaccttttacccgttaaccggtttttaccccttacgtttaaacttaaggtttaacgtaccgtaaaccgggttggggttaccggccggccccggtaaccgggaccccgggtcgtacgggaaaccgtaaccgaaccggttaggggtaggtacggggtaggtcgggggtaacggttaccgggggaacccgtaaaacccgtaaccggtacccggttggggtaacgttaccggtacgtaacggttcggttacccctaccgtacccgaacccgttcccggtaacccgggggacttaaccggtaaccgttaacccaggttacccgaacccgaaccgtaacctacccgttaacccgaacgtaaaccgaccgaaacccgtaccgtaacctaacggtaccgtaagggttacggaaccggtaacgtacccgtacggaacctacgtacgaacgaaccgtacccggtacgtaccgtacgttacgtaacgttccgtagccgtacgaccgtacgtaccgacggttaccggacgccggtcgaacccggtcggaccgtaccggttaccgttccgtggttccggaccggggg

SEQ ID NO: 207625 - DNA, 736 bp, Homo sapiens
  misc_feature: GYAE6OF01E3DWK.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagagccgtggggccctcgagtgacggtcctcctgacaggtcttacgtggtacttccgtaccgtttacctccttaatagttactacgaacggtgggtcgaccgccgacggcccgtcgtcggaaccaacgtacctggacggtggacggtgggacgtcggggaccctaaaccctaacgtacggttcggtacgtaccgacgtaggtcgttacccttacccgacccctacgtaccccggtccggggaacctaaccggtaacccttaaccgacgtaaccgtaaccccgtaaccgtaacccttcccgtaaccaaactaaaacccacccgtaaccgacccttaagacgtagggttacggttaggaacggtaccggtcctacgaacctacgttaccgacgaaccggaaccgtaccggtacctttaacttacgttaccgtgtacggacgtacgtaccgtacccgtacggtcgtaccggtacgcgtacccggttacggacgtcggtccgttaccgtttacggtccgttcgggtaccggggg

SEQ ID NO: 207626 - DNA, 724 bp, Homo sapiens
  misc_feature: GYAE6OF01ANLVU.17.25.C03.1.454.CMB.1.raw
  modified_base (176)..(176): a, c, t, g, unknown or other
  misc_feature (176)..(176): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtncgagtctggtgcaggtcgtggggctggaggtgaagagccgtggggcctgagtgaacggtcctcctgcgtaacggtctttcgtaggtacttccgtaaccgtttccctcctaagtagtactactaacgtggggtcgccgcgacggcccgtcgtcggaacaaccgcgtggagtaggtggtagggtacgtcgggacccgaaaccctacgtacggtcggtcgtacctagtacgttcgtcccttaccaccctacctcccggtacccggaactacggtacccttaaccgacgtaccgaaccctaacgtaacccttcccgtaaccaactaaaacccgacccgtaccgtaccctaaacctaggtacgggtaacggttacgggaacgtaccgtccgtaacgtactacgttccgaacggaccgtaccggaccggttaccgttccgttagttacccgtcggacgtccggacgtacccgtaccggaacgtccggttaccggaggccgtacccgcgggtaccaccggttccggtttcgtaccgtacggttcgggtacccggg

SEQ ID NO: 207627 - DNA, 744 bp, Homo sapiens
  misc_feature: GYAE6OF01D5HQ6.17.25.C03.1.454.CMB.1.raw
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
tcagcgtagactagcacgaccggtgctcgatttagtagtgtagatttgggtttgggggactcaacaaccacatctgtccctctagagaaaaccctgtgagcacagctcctcaccatggacctggacctggaggatcctcttcttggtggcagcagctacaagtgcccactcccaggtgcagctggtgcagtctggggctggaggtgaagagccgtggggcctcgagtgaaggtcctcctgcaaggcttgtggattcacgtttacctctaatagtactcaacgtgggtacncgtcaggccnctggaacaacggtcctggacgtggagtgggatcgggacctaaaccctaacgcgttggtcgtacaacgtagttcgtacttaccgacccgtaacgtcccgtaccgggactacgtaaccgttacccaagttaccggaacccctaacggaaacccttccctaacccgaaattaaaacccacgtaacgtaccctaagtaacgtcggggtaaagtttccggaaggtacccgtaccgtaggtaacctacggtttacccaagggaacccgaacgtaacccggggttacccgtaacctttaacgttaacgtcggtaacggaccgggtaaacttcccgggtaaccctaacggtacccggttcggggtaacgtaacccggaccccggttaaacgggccgttaaaccgggtcccggttacgttttaaccggacccggtttcgggtaacccgggggg

SEQ ID NO: 207628 - DNA, 970 bp, Homo sapiens
  misc_feature: GYAE6OF01A6I8Y.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggactcctcttcgttggtggcagcagctacaagtcgcccactcccgaggtcgcgagtcgtgggtcgcgtaggttcggtggggtctagggaagggtaggaaagacggccggtcggggaccctcggaggtaggtaacggttcctccgtaggaccgtaacggtcttcgtaggtacttaccgttaccgtttaccctccttaagttacgtacttaccgtaacgttcgggcgtacccgaccgacgggtcccgtacgtaccgggaaaccctaaccggtaaccggttcggagggttacggtaacgggttaggggaccggttaaccggggaaccccgtaaaaccccgtaaccggtacggttacggggttaccgtaccggtaaccgttacgggttcccgtttaacctacccccggtaaaccctaccggtttacccccggaaccgggggtaaacctaaaccggtttaacccgttaaacccgtaacgtaacccggggaacccctaaaccgtaccccctttaacccggtaaccctaaaaccgtaaacccggaacctaaccccgtaccttaaaggttacgggttaacgggtaggtttacggaaacgggtaccgttaccggaacgttaacgtaaccgttccggaaaccggcccgggttaaccccggaacccggtttcccgtttaagttaacccgtttaggtaccgggttaccgggaaccgtaaccgggttcccccaaacccggtaacgggttccgtaccccgggtaacgggtaccccgtacccggtacggtcccggtaccgggtttccccggtttaagggtttacccgtcccgggttttcgggggtaacccccgggg

SEQ ID NO: 207629 - DNA, 587 bp, Homo sapiens
  misc_feature: GYAE6OF01BF8H8.17.25.C03.1.454.CMB.1.raw
  modified_base (281)..(281): a, c, t, g, unknown or other
  misc_feature (281)..(281): n is a, c, g, or t
  modified_base (435)..(435): a, c, t, g, unknown or other
  misc_feature (435)..(435): n is a, c, g, or t
  modified_base (445)..(445): a, c, t, g, unknown or other
  misc_feature (445)..(445): n is a, c, g, or t
  modified_base (464)..(464): a, c, t, g, unknown or other
  misc_feature (464)..(464): n is a, c, g, or t
  modified_base (509)..(509): a, c, t, g, unknown or other
  misc_feature (509)..(509): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaacgtgggtncgccaggccgctggacacgacctggagtggagtgggagtgggaccgtaaccctaacgactgggtcgtaccacgtagtcgtccttaccacccctattcccgtccggggacacgtaccttaccgattacgaccacgaacctcctaccaataaaccncagcctaagngtacgggagttgacggacnccgtagactatcgagaccgacgaccggtccgttacttacttacgngtcgcgagtaccgtacccgacgtacgtccggtgaccgacccgtacggctacggtccggtctttggccttcgggcgggg

SEQ ID NO: 207630 - DNA, 739 bp, Homo sapiens
  misc_feature: GYAE6OF01BD3YJ.17.25.C03.1.454.CMB.1.raw
  modified_base (131)..(131): a, c, t, g, unknown or other
  misc_feature (131)..(131): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggntcctcttcttggtggcagcagctacaagtcgcccactcccaggtgcagctggtgcagtcgtggggctggaggtgaagagccgtggggcctcagtgaggtcctctgacaggcttcgtggacttcgaccgttttacctccgttataagttatacgtaacgtgggtagccgccgtagggcccgacgtaggaccaaccggtccgtaggtacggtggagtggggagtcgggaccggtaaaccctaacgccgtggtacgtactacgtaggttacgttccttccaccccgtagtcccgtaccggggtaacctaacgtaccgtaaccacgtacgaaccccgtacgtaaccttaccctacctaactaaaccgaaccaacgtacctaacgtgtacgggtacggttacggacgggtaacgtccgtacgaactacgtttcgaacggaccgaaccggtacccgggtacccgttacttaacggttaaccgttcggacggtaccgggtaaacgtcgtaaccccggtaccggtaacggttcccgggtacggtaccgggcccctaacgggacctaccgggtaccccgggttagtttccggttacccggtttcgggggtaccgggg

SEQ ID NO: 207631 - DNA, 787 bp, Homo sapiens
  misc_feature: GYAE6OF01DGBEZ.17.25.C03.1.454.CMB.1.raw
  modified_base (563)..(563): a, c, t, g, unknown or other
  misc_feature (563)..(563): n is a, c, g, or t
tcagcgtagactagcacgaccggtgctcgatttagtagtgtagatttgggtttggggactcaaacaaccacatctgtcctctagagaaaaccctgtgagcacagctcctcaccatggactggacctggaggattccttcttcgttgggtggcagcagtctaacgaagtcgaccccaccgtcccgaggtgccagtcgttgggtcgcgtaggtcggtggggctggaggtagaacggacggccggtcggggcctacgaggtacggtacggttcctaccgtcgacgtaacgggttcttacggtgtacgtttaccgtacccgttttaccttaccttagttaacgttactacgtaacggttgggtccaccgccggacggtccggacgtacggaacgaaccgtccgtaggtacggtgggtagtggggtacgtacgggaaccctaacccgttaacgtaggttcggtactacgtacgttaggttccgtccttacccgacctaacggtccccggtaccggactacgtaccttaacgacgtacgaaccctaacgtaaccctccctaaccgtaanaaaccctcgtaaccgtacctaacgtagggttaggtacggttaggacgtacgggtcctaacgagttaccgtcgaacgaccggtaccgtacggtcccgtttatactttacggacgtacggaacgtaccgtccggtaaccctacggttacggtcccgggaacgttcggaccccggtaggacccgttcggttcccggttacggtttcgtacccggttcggaccggggg

SEQ ID NO: 207632 - DNA, 796 bp, Homo sapiens
  misc_feature: GYAE6OF01B6TVT.17.25.C03.1.454.CMB.1.raw
tcagcgtagactagcacgaccggtgctcgatttagtagtgtagatttgggtttggggactcgaacaaccacatctgtcctctagagaaaaccctgtgagcacagctccccaccatggactggacctggagatcctcttcttggtgcagcagctacagtgcccactcccaggtgcagctggtgcagtcgtggggctggagggtgaaagacgtccgtggggcctacgaggttggaacggttcctccgaggacgaaggtcgttcgtaggtacttaccgtaaccgttttaccctccttagttaacgtactacctaacggtggggtacgtccgaccgacgggcccgtccgtacggaaccaaaccggtaccgttagggtaacggtcgggaacgttacgggggaacgtccggggaaccccgtaaaaccccgtaaccggtacgttacggggttactacccggagtacgggttcgttaccttacccgaaccccgtacgttaccccggtaccgggaacctaacgttaaccctttaaccgacgttaccgaacccgaacgtaaccctccctaaccgaacctaaaccaccgtacgtacctacgtagtacggtacgtggacgtacgcgtacgactcgacacggtaacgaccggcggtaccgttacctagttaccgagtacggcgtaaccgtcgtaccccggtaagggcccgttccgggacggtaacccggtacccgtaccgggtaccgttaccggggtacccggtttaccgttacgggtacccgttacggggtcccggggtaaacccggg

SEQ ID NO: 207633 - DNA, 611 bp, Homo sapiens
  misc_feature: GYAE6OF01A0EZB.17.25.C03.1.454.CMB.1.raw
  modified_base (293)..(293): a, c, t, g, unknown or other
  misc_feature (293)..(293): n is a, c, g, or t
  modified_base (455)..(455): a, c, t, g, unknown or other
  misc_feature (455)..(455): n is a, c, g, or t
  modified_base (475)..(475): a, c, t, g, unknown or other
  misc_feature (475)..(475): n is a, c, g, or t
  modified_base (488)..(488): a, c, t, g, unknown or other
  misc_feature (488)..(488): n is a, c, g, or t
  modified_base (537)..(537): a, c, t, g, unknown or other
  misc_feature (537)..(537): n is a, c, g, or t
  modified_base (557)..(557): a, c, t, g, unknown or other
  misc_feature (557)..(557): n is a, c, g, or t
tcagcgtagactagcacgaccggtgctcgatttagtagtgtagatttgggtttggggactcaacaaccacatctgtcctctagagaaaaccctgtgagcacagctcctcaccatggacctggacctggaggatcctcttcttggtggcagcagctacaagtcgcccactcccaggtgcagcgtggtgctagtcgtgggctgaggtagaagagcgtcgggctcgagtgaggtctcgtgacgagcttgtggtacttcgtaccgttcctaccgttatagtactcgaacgtgggtcnccgccgaggcccgcgtacggacctacgaccgtgaggtcggagtcgggtacgtcggggacctaacccgtagtacggtggtcacgagtagtccgtctaccaccctcgtccgtccggactacgtactaccgtagacgacccacgaccttccaacgtaactaaccncaccgtacaagtagtacggnggtacgcggtacncgtacgactctacgtccggacaccgaacggtccgttactagtcgtggtnacggtacgtcccggaaccgngtacgtccgggatccgcgaacgtcgcggttacccgttgtactcgtgggtaccgg

SEQ ID NO: 207634 - DNA, 783 bp, Homo sapiens
  misc_feature: GYAE6OF01CASW0.17.25.C03.1.454.CMB.1.raw
  modified_base (144)..(144): a, c, t, g, unknown or other
  misc_feature (144)..(144): n is a, c, g, or t
  modified_base (186)..(186): a, c, t, g, unknown or other
  misc_feature (186)..(186): n is a, c, g, or t
  modified_base (204)..(204): a, c, t, g, unknown or other
  misc_feature (204)..(204): n is a, c, g, or t
  modified_base (385)..(385): a, c, t, g, unknown or other
  misc_feature (385)..(385): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggnggcagcagctacaagtcgccccactcccaggtgcagctgggngtacgtcgtcgggtgggngtagggtaggaggaacgaccgtcgggtcgggtacctaggaaggtacggtacggtcctccgagaacgacggttccttaggtggtaccttaccgttaacccgttacctactaagttagtactaccgtaggtgggtcgccgacggacgccgtagagaacccgacgtcgtagaggtgaggtaggngaccggaacctaacctacgtacggtggtccaacgagttcggtacttccctaccgaacctccggttcccggaaccggactaaccgttaacctaaacgtacggaaccccgaacccgtaacccgtacccttacctaacctaaacctaaacccgaccggtaacctaacccgttaacggtacggtagggttaaggaacggaacggtcccgtacgtaacgacttaccgttacgaccgggtaaccgacccggtccgtaccgtttacttaacgttacgacggcggtaacgacccggtaccgtaacccgaacccgtcgggttacccggacgtaacccggccgtaccggtacggaccgggtttaccctttacccgggttttaccggcgggggtcccgggtaaccgggg

SEQ ID NO: 207635 - DNA, 821 bp, Homo sapiens
  misc_feature: GYAE6OF01EBC4D.17.25.C03.1.454.CMB.1.raw
  modified_base (281)..(281): a, c, t, g, unknown or other
  misc_feature (281)..(281): n is a, c, g, or t
  modified_base (737)..(737): a, c, t, g, unknown or other
  misc_feature (737)..(737): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtgcccactcccaggtgcagctggtgcagtctgggctgaggtgaagagcctggggcctcagtgaaggtctcctgcaaggtcttctggattcacgtttacctcctatagtatcaacgtgggtncgccgacggccgcgtaggaccgaacgacctggaggtggattgggaattcggggaccgaaaaccccttaacgacgttgggtacgtaccgaacgtacggttcggttccctttccgaaaccccccgtacttaccccgttaccccgggggaaacctacggtaaacccctttaacccgaaacgttccgaaacccccgtaaccggtaaaccctttaccccccttaaccccaaacttaaaaaacccgtaccccgaaaacccggttacccctaaaccgttaacggttcgggggttaaacggttttaacgggaaaccgggtacggtacccccggttaggtaaaccctacgttacccgtaagggtaaccccggtaacggaacccgggttaccccgtttacttaacgtttacctgggttaccggaccgtacggtaccgtacccccgaacggtaccgttacccggggnggtaaccggtcccccgtaacgggacccgtacgggtccccggttacccttttaccgggtaccgttcccggggttaccccgggggg

SEQ ID NO: 207636 - DNA, 805 bp, Homo sapiens
  misc_feature: GYAE6OF01DF1CZ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagcctggggcctcagtgaaggtctcctgcgaaggtcttcgtggattacgtaccgtttacctcctaatagtactcaacgttgggtcgccggccacgggccgcggtacggaacaaccggtaccgtggaaggtgggaacgtgggggacgttacgggggaccgtaaacccccgaaacgtacggttgggttacgtaccgtaacgttaacgggttcgttacccgttacccgaaccccgtacgttaccccggttacccgggggaacctaacgtaacccctttaaccgacgttacggaacccctaacccgtaacccttaccctaaccctaactaaaaacccacccgaacgtaacccttaacgtagtacgggtacgtttacgggaacggtaccgtccgtacggaactacgttacgtacgtaaccgaacccggtaccggggtacccgttagtttaaccgtttacgttcgggtacggtaccggtaacggtaccggtaccccaacgggtaaaccgttcccggggtacggtacccgtacccgggtaaccggtccggtaaccggtcccgggtttacccgttttacgggtcccgtttcggggtaccccgggggg

SEQ ID NO: 207637 - DNA, 964 bp, Homo sapiens
  misc_feature: GYAE6OF01EE7N2.17.25.C03.1.454.CMB.1.raw
  modified_base (283)..(283): a, c, t, g, unknown or other
  misc_feature (283)..(283): n is a, c, g, or t
  modified_base (316)..(316): a, c, t, g, unknown or other
  misc_feature (316)..(316): n is a, c, g, or t
tcagcgtagactagcacgaccggtgctcgatttagtagtgtagatttgggtttgggagtcagtctcagtcaggacacagcatggacatgagggtccccgctcagctccgtgggctcctgctactctggcctccgagctgccagatgtgacactccagactcgaccctagtcctcctactccctccctgtcctcgccttcgtgggtcggggtacaggtactccaccatccacgtccgaccgactacgtccgaacggttacttaaaaccttatttaacgttgtancgaagacgtaacgtaaaaccgtaggaaaaaccnccccgtaacgtaccctttcctaggtacttccggtttaccggtaggtacctacctaaaccgtccccgttaacttcggtacggtaacccgggttaaagggttcccggtacccgttaaccccgaaggtttcccggtaaaggtttccgaagggttcggggacttaacgggtacgggttacttaacggggtacgggtaaccttaaacgtttacgtttaaaccctaaccgttacccttaaccgtaaacccttacctttaccccgaaaaccccttaccggttacccgtaaccggttaacccctaacgggttacggtaaacgggttacgtttaccgggtaacctaacgttaaaccctttacgttaacccccctttagggtaaacccttaccaaaacccgggttaacggtttaaccccgttaccccgggttaacccgttttccccccgttaaacccgggttttcccgttaacccgggttttaaccccgggggaaccgttaaacccgggggtaaacctttaaaaaccgggtaagttaaacccggaaacggtttaaacccgggttaaaacctaaccccggggtttaggtaacccggttaaccgttaacccgggtccccctaaaaagtttcccggttttaccccgtttcccgttaaaccc

SEQ ID NO: 207638 - DNA, 804 bp, Homo sapiens
  misc_feature: GYAE6OF01EL8BZ.17.25.C03.1.454.CMB.1.raw
  modified_base (182)..(182): a, c, t, g, unknown or other
  misc_feature (182)..(182): n is a, c, g, or t
  modified_base (274)..(274): a, c, t, g, unknown or other
  misc_feature (274)..(274): n is a, c, g, or t
tcagcgtagactagcacgaccggtgctcgatttagtagtgtagatttgggtttggggactcaacaaccacatctgtcctctagacgaaaaccctgtgagcacagctcctcaccatggactggacctggaggatcctcttcgttggtgcagcagctaacaaggtcgccctactcccgaggtcncaggcctgggtgactaggttcgtggggtctaggtagggtagaaagaacggccggttacggggccctacgaggttaggaacggttccttccgnggtacgaacggtcctttcgtagggttacctttaccgttaaccgtttaccttacgttaagttacgtactacgtacggtaggtccgaccggccgacggcccgtacgtacggaaccgaacggccgtaggtacggtaggtacgggtacggtacggtacgggtaacccgtaaacccgtaacgtacggtacggttacgtaccgtacgtacgttccttacccgtaccctaacccgtaccggtcccggtaaccggtacctaaccgttacccttaccgaccgttaaccgaaccctaaccgtaacccttccctaacctaaacgtaaacctacgaactaccgtaagtcggtaggtacgtacgtaacgtacgacttagacgttacgtaccgacgaccgaccggtaccggttacgttacttcgtacggtcgtaccggtcgaaccggttaccgtacggtacggtaccggttacgacggtaaccgtacccgacgggtaccggtaccgggttccgttaccggttcggttaccggtccggggtaccg

SEQ ID NO: 207639 - DNA, 682 bp, Homo sapiens
  misc_feature: GYAE6OF01C2DF9.17.25.C03.1.454.CMB.1.raw
  modified_base (137)..(137): a, c, t, g, unknown or other
  misc_feature (137)..(137): n is a, c, g, or t
  modified_base (178)..(178): a, c, t, g, unknown or other
  misc_feature (178)..(178): n is a, c, g, or t
  modified_base (248)..(248): a, c, t, g, unknown or other
  misc_feature (248)..(248): n is a, c, g, or t
  modified_base (314)..(314): a, c, t, g, unknown or other
  misc_feature (314)..(314): n is a, c, g, or t
  modified_base (326)..(326): a, c, t, g, unknown or other
  misc_feature (326)..(326): n is a, c, g, or t
  modified_base (348)..(348): a, c, t, g, unknown or other
  misc_feature (348)..(348): n is a, c, g, or t
tcagcgtagactagcacgaccggtgctcgatttagtagtgtagatttgggtttggggactcaacaaccacatctgtcctctagagaaaaccctgtgagcacagctccctcaccgtggactggacctggaggatcctnttcttggtggcagcagctaacaagtcgcccactcccaggtncagctggtgcaggtcgtgggctaggaggtagaaggagccgtggggcctcgaggtaggaaggtcctaccgngactaaggtcttcgtggtattaccgtaccgtttacctccttatagttactacgaacgtggggtacnccgccgaggccncgtacgaccaccgtactggagngggatgggtaagccgggaacctaacctaagtacggtggtactccaagtacggttctccttaccgaaccctactccggtacggactaacgtaccgttacatacgacccgaactaccctacaccgaataacgaccacgtaccagtaaggtaggagttacggaaggacctccgtaagacttacgacgtacgaacccggtaacgtcccggaccctttagtaacctgttaggccgtaacgtacgacccgtcctaacggtaccgtacggtacggaaccctccggtaaaccgggaacccgttccggtactttacggcccgttgggggtaaccccgggtcgg

SEQ ID NO: 207640 - DNA, 879 bp, Homo sapiens
  misc_feature: GYAE6OF01BW8RO.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtcgcccactcccaggtgcagctggtgcagtcgtggggctggaggtgaagagcgtggggcctacgagtggacgtcctcgtgacgaggtcttcgtggtacttcgtacgtttacctccgtaagttacgttaactactaacgttgggggtcgcccggccgtaacggggcccgtacggtacgggaacccgtaaaccggtaccgttaggggaaggttagggaacggttcgggggtaacgtcgggggaaccctaaacccgtaaccgtaccggttcggggtaactaccgaaacgttaggttccgttacccgttacccaacccccgtacgtttcccccgggtacccggggtaaactaaccggtttaaacccttaacccgtaaggttaccccgtaacccgaaaccgttaccccttacccaaccgtaaaccttaaaaccgctaaccggtacccctaagtaccggtttaggggtacgttagggaacgggtacgttacccgtacggaaccttacgtaccggtaccggaacccggttaccccgggttaaccgggttccccttagttttaacccgttagggtccgttaccgggacgtaccgtaacccggtacccccggaacggttacgggttaccccggggtagaacccccgggttacccgaccggggaccttacccggggtacccgttttacccgtttcgggttaaccccgggttccggggtaaaccgggggg

SEQ ID NO: 207641 - DNA, 783 bp, Homo sapiens
  misc_feature: GYAE6OF01EBMZ4.17.25.C03.1.454.CMB.1.raw
  modified_base (409)..(409): a, c, t, g, unknown or other
  misc_feature (409)..(409): n is a, c, g, or t
  modified_base (451)..(451): a, c, t, g, unknown or other
  misc_feature (451)..(451): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgacccactcccaggtgcagctggtgcagtcgtggggctaggaggtagaagaacggccgtggggcctcgaggtagacggtctaccgtgacgaggtcttcgtggacttcctacgtttacctcctatagtatctaacgtgggtcgccgccgacggccgtcgtacggaccaaccggaccgtggaggtaggagtagggtacgtacggggacctaaaccccgtaaacgtcgtaggttcgtacgacttacggttnttacccgttccaaccctacgttaccccggtacccgggaaacnccgtttaacctaacccgtagtaccgtaacccgaaccgtaacctacccctaacgaaactaaaccgaaccgtaacgacccttaacgtaacggttacgggtagtttacggaacggtacgtaccgttagaacgtattaccggacgaacccgaaccggtacccgggttacccgtttacgttaacccgttaggtccggtacgacgggtaaacgacccggttaacccgtaacggtacccggttaccggggacggtccccggtacccgtaaaccggtccggaaccgggttaccccgggtttaccttttcggggtaacccgttccggggtaaccccggggg

SEQ ID NO: 207642 - DNA, 876 bp, Homo sapiens
  misc_feature: GYAE6OF01DSKQ4.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtgcagcagctacaagtcgcccactcccaggtgcagctggtgcaggtcgtgggctgaggtagaagacgccgtcggggcctcgagtagaacggtcctccgtagacgtaacggtcgttcgtacggtatttaccgtaaccgtttaaccttccgtaaagttaccgtaaacgtaccgtaaacggttcggggtccgaccgtaccgaacggtcccgacggttacggaaccgaaccggtaccgtaggtacggtaggtaggtacgggttacgacgggtaaccggtaaacccctaaacggtcgttgggtaccgtacctaaggtagttcggtacctttacccgaacccgttaacgtcccgtaaccgggtaacacgttaacccttaccgagtaacgtacccaaaccgggttaaccctacccgtaacctaaaggtaaaacctaacggtacgttaaaccctaaggttaaaccggttagggttaaacggttaacgggtaaacggggtaccctaaccgtttaacgaaaccccgtagttacccgtttaaggaaaccccgttaacggtaacccccggggttcttaacccgttttaagttaccgttacgggtaccggttaccgggaaacggttaccccggtacgaaacggttaaccggttcccgggtaaggtaccccggacccggtttaaacgggacccgtacggtaccccggtttagtttaacgggttaccgtttaccccgggaaccggggg

SEQ ID NO: 207643 - DNA, 861 bp, Homo sapiens
  misc_feature: GYAE6OF01EOSE2.17.25.C03.1.454.CMB.1.raw
  modified_base (165)..(165): a, c, t, g, unknown or other
  misc_feature (165)..(165): n is a, c, g, or t
  modified_base (351)..(351): a, c, t, g, unknown or other
  misc_feature (351)..(351): n is a, c, g, or t
tcagcgtagactagcacgaccggtgctcgatttagtagtgtagatttgggttgggactcaacaaccacatctgtcctctagagaaaaccctgtgagcacagctcctcaccagtcggactggacctggacgactcctcttcgttggtggcagcagactacaagtcncccactcccgaggtcgcagtctggtcgctagtccgtggggcctaggtaggtacgaacgacgtccggtgggccctagtaggttgtaacggttcctcgtacgacgtaggttccgttcgtacggtactttccggtaaccgttttaacccctccgtttaagtaacggttactacccggtacgtgggtacnccccggtaccgacggtcccgtacgtaccggaaaccctaaccggacctggtacgggtcgtacgggttccggacggtaccgggaacccctaaacccgtaagtccggttacggtacctacgtaccggtagggttccttaccctccggtaaaccctaccggtccccggtaccggggtaaatacccggttaccgtaacctaacgcccggtaaaacccgtaacccgtaacccttacccgtaaaccgtaaacttaacccgaaccaccggttaacctaaccgtacgtacgggtaacggttaccggtaaccgggacccttacgggcttaacccgtagtacccgtaacccggaacccgacccggttaacccggtcgttaaccgttacttaccgggtagtaccggaaccggtacggtaccccctacgaccggttcggtaccccggttagacccgtaacccgggtcgacccggtaacggttccgtttaaacccggttccgttccgggtacgggtacccgggg

SEQ ID NO: 207644 - DNA, 718 bp, Homo sapiens
  misc_feature: GYAE6OF01BD3R4.17.25.C03.1.454.CMB.1.raw
  modified_base (283)..(283): a, c, t, g, unknown or other
  misc_feature (283)..(283): n is a, c, g, or t
  modified_base (295)..(295): a, c, t, g, unknown or other
  misc_feature (295)..(295): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtctcctgcaggcttctggattcacgtttacctctatagtatcaacgtgggtncgccgaggccgngtcggacaacgacctggagtggagtgggatcgggacgaaccctaacgacgtggtcgtacacgtagttcgtccttcacccagttcccgtaccggggaacctaggtacctttaaccgagttacgaaccctaaccggtaacccttaccctacccgtaaactaaaacccaccctaacggtaaccccttaacgaacggttacgggtaacggtttacgggaacgggtacgtacccgtaggtaacctacgttcgtaacggaaccggtaaccgaccggggttacccgttaccgtttaacgttacgttaggtaccgacggtaacggtacccgtaccccgtaacggtaaccggttccgggtacgtaccggtacccgtcggaccggtcggtacccgggttacctttacggtccggtttccgggtacccgggggg

SEQ ID NO: 207645 - DNA, 729 bp, Homo sapiens
  misc_feature: GYAE6OF01DMCJB.17.25.C03.1.454.CMB.1.raw
tcagcgtagactagcacgaccggtgctcgatttagtagtgtagatttggggtttggggactcaaacaaaccacatctgtcctctagaagaaaaccctgtgagcacagctcctcaccatggactggacctggaggactcctcttcttggtggcagcagctaacaaggtcgcccacctcccgaggtgcagctggtgcgagtcgtgggggctggaggtagaaaggaacgccgtcggggcctcgaggtagaacggtctccgtgacgaaggcttcgtgacttctacgttactctatatactacaacgtggtcgacgcgtaacggccgtcgtacggaaccaacggctggaagtggaggtagggtagtacgggaaccgtaaaccctaacgtacggttcgtggtaccgtaagtacgttacgtccttacaaccccgtacgttccgaccgggtaacaccgtacgttaaccatacggaccaaaccgtaaccttcccgtaaccaaactaaaccaacgtacgtaaccctaacgttaggtacggtaacgggttaggaacgggtactaccgtacggtaactacgttacgaaacgtccggaaacgtaccgggttaccttacgttacttaacgtggtacggaccggtaacgtcccggtaacccgaggtccggttaccggtacggaaccggtccgaccggacggtccgtaacccgtccggtttacgtaccggttgggtaacccgggg

SEQ ID NO: 207646 - DNA, 757 bp, Homo sapiens
  misc_feature: GYAE6OF01ER2MG.17.25.C03.1.454.CMB.1.raw
  modified_base (697)..(697): a, c, t, g, unknown or other
  misc_feature (697)..(697): n is a, c, g, or t
tcagcgtagactagcacgaccggtgctcgatttagtagtgtagatttgggtttggggactcaacaaccacattctgtcctctagagaaaaccctgtgagcacagctcctcaccagtggactggacctggaggactcctcttcgttgggtggcagcgacgctacaagtcgcccactcccgaggtgcagcgtgggtgacagtcgttgggctgaggtgaaagaacggccgtaggggcctacgagttaggaaggtcctccgtaggaccgtaagggtccttacgttaggtactttccgttaaccgtttacctacttaagttagtactacgtaacgtggggtcgccgtaccggacggcccgtacgtacgggaaccaaccggcggttcgtaggggagtacggtagggtaggtaccggaccaaacccttaacgtacggttcggggtactacgaacgttacggtacttccctactaaacccgtcgtcccggtaaccgggaacacgttaaccttaacggaccttgggaaacccctaacgtacccgttacctaaccaacgtaaaccgcgaaaccgtcgtaacaggttcggtagtacgggacgacgttaccagtaccacgttacgacggaccgacggtaccgtacgtacgttaagttcccgtagggctgggaaccgttaccgacccggtaaacggtcttccgggggacncggtaccccgtcggcgaacccgggttccgttaacgttacgtccgggttacggtaccgggg

SEQ ID NO: 207647 - DNA, 810 bp, Homo sapiens
  misc_feature: GYAE6OF01A0254.17.25.C03.1.454.CMB.1.raw
  modified_base (181)..(181): a, c, t, g, unknown or other
  misc_feature (181)..(181): n is a, c, g, or t
  modified_base (238)..(238): a, c, t, g, unknown or other
  misc_feature (238)..(238): n is a, c, g, or t
  modified_base (250)..(250): a, c, t, g, unknown or other
  misc_feature (250)..(250): n is a, c, g, or t
  modified_base (693)..(693): a, c, t, g, unknown or other
  misc_feature (693)..(693): n is a, c, g, or t
tcagcgtagactagcacgaccggtgctcgatttagtagtgtagatttgggtttggggactcaacaaccgacatctgtcctctagagaaaaccctgtgagcacagctcctcgaccagtcggactggacctggaggatcctcttcttggtgcagcaggctacaagtcgcccactcccgaggtncagtccgtggtgactaggtcggtgggctaggaggtagaagtacgccgtgggcctcgngtgacgtctcgngacaggtcttagtcgtacttccgtaaccgtttcgacttaatagtacttaccgaaggttcgggtcgaccgaccgtaggggcccctagtaccggacctaaacggccgttaggagtagggagttcgggacggttaccggaacccgtaacccgttaacgaccgttgggtacgtaacctggttaaccgttgttacccttaaacgcccccgacggtttcccggtaacccgggaaacgtacccgtaaacgttaccaacggtttaaccgaacccggttaaccgtaacccgtaacccctaacgttaaaaacgtaacccgtaaccggtaaccgtacccgtaaatggtttaacgggttaccgttaagggaacccgtaacgtccgaacggtaccttacgtaacgtcccgaaacgtaccccgggtaacttccgtaacgtttaagtccggttaccgnggtaacccggtacctaaccggtaccccgtagggttacctaccgggtaccggaccctacgggttccaaccgggttcttacccgggttagttacccggacgggtttccgggacccgggg

SEQ ID NO: 207648 - DNA, 800 bp, Homo sapiens
  misc_feature: GYAE6OF01D02TA.17.25.C03.1.454.CMB.1.raw
tcagcgtagactagcacgaccggtgctcgatttagtagtgtagatttgggtttggggactcaacaaccacatctgtcctctagagaaaaccctgtgagcacagctccctcaccatggactggaccgtggaggatccttctttcgttggtggcagcagactacgaagtcgcccacctcccgaggtcgcgagtcgtggtgctaggtcgtggggctggaggtagaaaggacgccgtacgggcctgaggtgaaggtccttccgcgacgacggtcttgtggtactttcctaaccgttttacctactaagttacgtatacgtaacggtgggtacgccgaccgcggccgtcggtaacggaaccgtaaccggtaccgtggtacgggtaggtacggtgggaacggtacgggaaccctaaacccgtacgtacggttgccgtacgacgttcgtcttccttacccaccgtcgttcccgtaccggaacctacgtaaccttaccgaactacccgaacccgtaaccgtaccctaaccctaacctaaaaccgaacctaaccctaccgtaacccgtagtaaacggtacgggtaacggtacgaaggtccctaccgagtaacttacggacggtaccggaacccgttacggtaccccgtacgttttaacgtaacgttcggtaacgggccgtaaccgaaccggtaaccgtcccgttaaacgggtcccggtacgggttaccggccggttaaccccggtcgtacccgtacccggggtttacccggttacccgttttacgggttaccggcggggtaacccgggg

SEQ ID NO: 207649 - DNA, 922 bp, Homo sapiens
  misc_feature: GYAE6OF01CD083.17.25.C03.1.454.CMB.1.raw
  modified_base (680)..(680): a, c, t, g, unknown or other
  misc_feature (680)..(680): n is a, c, g, or t
tcagcgtagactagcacgaccggtgctcgatttagtagtgtagattttggttttggggactcaacaaccacatctgtcctctagaagaaaaccctgtgagcacagctcctcaccatggactggacctggaggactcctcttcttggtggcagcagctacaagtcgcccactcccgaggtgcagcgtggtgcaggtcgtggggctggaggtaggaagaggccggtggggcctcgaggtcggaacggtcctccgtgacgaacggtctttcgtaggtactttccgttaaccgttttacctaccttaagttaacgtaacgttaccgtaacggttcggggtccggtccggacccggtacgggccccggtccggttaacggaacccgaaaccggtacccggtaggtaacgggtacggggtaggtacgggggtaacgggtacccggggtaaaccccggtaaaaccccgttaaaccggtaccggttcgggttaccgtaaccgtacggtacggttcgttacccttaacccgtacccctaccggttccccggtaccggtaacaaccggttaacccttaaccgtacgttacgaacccgtaacccgttaaccctacccgtaaccgaaaactaaacccgtaacgtacgtaacctaacgaacggttacgggttagtaacgggacgggtaacccnccggttaagaccgtaacgttaaccgggtaacgacccgggtaaccgtcccgggttaacccgtttacttaaacgttccggtgggttaaccggcgggtaaccgaccccggttaaaccccgaccggttacggggttaccccgggtacggtaaccccgggtcccggttaccgggacccgggttaccccggggttaccgttttaccccgggttttaacggtccgggtttcccgggggtacccgggggg

SEQ ID NO: 207650 - DNA, 898 bp, Homo sapiens
  misc_feature: GYAE6OF01EZKRR.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggagatcctcttcttggtggcagcagactacaagtcgcccactccaggtgcagcgtggtgctagtcgtgggctggagtacgaagacgccgtcggggcctgagtgtaacggtctccgtgacgtagtcttgtggttacttccgtaaccgttttaccctcttaagttacgtactaccgtaaaggtgggtacccggtaccgagggtcccgtgtaacgggacctaaccggtccgtaggtagggtaggtggtacggggtacggtaccggggaacctaaacccgtaccgtacgggttacgggtcgtaactaacggtaggtttccgtttaacccgtaccaaccccgttaacggtacccggttaacccggggtaaaacctaccgggtttaaaccccttaacgtaaccgtaaccggaaaccccgttaaacccgtaaacccgttaccctaaaacccgtaaaaccgttaaaaccgtaaaccgtaacccggttaactaaacggttaacggtaaccgggtttaaagggtaccggtaaccgggtaacccgtaaccgtttagggtaaccctaggttaacccgttcgggaaaaccccgtaccgggtcccccgttaaccgttaaccgtttaacggttacccggttaaaggcccgggtaaacgggttaaccgtaccccgttacccgtaaccggttacggtaccggttacccggttaaccgggacccggtaccggtaccgtaaccgggtttccggaaccggtttttaacgccgggtacccggttaacccgggg

SEQ ID NO: 207651 - DNA, 913 bp, Homo sapiens
  misc_feature: GYAE6OF01DQY9L.17.25.C03.1.454.CMB.1.raw
  modified_base (167)..(167): a, c, t, g, unknown or other
  misc_feature (167)..(167): n is a, c, g, or t
tcagcgtagactagcacgaccggtgctcgatttagtagtgtagatttggggtttggggactcaaacaaccacatctgtcctctagagaaaaccctgtgagcacagctcctcacatgactggacctggagacttcctcttcgttggtggcagcacgctaacgaagtcncccactccgaggtcgcaggtcgtgggtcgacgtacggtcgggtcggggtactaggggaacgggttaggaaacgggacggtccgggtcggggtcctacggtagggttaccggacggttccctttaccgacggaccgtaaggttccttggttacggttaaccttttaccggttaacccgttttacctactaagttaaccgtaacgttccgtaagggtcgggaccgaccggaccggtacgggtccgtacgggtaaaccggaacctacccggtaacgtagggtacggtagggtacgggtacgggtaccgggtaaccgggtaaaccctaaaccccggtacgttcggttagggtacctaaccgtcgttaacgttcccggttaacccttacccgtaaccgttaccccggtaggaacccggtacctaactaccccggttaaatccgaacccgtaacccgaaaccttaccccgtaacctaaaccttaaccgaaacctacgaaccgtacgtaccgtaaggcggttaggtaacggacgtacccgacgtacgtaacgtacgtacggaaccgaacccggtccggtaaaccgttacccgttttaactaacggtttacggttacccgggaaggaacccgtaccgttaccccggaaccgtaacgggttcccggaccggtacgggaacccgtacccggggtaattcccgggaccgggtttaccccgttagggtttaccgggaccggttcccggggtaaccggg

SEQ ID NO: 207652 - DNA, 837 bp, Homo sapiens
  misc_feature: GYAE6OF01EJM5M.17.25.C03.1.454.CMB.1.raw
tcagcgtagactagcacgaccggtgctcgatttagtagtgtagatttgggtttggggactcaacaacacatctgtcctctagagaaaaccctgtgagcacagctcctcaccatggacgtcggacctgggagattcctcttcttggtggcagcagctaacaagtcgacccactccgaggtgacagtcgtggtcgcaggtcgtgggctaggaggtagagacgcgtgggcctacagtgacgtctccgtgacgtaggtcttcgtgtacttcgtacgtttacctacttataactatacgagttgggtcgccgaccgacggtcccgacgtaggaaccgtaacggtacgtggtacggttacgggtacgtaggggacgggtacgggaaccccggtaaaccctaacggtcggttacgggtaaccgtacgtaaccggtcgttcgttaccccttacccggaacccccgtagttaccccggtacccggggtaaacctacgtaaacccctttaaccggacgtaaccccgtaacccgtaacccggtaacccttaccccggttaaacctaaacttaaaacccggaccgtaaccgtaacccgttaagtaaaccgggtttagggtaacggtttaacgggacggtaacccggttacccgttacgaacctaccgggttaccgaaccgggtaacccggtaacccggttccggtacccgtttactttaacggttacccgtaggttacccggaaggtaacccggtccgacccgttacgtacggttaccgggacgtccggtaaccggcccggtacgtacccggttccgttacgggttaccgttccggtccgggtacgggg

SEQ ID NO: 207653 - DNA, 892 bp, Homo sapiens
  misc_feature: GYAE6OF01COZJ9.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggactcctcttcgttggtggcagcagctaacagtcgcccactccagggtgcagcgtgggtcgcgacggtcgtcgggggcttagggaacgggtaggaaacggaacggtcccgtcgggggggtccctacgtaaggtcggtaaacgggttcctacccgtggaccgtaagggtcctttacgtagggtacttaccgtaacgttttacctaccgttaagttaagtactaccgtaagtggggttacgccgttacgacgggtccgtacgtacggaaccaaccggtaccgtggtaacggttggggaacgtttcgggggacgttaccgggggtaacccgtaacccgttaaacgacgggtttcgggtacgtacgtaccgtaacggtttcggtacccctttaccgtaacccctaccggtaccccgggttacccggggaaccgttaccgttaaaccccgtttaacccgtacggttaaccgggaacccctaacccgggttaaacccttacccccggtaaaccctaaaaccgtaaaacccggtaacccgtaaccggtaacccgttaacgacgggtttaagggaacggtttacgggaacgggttacgtaccccggtaagtaaccgtacgttccgaacgggtaaccgtaccggtaccggtacccgttagttaccgttaacgtcggtaccggtagggtaccgtaccgtcccgtacgtaccggtcgggtacaccggccgtacgaccgtacggtcccgttagttaccgtcggtcgggtaccggg

SEQ ID NO: 207654 - DNA, 895 bp, Homo sapiens
  misc_feature: GYAE6OF01CSHS1.17.25.C03.1.454.CMB.1.raw
  modified_base (153)..(153): a, c, t, g, unknown or other
  misc_feature (153)..(153): n is a, c, g, or t
  modified_base (172)..(172): a, c, t, g, unknown or other
  misc_feature (172)..(172): n is a, c, g, or t
  modified_base (193)..(193): a, c, t, g, unknown or other
  misc_feature (193)..(193): n is a, c, g, or t
tcagcgtagactagcacgaccggtgctcgatttagtagtgtagatttgggtttggggactcaacaaccacatctgtcctctagagaaaaccctgtgagcacagctcctcaccatgactggacctggagatcctcttcgtggtgcagcagctanagtcgcccactccaggtcncagtcgtggtgctaggtccgnggggctaggacggtagaaacgacggtccggtggggacccttgaggtaggtaacggtcctaccgtggtaaccgaggtccttacggtaggtacttttacccggttacccgtttaacctaccgttaagttacgttaacctaccgaacgggtttcgggccgacccgaccgaccgggtcccgtacggtaaccggaaccaccggtaccgttggaacggttgggtaagacgggtacggttaccgggaacccctaacccgttaacgcggttggccttacgacgttacgttcgtacccttcccgacctacggttccccggaacgggtactaacggttacccctaagtaccggtaacccgtaacccgtaaacccggttaaccctttcccggtaaacccgtaaacttaaaccccgaacccgtacgttaacccgtaacgtacggtttaaggggtaacgtttagggaaccggtaccgttacccgtaacgtaacccgtacgttccggaaaccgggaaccttaacccgggtaacccggttcgtttaaacgttaccgttaccgggttacgtcccgggtaaacggtaaccgtacccggtacccgtaagggttaaacccggttcccgggtaacggtcccgtaaccccgggtaagggtcccgttaccgggtacccgggtttttacctaccgggttcccggttcccgggggtaaacccgggg

SEQ ID NO: 207655 - DNA, 927 bp, Homo sapiens
  misc_feature: GYAE6OF01ECEVH.17.25.C03.1.454.CMB.1.raw
  modified_base (339)..(339): a, c, t, g, unknown or other
  misc_feature (339)..(339): n is a, c, g, or t
tcagcgtagactagcacgaccggtgctcgatttagtagtgtagatttgggtttggggactcaacaacaacatctgtcctctagagaaaaccctgtgagcacagctcctcaccatggactggacctggaggatcctcttcttggtggcagcagctacaagtgcccactccaggtgcagctgtgcagtctgggctgaggtcgaagaacgccgtaggggcctacgaggtgaaacgggtctaccctggacctaagggtcgttacgttcgggaactttccgtaaccggttttacctccccgttaagttaacggttaaacttaccgtaaacgttcgggggttacnccggtaccccgaacgggccccggtagttacgggtaaccgaaaccggtacccgttggaaccgggttagggtaccggttacggggtaagtacgggggaaccggtaaaaccccgttaaaaccgtaccgtacggggttacgtttaaccggaacgtaaacggtttcggttacccttttaaccgtaacccccgtaaccgtttccccggttaccccggggggaaacctaacggtaaccgtttaaccccgtaaacgttaccggaacccgaaccgtaaaccttccccgtaacctaacgttaaaaccaacggtacctacccgtaactagtacgggtacgggtttaccgaaagggtacaccggtacgtaacgacgtttaccgacggtaacccggtacggtaacccgggtcccgtttaaaccttacggttttaaacccgtggttacggtaccggaaggtttacccggtacccccgtaacggtaacccggtaccccgggttaagaccccggttaaccggttacccggaacccgggtaacgggtaccccgggtttaccccttttaacggggttaacccgggtttccgggtaaacccgggggg

SEQ ID NO: 207656 - DNA, 915 bp, Homo sapiens
  misc_feature: GYAE6OF01BUZBV.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactccaggtgcagctggtgcagtcgtgggctggaggtgaagaagccgtggggcctcgaggtgaacggtcctccgtgacgaacggtctttcgtggtactttccgtaaccgttttaccctccgttaataacgttactaccgtaacggtcggggttcgccggtcgttaaccgggcccgtcgttacgggaaccctaaaccggtacccgtgggtaacgggttggggaacgttaggggggtacgttaccgggggaaccccgtaaaacccccgttaaaccgaccggtttacggggtcgttaaccgaacgtacggtttccgttaccttaccccgaacccccgtacgttaccccggtaacccggggaacctaaccggttaaaccctttaacccgaagttaccgaaaccccgtaaaccgtaaacccgtttacccctaaaccgtaaaccttaaaaccgaacccgaaccgtaaccccttaaacgaaggttacccgggttaaggtttaccgggaacgggtaaccgtccccgttaaggtaacccttacgttacgttaaccggaacccgtaacccggtacccggggttaacccgtttaacgtttaaccgtttacccgtaggttacccgggaaccgtaacggtaacccggttaccccggtaacggtaccggttcccggggtacggacccggtaccccgggtacggacccggtaacggtccccgggtttactttaaccggttacccgggtttcggtaaccccgggggg

SEQ ID NO: 207657 - DNA, 950 bp, Homo sapiens
  misc_feature: GYAE6OF01DI9LV.17.25.C03.1.454.CMB.1.raw
  modified_base (366)..(366): a, c, t, g, unknown or other
  misc_feature (366)..(366): n is a, c, g, or t
tcagcgtagactagcacgaccggtgctcgatttagtagtgtagatttgggtttggggactcaacaaccacatctgtcctctagagaaaccctgtgagcacacgctcctcaccatggactggacctggaggactccttcgttcgttggtggcagcagcctaacaagtcgcccacctccgaggtcgacacgtcgtggtcgacgtaggtcggtgggtctagggaggtagaaaggacggtccggtcggggccttacgtaggtacggtaccggttccgtaccgtacgtacgtaaggtccttacgtaggtaactttcccgttaacctttaacctcgttaagttaacgtacttaacggtaccggttgggaccnccggtaccgtacggtccgtaccggtaacgaaaccgaccggtactggggtaacggtggaacgggttacgggtaacggtacggggaaacccccttaaaccgtaacgttacgggtcggttacgtaacgaaccgttagggttcccttaaccgttacccaaacccggttccgttaaccgggtacccggtaaactaacgtaaaccttaccgtacgtaacccggtaccctaaaacgttacccgtaacctaaaccgaaaccgtaacgaaacccgtaccggtaacctttaacggggaagtttaaccggggtaacggtttaaccgggaacggttaccctacccgttaggtaaaccttccgggttaacccggtaaacggacccgggtttaaaccccggtaccggtttaccgttaacggttttaacgtacggttaaccgttgggaaaaacccgttccgggtaaaccccgtacccggaacggttttaaccccggtcgggggaaaaccctcggttaacccccggggagtacccgggggtacgtttcccccggttttaaacgggtacggtccccgggtttaagggaaaccccggggggg

SEQ ID NO: 207658 - DNA, 960 bp, Homo sapiens
  misc_feature: GYAE6OF01AMAPW.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggccagcagctacaagtcgcccactcccaaggtgcagctggtgcagtcgtgggctggaggtagaagaacgtccgtcgggggacctcgaggtaggaacggttcctccgttgacgtaacgggtcctttcggttaggtaactttccgttaacccggttttaacccctacccgttaagttaacgttacgtttaaccgaaaccggttgggggttaccgccggaccccgaacgggtcccccgtacggttaccgggaaacccaaacccggaacctttagggaaggttacggggttaaggtacggggggaacgttaccggggaaccccgtaaaaccccgttaaaaccgtacggttacgggtacgtacgaacgtacgggtttcttaccgtttacccgaaccctaccggttcccgtaacccggggtacctaaccggttaaccctttacccgaacgttaccgaaccccgtaaaccgtaaacccttccccgtaacccgtaaaactaaaacccctaaacccgaaccggtaaccctaaacgtaaccggttagggttaaaccgggttacggaccggggtaaacccgtcccggttaacgtaaactaccgttaacgttaccgggaaaccctacccgggtaaccccgggttcccggtttaacctttaaccgtttttaaaccggcggttacggtaaccgggaaccggttacccggtaacccccgtaacgggtacccggtttaccggggtaacggtacccgggtaccccgttaaacggggccctacggggtccccggtttaggtttccggtaccccggtttgggtaccccgggggg

SEQ ID NO: 207659 - DNA, 688 bp, Homo sapiens
  misc_feature: GYAE6OF01BVD2O.17.25.C03.1.454.CMB.1.raw
  modified_base (302)..(302): a, c, t, g, unknown or other
  misc_feature (302)..(302): n is a, c, g, or t
  modified_base (499)..(499): a, c, t, g, unknown or other
  misc_feature (499)..(499): n is a, c, g, or t
  modified_base (593)..(593): a, c, t, g, unknown or other
  misc_feature (593)..(593): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactccaggtgcagctggtgcagtcgtggggctggaggtgaagaagcgtggggcctcgagtgaagtctcctgcaggtctgtgtacttctacgtttacctctatagttactacgacggtgggtcgccgaccgacggccnggtacggaaccgaacggtaccgtggaggtacggagtaggggacgtcggggtaacccgtaaacccgtaacgtacggtacggttacgacctacggtaagttcgtaccgttaccgaccctacgttacccggacccggtaactaacggtaccttaccgaacgtaccggacctaaccgaaccttccctactaaacgtaaacncgaacctcctaaagtcgtagggtaacgttagacgggtactacgtacgtacacgttcgacggaaccgtaccggacgtacccggttattacgttancggtgaccgacgtccggtacccaggtccgtagggcgtacggccgtacgggaccgtcgggttaccgttccgtttacggtcggttcggggtaccggg

SEQ ID NO: 207660 - DNA, 631 bp, Homo sapiens
  misc_feature: GYAE6OF01BTAVI.17.25.C03.1.454.CMB.1.raw
  modified_base (467)..(467): a, c, t, g, unknown or other
  misc_feature (467)..(467): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctgggtgcagtcgtggggctggaggtgaagagccgtggggcctcgagtgaaggtctcctgacaggtcttcgtggtacttcgtaccgtttacctcctatagtatactaacgtgggtgccgccgaggccgcgtacggacaacgcctggagtggagtgggagtcgggaccaaccctaacacgttggcgtacacgtagttcgttccttaccaaccctcgttcccgtaccgggaactacgtaccttaccagtaccgacccacgtaacctcctaccaataaccacacgtacctanagtaggagttagacggcgtcacgactacttacgcgaaccgacgtaccggtccgttacttaacgtacgtgcgacgtacgtaccgtacccgtaggtccggtacggtacggacgtacccgtacggccgacggtcccggttaccgttcgtacgttcgggtacccgggg

SEQ ID NO: 207661 - DNA, 740 bp, Homo sapiens
  misc_feature: GYAE6OF01DCVBK.17.25.C03.1.454.CMB.1.raw
  modified_base (281)..(281): a, c, t, g, unknown or other
  misc_feature (281)..(281): n is a, c, g, or t
tcagcgtagactagcacgaccggtgctcgatttagtagtgtagatttgggtttgggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagagcgtggggcctcgagtgaaggtcctcctgcgaaggcttcgtggtatttccgtacgtttacctcttagtatatnaacgtgggtgaccgccgaggccgacgtggaacacgacgtggaggtggagtggagtcgggaccgaacccgtaacacgtggtacgtcactagttcgtaccttaccgaccctacgtcccggtaccgggtacaacggtacctttaaccgacgttacggaacctaaccgtaacccctaccctaaccctaaacctaaaacccgaacctaccgtacccttaacgaacggttcgggtaaggtttacgggaacggaccggtacccgttacggaaccttacgttccgaacgaacccgggtaaaccggtaacccgggtttcccgttacgtttaacgttttacccgttgggttccggaacccggtaacgggaccccttacccggaccggtaacgttcccgggttacgggaaccctccgggtaccgacgtacggttcccggttacttttcggccggttcgggtacccggggg

SEQ ID NO: 207662 - DNA, 744 bp, Homo sapiens
  misc_feature: GYAE6OF01CK3D7.17.25.C03.1.454.CMB.1.raw
  modified_base (145)..(145): a, c, t, g, unknown or other
  misc_feature (145)..(145): n is a, c, g, or t
  modified_base (265)..(265): a, c, t, g, unknown or other
  misc_feature (265)..(265): n is a, c, g, or t
  modified_base (333)..(333): a, c, t, g, unknown or other
  misc_feature (333)..(333): n is a, c, g, or t
  modified_base (682)..(682): a, c, t, g, unknown or other
  misc_feature (682)..(682): n is a, c, g, or t
tcagcgtagactagcacgaccggtgctcgatttagtagtgtagatttgggtttggggactcaacaaccacatctgtcctctagagaaaccctgtgagcacagctcctcaccatggactggacctggaggactcctcttcgttggnggcagcagctaacaagtcgcccacctccaggtcgccgagcgttgggtcgacgtacggtcgtcgggggcttggaagggtagaacgacggtccggtgggccctgaggtggaacgtcctacgngacgtacggtcttcgtggtacttcgtaccgtttacctctagtaacgtacgtactaacggtcgggtacnccggaccgtacggggtcccgtacggtaccggaaaccgaccggtaccgttagggtaggtacggtaacggtgggtaacggtaccgggaaaccgtaaacccgtaagtacggtacggtacgtacgacgtacggttacgtcccttacccgaccgtacctaccgggtacgaactacggtaaccttaccgacgtaccgaaccgtaacccgtaaccaccgttaacaaacgtaacaccacgtaccacgtacgtagggtacgtagacggtacacgtacactcgacgtaccgaacgaccgtaccggtcctacgttacgtttacgacgtcgtaaccgtcgtaccggtccgacgttaccggngtacccgtacggaccgtaccggcgtaccggttcgttacgtccgttacggtccgggtaccggg

SEQ ID NO: 207663 - DNA, 696 bp, Homo sapiens
  misc_feature: GYAE6OF01B8L12.17.25.C03.1.454.CMB.1.raw
  modified_base (153)..(153): a, c, t, g, unknown or other
  misc_feature (153)..(153): n is a, c, g, or t
  modified_base (381)..(381): a, c, t, g, unknown or other
  misc_feature (381)..(381): n is a, c, g, or t
  modified_base (439)..(439): a, c, t, g, unknown or other
  misc_feature (439)..(439): n is a, c, g, or t
  modified_base (448)..(448): a, c, t, g, unknown or other
  misc_feature (448)..(448): n is a, c, g, or t
tcagcgtagactagcacgaccggtgctcgatttagtagtgtagatttggggtttgggagtcagtctcagtcaggacacagcatggacatggagggtccccgctcagctccgtggggctcctgctactctggctccgagctcgccagatggtanacagtaccagtatcgacccagtcctccactccctccgtgtcctcgtccgtcgtaggtcggggtcacgtacgtaccacataccgtacgtcggaccggaagaacgtaccgtaaccggttaacgttaaaaacctttaagtttaaagttcggtaactacgaacgtacaaaacggtaaaccgtacggaaaaaccgccctaacgtacccttacgtgtaacctcgtcggtgtacncctaactccgtactcgacgacggtaacgtcgtaccgtaccgaggttcggaggttacgnggcgtacgnggtacgagtccggaggacttaagtacgttaccaagtccaaccgtactacctacaaccgtctactacgaactaacgtgggtaactagtcacgtactaacttctaacgtaactagtaaaccgtaacgccgttaacctacgttaccctaccgtacgtaccttaccggtaggaaccgaaggttaacgaagtactaaacgtaactaacggacgtagttcgaccttcggactacaacggttctcgtagttaccc

SEQ ID NO: 207664 - DNA, 782 bp, Homo sapiens
  misc_feature: GYAE6OF01CH1IY.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatgactggacctggaggactcctcttcgttggtggcagcagctaacagtcgccccactcccgaggtcgcagtcgtggtcgcgtaggttcggtcggggctgggagggtaggaacggacgtccggtcggggccttgaggtaggtaacgtcctccgtgacgtaggtccttgtaggtactttccgttaccgttttacctaccgttaattacgttacgtaccgtaacggtcgggtacgccggtccgaccgggccctaggtccggaaacgaccgtaccgtggaggtacggaggtgggtacggtacggggaaacccctaaaccgtacgtacgggtgtaccgtactaccgtgttccgtacctacccacctaccgtccgaccggactacgtacctacgtacgtacgaacccgtacctacctaccctaacctaaactaaaccgaacctaccgtaaccgtaagtacggtacggtaaggtacggacgaccgtacgtacgaactagtacgtaccggaaccgtaccggtaccggtacccttacgttacgtaacgttcggtacgtacggtacgtacccggtaacccgtacggtaccgtaccgggtcggaaccggtaccccgtacggcccggttaccgggtacccggtttaccgtttccgggtaacccggtttcggggaacccggg

SEQ ID NO: 207665 - DNA, 864 bp, Homo sapiens
  misc_feature: GYAE6OF01DCF80.17.25.C03.1.454.CMB.1.raw
tcagcgtagactagcacgaccggtgctcgatttagtagtgtagatttgggtttgggggactcaaacaaccacatctgtcctctagagaaaaccctgtcgagcacacgctcctcaccagtggactcggacctggaggactccttcttcgttgggtggcagcagctaacagtcgcccactccgaggtcgcacgtcgtggtcgcgtacggttccgtgggggactagggtacgggtaagaaacggtaccggtccggttcgggggtacccttacggtaagggtacggtaaccggttcctacccggtaggaccggtaaggttccgtttacgtaggttaacctttaccgttaccgtttacctacgtaagttacgtactacgtaacggtcgggtaccgaccgaccggtacggtccgtacggtaccggtaaccgtaaccggtacggtaggaacgggttcggaagggtacggggtaacgtaccgggtaaaccccgtaaacccggtaaggtcggttcggtaaccttaccgtaacggttacgtttaccgtacccttaacccgaccgttaacccggtacccggtaacccggtaaacctaccggtttaaacccctaccgtaaccgtaacccggtaaccgtaacccgttaacccttacccgtaaacctaaacgtaaaccgaccgtaaccgtaaccgtaggtacggtaggtacgtacgacggactacgtacgtactcgtacgaacgtaccgtacggtccgtacgttacttacgttcggtcgtacggtacgtacgtacccgtacgacgtaccgggtacgtacggaccggtaccggacgtaccggtacggtaccgttcgttacgggtccgttcggggtaccg

SEQ ID NO: 207666 - DNA, 825 bp, Homo sapiens
  misc_feature: GYAE6OF01DAV4V.17.25.C03.1.454.CMB.1.raw
  modified_base (369)..(369): a, c, t, g, unknown or other
  misc_feature (369)..(369): n is a, c, g, or t
  modified_base (434)..(434): a, c, t, g, unknown or other
  misc_feature (434)..(434): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggagactcccttcttggtgcagacgagactactaagtcgcccgacctaccgacggtgcgagcgtggtgcgagtcggtgggcgtggtaggagaagaacggccgtcgggtccgtagtaggtaggtaacggttccgtaccgttggacgtaacgtcgttcgtagtagttacctaccgtttaacctcctaagtactatacgtaacgtgggtcgacgtccgacggtcgaccgtaggaaccaacgtaccgnggtaaggttggagtacgggaacgttacccgggaaccgtaaaaccccttaggtaaccgtggggttntacccgaaagtttcgttaacggttcccttaacccggaaccccaacgttttcccgggaccggttaaacacccgtttaaaaccctccggtaaagaccccgtaaaccgaccccgttaacgtacccctaaaccgtaaacctaaaccgtaaccgtaaccgttaaccgaacgttaacggtaagggttaaccggtaagggtaacggaaccgtacgttacaaacgttacgtacgtaacgaacgaaccgtaccggttaaccttacgtttaacgtacgttacgttacggaaccgcggtaacgtaccccggagtaaccggttccgtaagggtacccgtacgtacccgggtaactaccgggttcccggtaacgttttcccgacggttccggcgggtacccggg

SEQ ID NO: 207667 - DNA, 766 bp, Homo sapiens
  misc_feature: GYAE6OF01DXOIN.17.25.C03.1.454.CMB.1.raw
  modified_base (102)..(102): a, c, t, g, unknown or other
  misc_feature (102)..(102): n is a, c, g, or t
  modified_base (154)..(154): a, c, t, g, unknown or other
  misc_feature (154)..(154): n is a, c, g, or t
  modified_base (272)..(272): a, c, t, g, unknown or other
  misc_feature (272)..(272): n is a, c, g, or t
tcagcgtagactagcacgaccggtgctcgatttagtagtgtagatttgggtttggggactcaacaaccacatctgtcctctagagaaaccctgtgagcacanctcctcaccatggactggacctggaggatcctcttcttggtgcagcagctanaagtcgcccactcccaggtgcagtcgtggtgcgagtccgtggggtactggaggtagaaacggaacgtcccggtggggccttcgaggtgaacggtcctccgtgaccgaaggtctttcgnggtacttccctacgttttacctacgtaattacgtactacaacgttcgggtcgccgccgacggccgtacgtacgggaacctaaccggtaccgaggtacgggtagtaggttaggggacgttaccggggaaccctaaacccgtaagaccggtttggtacgtaccgaacgtcgttcggttaccctaccaacccgtactcccggtaccgggacctagtaaccctacataccggaacccacgtaacctccctacaaacttaaacaccgcgtaacccagtaggttacggtaggttacggacgtaccgcttaacgaactcgtaccgtaggaacccgtacggaccggttacccggttatttaacggttcctagggtacctacccgggaagtccccggtaaaccccgcggtaaacgggttcccgggacccgtacgttacccccggtaggaaccgtcccgggttacccgtttgtttacccgttcccgggttacgggacccggggg

SEQ ID NO: 207668 - DNA, 825 bp, Homo sapiens
  misc_feature: GYAE6OF01BALWA.17.25.C03.1.454.CMB.1.raw
tcagcgtagactagcacgaccggtgctcgatttagtagtgtagatttggggtttggggactcaacaaccacatctgtcctctagagaaaaccctgtgagcacagctcctcaccatggactggacctggaggatcctcttcgttggtggcagcagctacaacgtacccactccaggtgcagctggtgcgagtcgtggggctgaggtgaagacgccgtcggggtcctcgaggtagtaacggtctccgtgacgaaggtcttgtggtattccgtaccgtttacctacttagtagtactacgaacgtggcgcgccgtacgggccgtcgtacggaaccgtaacggtaccgtaggacggtgggaacggttggggacggttacgggaacccgtaaaacccgtaacgtaccggttacggtacggtaccgtaacgtacggttcgttacccttaacccaaccccgtacggttacccccgggttacccggggaaccgttaaaccggtaacccgtttaaccgtaaacggtacccggaaacccgtaacccggtaaccctacccctaacccgtaaaacctaaaccaaccgtaacgtaaccccgttaacgaacggttacgggtaacggtttaacgggaacggtaaccgccgtttaacgaacctacggtacctaagggacccgtaaccgacccgggttaccgtttaccgttaattaccggttacggtaggaccgtacgggtacccaccgggtaccgaacggttccggtaaccgtccggtacccggtacgaccggtaccggttcccggttagtttcccgggaacgttcgggccggggtaccgg

SEQ ID NO: 207669 - DNA, 834 bp, Homo sapiens
  misc_feature: GYAE6OF01DUTCV.17.25.C03.1.454.CMB.1.raw
  modified_base (197)..(197): a, c, t, g, unknown or other
  misc_feature (197)..(197): n is a, c, g, or t
  modified_base (640)..(640): a, c, t, g, unknown or other
  misc_feature (640)..(640): n is a, c, g, or t
tcagcgtagactagcacgaccggtgctcgatttagtagtgtagatttgggtttggggactcaacaaccacatctgtcctctagagaaaccctgtgagcacagctccctcacagtggactggacctggaggacttcctcttcgttggtggcagcagctacagtcgccccactcccgaggtcgccgaggccgtgggtcncgtaggtcggtcggggctggagggtaggaaacggacggtccggtgggccctgaggtacggtaacgttcctcgttacggacgtacggttcgtttcgtacggttacttcccgtttaaccgtttacccgtagttaacgttagttacgtaaccgttaaccggttggggtaccgtcccggaccggtccggggtaccggtaccggtaaccggaacccgttaaaccggcccggttaaggtagggttacggagggtggggtaccgggtaccggaacccgttaaacccctaggtaccgtacgggttctaccgtaccggaggttcccgttccgtaaccgtacccgtacccggtacggtacccgattaccggtacctacacgtaccgaacctacgaccctcgtaccaactaacacgtacactacgtaagtcggaggtaacgacggacttcgacncgttacgccgaacggtaaccgtaccggtccttaaccggtacttggttaccgtacggtaggtaacccggtccgtaaaccggtacccggtaaccgggtaccgtacggggtacccgccccggttaccgggtaaacggcccggttaacccggttacgggtttaccctttaacggcccgggttaacggtccccgggggg

SEQ ID NO: 207670 - DNA, 737 bp, Homo sapiens
  misc_feature: GYAE6OF01ETNDM.17.25.C03.1.454.CMB.1.raw
  modified_base (293)..(293): a, c, t, g, unknown or other
  misc_feature (293)..(293): n is a, c, g, or t
  modified_base (326)..(326): a, c, t, g, unknown or other
  misc_feature (326)..(326): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatcgacccagtcctccactcctcctgtctcgcctcgtggtgggggtcaggacgtcaccatcacttggccggacaacgtcgacggtacgttaaaacctatttaaattggtatcgagacaacgaaacctacgggaaaacnccccaagaccttcctagtactctcgtgggttcncctactccacgtcgtcggacgaacggtcggacccggccctagtcggtacggttaccagggttcggcgtaggtcggacgtcggtacgggactagggtacttttacgaacttccgtacaaccgtactacccaaccgtcctacgtcgacctaaccgtaggtaacggttacttcggtacaccgttaactaccttaactacgttacggtacctaaaccggtagttaaccgttaccgttacccggttaccccgttacgtaccgtttaccgtttacgggacccggtaacggggttaaacccgtaaacggtttaccggaaacgtaaccgttaaaccggaaaacgggttaacccgttacgggtaaccggtacccgttacgaacccgtacccgtacgtttacccgttcgggtttaaccccg

SEQ ID NO: 207671 - DNA, 757 bp, Homo sapiens
  misc_feature: GYAE6OF01DLJ02.17.25.C03.1.454.CMB.1.raw
tcagcgtagactagcacgaccggtgctcgatttagtagtgtagatttgggtttgggggagtcagtctcagtcaggacacagcatggacatgaggtcccgctcagctccgtgggctcctgctactctggctccgagctgccagactgtagaccatccagatcgacccagtcctccactcctcctgtctcgcctcgtcggtggggtcaggtacgtccacctatcgacttcggaccgacaacgtcgaacggtaccgtttaaaactatttaagtcgtactcacgactaacggaaacctggaaaaccgtccccaagtacccttacctagttacctcgttaccgtcgggtacgtacccaacgtccctaacgtaccggtaggaacccggtaagggtcggtaccccgtacccctaaggtccggttaacgtccgtaggggttaccggacgtacgggtacgtaacggttaccggacgggtaaccgtacgtttaactttaccggaacctttaccgaccctaactaaccgtacctacccttaccgtacctacgtaccaccgtaggtaacgtcgttacgtacgtactacctacgttaaccttacgtacgtactaacgtaacgtacgttaccgttaccgtcccgtacgtacgttaccggtttaccggacgggtaaccggtaacgtaacggttaccggagtaaccgtaccgtaaaacggtcctagggtacccggacgttaccgtaccctacttaacctcggttccgttaccg

SEQ ID NO: 207672 - DNA, 723 bp, Homo sapiens
  misc_feature: GYAE6OF01ED1Y6.17.25.C03.1.454.CMB.1.raw
  modified_base (177)..(177): a, c, t, g, unknown or other
  misc_feature (177)..(177): n is a, c, g, or t
  modified_base (252)..(252): a, c, t, g, unknown or other
  misc_feature (252)..(252): n is a, c, g, or t
  modified_base (361)..(361): a, c, t, g, unknown or other
  misc_feature (361)..(361): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttgggtgcagcagctacaagtcgcccacctccgaggtncagcgtaggtgctagtcggtgggctggaggtagaacgacgccggtacgggcctacgaggtcgaacgtccttaccnggacgtacggtcttgaggttcttaccgtaccgtttaccttactacgtagtacttacgaacgtcggtcgccgcgacggccgagtacggaccacgactggacgtgtacggngggtacgacgggaacctaaccgtaacgtacgtcggtacgtacgtagtcgtacgttacctacgtacccctaacggttccggaacgtacgaaccggttacctacgacgttaacccgaacctaaccgtaaccccttacctaaacctaaaccgttaaacccgaaaccctaccgtaaacccgttacgtaaacgggttacggttacggttaacgggaacggtaccgttaccgaaccggtactaacgtcgtaacggaaccgtaccggacggttacctacgttaacgtcgtaggacgacgtacgtcgaccgtacgtacgtcgacggtcaacgtgaccgtcggtaccgttctcggtccggttggacccggg

SEQ ID NO: 207673 - DNA, 887 bp, Homo sapiens
  misc_feature: GYAE6OF01A25EF.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcgttcgttggtggcagcagctacaagtgccccactcccaggtgcagctggtgcagtcgtggggctgaggtgaagagccgtggggcctcgagtgaacggtctccgtgacgaaggtcttcgtaggtactttccgtaaccgttttaccctccttaatacgttactacgtaacgttgggtgccgccgtacgggcccgcgtacggaacctaaccgaccgtggaggtcggaggtggggagtacggggacctaaacccgtaacgtacgtcgggtcgtaccacgtagttcgtaccttaccaccccgtagtccccggtacccgggaactacggtaaccttacccgtagtaccgaacccgtaaccgtaacccttaccccgtaacctaaaaccgttaaaccgaacccgtaaccgtaccccgttaaaccgttacggttaggggtaaccgtttagggaaccggggtaacgtccccgttacggtaaaccgttaccgttaccggtaacccgggtaacccgtacccgggtaaccccggggtacccgttttaaaccgtttaaccgtttaaccggttacggacgggttaacccgggtaaaccgggttaccccgggtaacccccctaaacgggggttacccgtttaaccccgggggtgttaaacccccggggtaaccccggtttaccccgggaccgggttacccggggtaccccgggttttacccgttttaccgggttaaccccgggtttcccgggggttacccggggggg

SEQ ID NO: 207674 - DNA, 1054 bp, Homo sapiens
  misc_feature: GYAE6OF01CVWZK.17.25.C03.1.454.CMB.1.raw
  modified_base (105)..(105): a, c, t, g, unknown or other
  misc_feature (105)..(105): n is a, c, g, or t
tcagcgtagactagcacgaccggtgctcgatttagtagtgtagatttggggtttgggggagtcagtctcagtcaggacacagcatggacatggacgggtccccgntcagcctccgtgggcctcctgctactctggcctccgagctgccagatgtcgacactccaagactacgaccctagtcctacacctcccttccctcgtcctcgtccttcggttggggtacgggggtacagtaccgtaccgaacctactcccgtacgttccggacccggtaactaacggtacccggtaaaccgggttaaacccgtttaaaaaccttttaagttttaaagtttacggttaacctacggtaaacggtacctaaaaaaccgggtaaacccgttaaacggggaaaaccccgtcccccgtaaacggttacccccctttaccggtacggttaacctttaccgttacggtttccgggtaactacccttaaccccgttacgttaaccccgttgggtaaccgggttaaccgggttaacggggttcccccggacccgtttaaccccgggtaacgttttaaccgggggtaaccggggttttacaacgggggtttacgaacccgggggtttagttaaacccggggtttacggttacggggtaaaccggggttaaacccgttaaacgtttttttaccttaaaacccccggtttatttaaaccccccaccgtaaaccccttacccggtttaacccccttaaacccggttacctttacccggtaacccgaaacccgtaaccgggtttaggtaaccggtttacttaccggggtaaccgttaaccctaaccgttacttacccgtttaaacggacgttaaacccaaccggtaagttttaacccctttaaccggtacccccttttccggtaacctttacccgggtttacgggtacccggggaaacccgtaagggggtaaacccttagtaaccggtaaacggttaccctaaaagggtacgtttaaacccggacggttcctaacggtacccgttactaacgtttaccgcggtttccgtaaccc

SEQ ID NO: 207675 - DNA, 652 bp, Homo sapiens
  misc_feature: GYAE6OF01EBT1G.17.25.C03.1.454.CMB.1.raw
  modified_base (292)..(292): a, c, t, g, unknown or other
  misc_feature (292)..(292): n is a, c, g, or t
  modified_base (356)..(356): a, c, t, g, unknown or other
  misc_feature (356)..(356): n is a, c, g, or t
  modified_base (494)..(494): a, c, t, g, unknown or other
  misc_feature (494)..(494): n is a, c, g, or t
  modified_base (505)..(505): a, c, t, g, unknown or other
  misc_feature (505)..(505): n is a, c, g, or t
  modified_base (559)..(559): a, c, t, g, unknown or other
  misc_feature (559)..(559): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtcgcagtcgtggggctgaggtgaagagccgtggggcctcgagtgaaggtctcgtgacaggtcttcgtggtacttctacgtttaccctctatgtactctaacgtgggtacncgccaggtccgactggaccaacggtcctggagtcggagtgggacgtcgggaccaaacccgtacncggtggtctacgactacggtcgttacctcacccctatcccgccgggaactacggtaccttaaacgcttagacccctaacgaacctccctaaccgaataaaccacagtaccctagtacgtgggtaagttacggaggacnccttacgaccngttacgaaccggaacgacccgtaccgggcccttattaagtaccgtgtacggacncggtaacgtccccgaagtccgtaccggacggtaccggccctagggccctacgggacccggttccgtttaacggttccggtccgggtaccgggg

SEQ ID NO: 207676 - DNA, 593 bp, Homo sapiens
  misc_feature: GYAE6OF01BD9TF.17.25.C03.1.454.CMB.1.raw
  modified_base (343)..(343): a, c, t, g, unknown or other
  misc_feature (343)..(343): n is a, c, g, or t
  modified_base (438)..(438): a, c, t, g, unknown or other
  misc_feature (438)..(438): n is a, c, g, or t
  modified_base (457)..(457): a, c, t, g, unknown or other
  misc_feature (457)..(457): n is a, c, g, or t
  modified_base (465)..(465): a, c, t, g, unknown or other
  misc_feature (465)..(465): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagctggggcctcgagtgaaggtctccgtgcgaagggcttcgtggattcgacgtttacctctatagtatcaacgtggtgcgccgaggccgcgtcggaacctaacgccgtagaggtggagtgggatcgggacaaccctaanacgtggtcgtacacgtagtcgtcttccacctactccgtcgggactacgtacttaccatcgaacctacgtaacctcctacaataacacagacctangtaggtagtagacggtacncctagacntcgagacgacgacggtaccttattacgttacgttcgcgtacgacgtaccgtaacccgcggtaacgtcccgggagtacccggacctacgggcgtacgtcccggttctttacgcgtttcgggacccgggg

SEQ ID NO: 207677 - DNA, 861 bp, Homo sapiens
  misc_feature: GYAE6OF01DSJHO.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccgaggtgccagcgtggtgcagtcgtggggctggaggtagaagacgccgtcggggcctcgaggtagaaggttctccgtaggacgtaacggtcttcgtaggtactttcctaaccgttttacctcttaagtacgttactacgtaacggtcgggtacgccggaccgaacgggtccgtaccggtaggaaaccgaaaccggtaccgtggaagggtagggtaagtacgggggtataccggggaacccgtaaaacccgtaacggtacgttacgggtacgtaacgtaccggtagttacgtaccctttacccgaacccgtaccggttaccccggtaaccggggtaaacctaaccggttaaaccctttacccgaaacgttacccggaaaccctaaccggttaacccttacccgtaaccccgtaaataaaaccctaacccggaacctaacccttaaggtaacgtacgggttaacggtaaggaaccggtacgtaccgttagacttaacgaccggttacggaaccgtacccggtacccgggtactttaaccgttaacttacgggtagaccggtaacggtaccgtaaacccgggtaccctaacccggggtaaccgttccggggttaacgtaccccggaccgggttacggaccgtaccgggtccggtttacccggttttaccggtgggttaccccgggaaccggggg

SEQ ID NO: 207678 - DNA, 901 bp, Homo sapiens
  misc_feature: GYAE6OF01BBLAI.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtcgcccactccgaggtgcagctggtgcgtagtcgtggggctggaggtgaagagccgtggggcctcgaggtgaacggttctccgtgacgtaacggtctttcgtaggtactttccgtaacgttttaccctacttaattacggtaacttcaaacggttggggtaccgccggtacccgaacgggtcccggtaccgttaggggaacctaaaccggtacccgttacggagggttacgggagttacgggggggtaaacgtacgggggaacccgtaaaacccccgtttaaacgtaacccggttacggggtttcgtaaccgttaaccgtaagggtttcggttccctttaacccggtacccccgaaacggtttccccggtaaccccggggggtaaacaaccgggtttaacccgtttaaacccgtaactttacccggaaaacccccggtaaccggtaaaccccttaccccgtaacccgttaaacccgtaaaacctaacgtaacccggtacccttaacgtacgtacgggtacgtttagggaaccgtacgtaccgtagtactacgttacgtacggaacccgtaccggtaccggggttacccgttacttaacggtttacgtacgttaccgggtccgaacggttaccggtacccctaaccgggtacgttacccgggtcgggtaaccgttcccggtaacccggcggtacgggttacccgggttaccctttacggacccgtttcgggggaacccgggg

SEQ ID NO: 207679 - DNA, 784 bp, Homo sapiens
  misc_feature: GYAE6OF01A6KG2.17.25.C03.1.454.CMB.1.raw
  modified_base (291)..(291): a, c, t, g, unknown or other
  misc_feature (291)..(291): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcgagtggaaggtcctccgtgacgaaggcttcgtaggattctacgtttacctccttatagtatcaagtggtncgccgacggccgcgtggaaccacgaccgtaggacggtaggagtgggagtacggggaccgtaaaccctaacgacgttggtcgtacacgtacgttcgttccttacccgaacccgtctacccgtcccgggaacacgtaaccttaccgacgtacccgaacctacgaaacccgttccctaaccgtaactaaaaccaccgtaaccgtacccgtaaacgtaggtacgggttaacggtttaacggaacgggtaccgtacccgttacgaacgttaccgttaacgtacggaacccggtaaccgtaacccgggggtaaccctttacggttaaccgtttaccgggttacggttaacggaccgggttaaacggtaaccccggtccccgtaacggggttaacccgttaccggggtccgtaaacccgggttacccgtaaccgggaccggtaacccgggttcccggttacccgttttacgggtaaccccggtttcccgggaacgggggg

SEQ ID NO: 207680 - DNA, 778 bp, Homo sapiens
  misc_feature: GYAE6OF01BG644.17.25.C03.1.454.CMB.1.raw
  modified_base (150)..(150): a, c, t, g, unknown or other
  misc_feature (150)..(150): n is a, c, g, or t
  modified_base (186)..(186): a, c, t, g, unknown or other
  misc_feature (186)..(186): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagnagctacaagtcgcccactcccaggtgcagctgggtncgagtcgtgggctggaggtagaagagccgtcggggcctcaggtagaaggtctccgtgcgaacggtcttcgtggtactttcctaccgttttacctccttatacgtactactaacggtgggtcgccgaccgtcggcccgtacgtacgggtaaccaacccggtccgtagggtaacggtggacgggttacgggggtacgtaccggggaacccgtaaaccccgttaagtaaccgttcgggtacgtaccgtaacgttacgttccgttaccttacccgtaaccctccggttaccccggtacccgggaacgtaacgtaaccccttaccgaaccgttacccgaaccgtaacccgtaccctaccccgtaacctaaacctaaacctaccgaactacccgtaacgtacggtagggttacggtagggaacgtaccgtccgtaacgaccacgttcctaacgggaacccgaccggttccgtaccgttacgttcgttacgtcggacggccggacgttaccccgtaccgtaccggtaccggtccgggaacggtcccgacccgtaaggcccgttacggccggtttacctcggttccgtcgggacccgggg

SEQ ID NO: 207681 - DNA, 879 bp, Homo sapiens
  misc_feature: GYAE6OF01D8QC5.17.25.C03.1.454.CMB.1.raw
  modified_base (126)..(126): a, c, t, g, unknown or other
  misc_feature (126)..(126): n is a, c, g, or t
tcagcgtagactagcacgaccggtgctcgatttagtagtgtagatttgggtttggggactcaacaacacatctgtcctctagagaaaaccctgtgagcacagctcctcaccatggactggactggnggatctcttctggtgcagcagctacagtcgcccactccaggtgcagtctggtgctacgtcgtgggctggacggtgaagtacgccgtggggcctgaggtagtaacggttcctccgtaggtacgaaggttcttcggtagttactttacctaaccgttttaccttacctaagtacgtataccgtaaggttcgggtcgaccgaccggtaccgggtcccgtacgtacggaaacccgtaaaccgggtccgttagggacgggttacgggtaaggtcgggggaacgtttaccggggaaaccgttaaccccgtaagtacgttcggacgtaccagttcgtcgttaccctaccgacctaccgttacccgggacgtaaccgtacggtaacccttacgaaaccgttacccgaacccgtaacccgtacccgttaacccacccgtaaacttaaacccgtaacgtaacgtaacccgttaagtaccggttaacgggtacggttaacgggaaccggttaccgaacccggtttaacgaacttaccgtacggttaaccggaccggtaaaccccgtccggttaaccgtttaccgtttaaacggttaccgtttccggtaaccggtaacgggacccttaacccggggttacccgtaaacccgggtcgttaccccgggggacttaaccccgggtaccccggggttaaacggttcccggaaacccgggttcccgttttacccggggtttaacgccggtttacccggggggaccccggg

SEQ ID NO: 207682 - DNA, 833 bp, Homo sapiens
  misc_feature: GYAE6OF01EFOBX.17.25.C03.1.454.CMB.1.raw
  modified_base (308)..(308): a, c, t, g, unknown or other
  misc_feature (308)..(308): n is a, c, g, or t
tcagcgtagactagcacgaccggtgctcgatttagtagtgtagatttgggtttgggactcaacaaccacatctgtcctctagagaaaaccctgtgagcacagctcctcaccatggactggacctggaggatcctcttcgttggtggcagcagactacaaggtcgcccactcccgaggtgcagcgtggtgcagtcgtggggctagaggtagaagaacgcgtacggggcctacgagtacggaagttcctcgtgacgaggtcttcgtaggacttcgtacgttacctaccgtatagtactaccaagtgggtnacgtacgacggtccgacgtacgaacccgaacggtaccggtaggtagggttaggaaggtacggggtacgttacggggaaaccccgtaaacccgttaaaaggtacccttaacggggtacgtaaaccggtaacgtaaacgggtttaccggttaaacccgttacccacccgttaaccggttaacccggacggggtaaacccaagggttaaaccccttacgggtaactaacccgtaacccgtaaccggtaacccgtccctttaaaccccgaaagtttaaaacccgggaacttaccgaaccgttaaactaccgttaagggtacggtttaacggaaggtaaccgccgttaacgaccgttaacgacgtaaccggaaccgaccgaaaccgggttccgtaacgttaccgtaacgtacgttaaccggataaccggtaaccgtaacccgtacggtaacgtaccggggtacaacggttacccgtaaccgaccgtaccggtcggttaaacctttgggaaaccgtttcccggaacggggg

SEQ ID NO: 207683 - DNA, 702 bp, Homo sapiens
  misc_feature: GYAE6OF01C8X7R.17.25.C03.1.454.CMB.1.raw
  modified_base (456)..(456): a, c, t, g, unknown or other
  misc_feature (456)..(456): n is a, c, g, or t
  modified_base (529)..(529): a, c, t, g, unknown or other
  misc_feature (529)..(529): n is a, c, g, or t
  modified_base (555)..(555): a, c, t, g, unknown or other
  misc_feature (555)..(555): n is a, c, g, or t
  modified_base (629)..(629): a, c, t, g, unknown or other
  misc_feature (629)..(629): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtcgcagtctggtgcagtcgtgggctggaggtgaacgaagccgtagggcctgaggtgaacggtcctccgtcgacgaggtcttactggactttcctacgtttcctctatacgtactcaacgtcgggtcgccgacgacggtccgtcgtcggaacgaccgtaccgtggagtaggtacggtagggtcggtaccgggaaccgtaaccgtaacgtcgtcggtacgtacaagtcgttcgtccctacccgacctaccgtcccggtaaccggacctacgtaacccttaaccnggtaacccgtaacccgtaaccgttaccctaaccctaacctaaagtaaacccgacctaacggtacccttaaggngttaaggggtacgtacggacgtaccnccgtaggaacctcgtactaacgggacccggacgtaccggtctttactaacgttggtacggacgtcgacgtaccnccgtacgccgtacgggccgaccgtccgacggtcgtaccgggttccgttacggtctccgggttcgggacccggg

SEQ ID NO: 207684 - DNA, 780 bp, Homo sapiens
  misc_feature: GYAE6OF01AIHFD.17.25.C03.1.454.CMB.1.raw
  modified_base (472)..(472): a, c, t, g, unknown or other
  misc_feature (472)..(472): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctgggaggactccttcttcgttgggtggcagcagctacgagtcgcccactcccgaggtgcgagtcgtggtcgcgaggtcgtggggctggaggtagaaggacggtccggtcggggcctcggagtacggtacggtcctccgtaggacgacggttcttacgtggtacttccgttaaccgtttacctacctagttacgtactaccgtaacgggttcgggtacgccggccggaccgggtacccggtaggtaaccggaacccgtaaccggtcggtagggagggtcggtacgggtacggggtaacggtccggggaaaccccgtaaaccgtacgtacggtcggtctacgtaacggtntccgttacctaccgaaccgtcgtaccggaccggtactacgttacctaccgacgtaccgaacccgtacgtaaccctccgtaactaaccgtaaccacgtacccgtacctaaggtacggtcgggttaacggtacggaccggttaccgtcctaagaccctaacggtttaccaaccgggaccggtacccgtaccgggtttaccttagttaccgttacgggacggtaccggacgtaccggtacccgaccgtacgtccgggttcgaacgcccgtagccggacgtcggttccgttcgttacggccgtgggaccggg

SEQ ID NO: 207685 - DNA, 790 bp, Homo sapiens
  misc_feature: GYAE6OF01B30C1.17.25.C03.1.454.CMB.1.raw
  modified_base (183)..(183): a, c, t, g, unknown or other
  misc_feature (183)..(183): n is a, c, g, or t
tcagcgtagactagcacgaccggtgctcgatttagtagtgtagatttgggtttggggactcaacaaccacatctgtcctctagagaaaaccctgtgagcacagctcctcaccatgactggacctggaggatcctcttcttggtggcagcagctacaagtgcccactcccaggtgcagctggtncagtcgtgggctgaggtgaagagccgtggggcctcaggtgaaggtctcctgcaaggcttcgtaggacttcgacgttttacctccttaagtacgtatctaaccgtggggttacgccggaccgaggtcccgaccgttcgggaacctaaccggtaccgtggtacggttagggacgtggggtaacgttacggggacccgtaaacccgtaaccgacgtcgggtacgtaccgtacgtaggttacgttcccgttaccaccccgtaacgttcccgttaccggggacaccgtaccttaaccgacgtaccggttaacccgaacgtaacccttcccgtacccgaaacttaaacccgactagtacccttaaacgtacggttacgggtaacgtttacgggaaccgggtactccggtttaaccgaacgtacgttaccgtaacgtaaccggacccggtaccgggtacccgttaacgttaacgtttaccgtaggtcggaaccggtacggtacccggttcccctaaaccgggacgttacccggggttaacgaccggttacccggtaacccggacggtaacggtccccggttaccgtttacggaccggtttccggtaccgggggg

SEQ ID NO: 207686 - DNA, 692 bp, Homo sapiens
  misc_feature: GYAE6OF01DU4B1.17.25.C03.1.454.CMB.1.raw
  modified_base (177)..(177): a, c, t, g, unknown or other
  misc_feature (177)..(177): n is a, c, g, or t
  modified_base (262)..(262): a, c, t, g, unknown or other
  misc_feature (262)..(262): n is a, c, g, or t
  modified_base (514)..(514): a, c, t, g, unknown or other
  misc_feature (514)..(514): n is a, c, g, or t
  modified_base (586)..(586): a, c, t, g, unknown or other
  misc_feature (586)..(586): n is a, c, g, or t
tcagcgtagactagcacgaccggtgctcgatttagtagtgtagatttgggtttggggacgtcaacaaccacatctgtcctctagagaaaaccctgtgagcacacgctcctcaccatggactggacctggaggatcctcttcttggtggcagcagctacaagtcgcccactccaggtncagctggtgccagtcgtgggctggaggtggaacgaagcccgtaggggcctcaggtgtaaggtcctccgtggactaaggtcctttntgggtacttccgtaaccgttttacctaccttaagttattactacaagttcgggtcgaccggtccgacggtacccggtcgtacggaaccgtaaccgtaccgtaggtacggtaggagttacggggaacgtacgggacccgtaacctaacgtacgtaggttcgtactacgtagtctccctcaaccctcgtcccgtaccggatacgtaccttaccagtacacctacgaacctccacctaataacagaactcctaanatgggtattaggacgtagcctacgactacgtacgccgtaacgacctcgggttacccttacttacgttaacgnggttacgacgtaccgggtaacctacccggacctacgggtacccggtagaccggttaccgacggaccttaggtcccgttacccgttgttaccgtcgggtacccgggg

SEQ ID NO: 207687 - DNA, 761 bp, Homo sapiens
  misc_feature: GYAE6OF01AXB86.17.25.C03.1.454.CMB.1.raw
  modified_base (313)..(313): a, c, t, g, unknown or other
  misc_feature (313)..(313): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcaggtcgtggggctggaggtgaagaagccgtggggcctcgaggtgaacggtcctccgtgcgaaggtcttcgtggtattcctaacgtttacctccttatagtactctaacgtgggtgccgcgaggcccgngtacggaccaacgcgtgacgtggacgtgggtagtcgggaccgtaaacccgtaaacgacgtcgggttcgtacgaacgtagttcgttaccgttacccaaccccgtacgttcccgttaccgggggaacctacggttaaccctttaacccgacgttaaccggaaccccgtaaccgtaacccttacccgtaacctaacttaaaacccacgtaacgtaccctaaacgtacgtacggtacggtttacggaacgggttacacccgttaggtaacctacgttccgtaacgtaaccgaacccgaccgggttacccgttaccgttactttacggtcgttaggaccggtaacgtccggtaaccccgaggtaccgttaccggggtacgtaccggtaccccgtacgggtccgtacggtcccgggttacccttttcggaaccggtttcgggtaacccgggggg

SEQ ID NO: 207688 - DNA, 675 bp, Homo sapiens
  misc_feature: GYAE6OF01AR2HC.17.25.C03.1.454.CMB.1.raw
  modified_base (156)..(156): a, c, t, g, unknown or other
  misc_feature (156)..(156): n is a, c, g, or t
  modified_base (243)..(243): a, c, t, g, unknown or other
  misc_feature (243)..(243): n is a, c, g, or t
  modified_base (278)..(278): a, c, t, g, unknown or other
  misc_feature (278)..(278): n is a, c, g, or t
  modified_base (410)..(410): a, c, t, g, unknown or other
  misc_feature (410)..(410): n is a, c, g, or t
  modified_base (457)..(457): a, c, t, g, unknown or other
  misc_feature (457)..(457): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtgcagcagctanagtcgcccactcccaggtgcagctggtgcagtcgtggggacttaggaggtagaagaaggccgtaggggcctcgagtgacgtcctccngacaggtcttgaggttacttcctaaccgtttaccnctaagtagtactacgaacggttgggtcacgaccgacggccgacgttacggaacctaacggccgttggacggtaggacgtagggagtacgggaacccaaaccctaggttaccgtggtacctacgacgtagttntaccctacccacgtacgttcccggtacggactaccggttacctaccncgtaaccgacccaaccgtaccctacctaccaactaacactaccgaccgtagacgtaggtagtacgacgtacctactacgactacgtcgtacgaaccggtacacccggttacttagtaacttacgacgtcgacgtacgaaccgtccgacggtccgtacggaccgcggtacccgacggtaccgcggtttaccgtcgtttacggtccgttccgggaccggg

SEQ ID NO: 207689 - DNA, 893 bp, Homo sapiens
  misc_feature: GYAE6OF01APOC5.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatccttcttcgttggtggccagcagctacgaagtcgcccactcccaggtgcagcctggtgctaggtcgtcggggcgttaggaggtaggaacggaacgtccggtcgggggtcctcgtaggtacggtaacgggtcctaccggtcgtacgaacgggttctttccggtaggttacttaccgttaaaccggttttacccgttaccttaagttacgttaacgttaaccgtaacgggtcggggttacggacccgaccggtacggggtacccggtacgggttaacggaacccggaaaccggttaacccggttaggggtaaccgggtaggggtacggggtttaacggggtaagggtaccccggggtaaacccggaaaaccccttaacgggttaccgggtacgggttactaaccgtacggttaaccggttgtttacccgttaacccgaaccccgttacggtccccgtaacggggtaccctaaacggttacccttaccggactacccgaaaccccgtaacgtaaccctacccgtaaaccgtaactaaaccgaaccgtaaccgtacccgtaacgaacgttaggtaacggttcgaaggtaccgtacctaacgtcgttaaccgcgtacgaaccggtactaccggtacccttacgtacttacgtaggtaccggagtaccgtacccgtaccgacgtaccggttacggacggtcccgttacccgggacgtaccggtacggtacccgttacggttcccggtccggtaccgggtacccgggg

SEQ ID NO: 207690 - DNA, 807 bp, Homo sapiens
  misc_feature: GYAE6OF01CBFYG.17.25.C03.1.454.CMB.1.raw
  modified_base (204)..(204): a, c, t, g, unknown or other
  misc_feature (204)..(204): n is a, c, g, or t
  modified_base (414)..(414): a, c, t, g, unknown or other
  misc_feature (414)..(414): n is a, c, g, or t
tcagcgtagactagcacgaccggtgctcgatttagtagtgtagatttgggtttggggactcaacaaccacatctgtcctctagagaaaaccctgtgagcacagcctcctcaccatggactggacctggagatctcttcttggtgcagcagctacgaagtcgcccacctcccgaggtgcaggtcgtggtgctaggtcggtggggntggaggtaggaacggacgtccggtcggggcctcgaggtaggtaacggtcctccgtcggacgtaacggtctttacgtcggtacttaccgttacccgttttaccctaccttagttaaccgtaagttaccgtaacggttcggggcgaccggaccggtacggggtacccgtcggtaaccggaacccgaaccggtaccgtaggtacgggtagggnggtagggtaagtaccggggaacctaaacccgtaggtaccggtggtcgacgtacgtaggttctaccttaccgaccaccggtacccggtacggaacctaccgtaacccttaccgtaacgtacccggtaacctacccgttaacccaccttaccgaaaaacctacctaaccgtacccgtaactaggtacgttagggtaacgtaggaaccggtacgtacccgtagtaaccgtaccttacggaccgtaaccggacccggttacccggggtacccttttaggacgtttaaccggcggttcggaacccggttagtacccgtacccggtaacggtccggttaccgggacgtacgaccgacggctcgggaaccgtttggtaccgtcggggttccgggtacggg

SEQ ID NO: 207691 - DNA, 787 bp, Homo sapiens
  misc_feature: GYAE6OF01CUA44.17.25.C03.1.454.CMB.1.raw
  modified_base (271)..(271): a, c, t, g, unknown or other
  misc_feature (271)..(271): n is a, c, g, or t
  modified_base (298)..(298): a, c, t, g, unknown or other
  misc_feature (298)..(298): n is a, c, g, or t
tcagcgtagactagcacgaccggtgctcgatttagtagtgtagatttgggtttgggactcaacaaccacatctgtccctctagacgaaaccctgtgagcacagctcctcaccagtggactggacctggaggacttccttcttcgttggtggcagcagctacagtcgccctactcccgaggtgctgcgtggtgcctggtcgtggggctaggaggtagaacgacgccggtcggggtaccttgaggttcggacggtcctcgtagcaggtcttgngtacttcgtacgtttcctctagtactntaccgagtggtcgaccgcgacggcctacggcgaaccgacgcgtaggcggtaggacgttgggaacgtcgggtaacccgaaaccgtacgacgtgtacgtacctgacgtttcctaccttaccgaaccccgtcgttaccgacccgggtctaaacgttccgttaactacggtaccgaacccgaccgttaaccgtaccgtaccctaacaacctaaccgacgtaaccctacgtaacggtcgggtaacgttaggaacggtacctacgtaacgtacgtacgtttaccgggacgtaacccggtaccccggaccggttaacccgtttaccgtttaacgttaccggttacggaacccgggtaagttaacccggtacccggtacccgaaacggtttcccgggttaccgggaacggtaccccggttccggggacccggttaaacgtcccccgggtttacggtagttttcccccggttaaggggttccccgggtaaacgggggg

SEQ ID NO: 207692 - DNA, 865 bp, Homo sapiens
  misc_feature: GYAE6OF01CX63Z.17.25.C03.1.454.CMB.1.raw
  modified_base (188)..(188): a, c, t, g, unknown or other
  misc_feature (188)..(188): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttgggtggcagcagctacaagtcgcccactcccgaggtgcagtctggtnctagtccggtggggctaggaggtggaagacggtcccgtggggtcctcgaggtaggaacggtcctccgtgacgtaacggtctttcgtacgggtactttccgttaccgtttacccttacctaagttaacgttataccgtaacggtttgggccgtccggaccgacgggtcccgtacgacggtaacctaaccggtaccgtaggtacgggtgggtaggtacggggtacggtacggggtaacccctaaaccccgtaacggtaccggttcgggtacctaccgtaacgtaccggttcgttaaccgtacccgtaacccccgttacggtacccccgggttaaccgggaccttaaccggttaaacccttaccggtaacgtacccggaacccgaaccgttaacccctaccccttaaccgaaacttaaacccgaactacccgtactaacgtaccggttaggtacggtaacggacggtaccgtacgtaacgtactaacgttcgaaccggaccgaacccggtaccggtcccttactttacggtaccgttgaccggtaaccggtacgtacccggtaaccccggtagttaacccgggtcgggttaacccgacggttaccccgggtaacggtcccggtaacccggggttacctttaacccggttacgggtcccgggttttcggggaacccggggg

SEQ ID NO: 207693 - DNA, 731 bp, Homo sapiens
  misc_feature: GYAE6OF01EU4VY.17.25.C03.1.454.CMB.1.raw
  modified_base (183)..(183): a, c, t, g, unknown or other
  misc_feature (183)..(183): n is a, c, g, or t
  modified_base (186)..(186): a, c, t, g, unknown or other
  misc_feature (186)..(186): n is a, c, g, or t
  modified_base (195)..(195): a, c, t, g, unknown or other
  misc_feature (195)..(195): n is a, c, g, or t
tcagcgtagactagcacgaccggtgctcgatttagtagtgtagatttgggtttggggactcaacaaccacatctgtcctctagagaaaaccctgtgagcacagctcctcaccatggacctggacctggaggatcctcttcgttggtggcagcagctacagtgcccactccaggtgcagctggngcngtcgtgggntgaggtgaagacgcgtgggcctcgagtggaaggtctccgtgacgaaggtctttcgtggtacttactaccgtttacctcctaatagtactacaacgtggtgccgaccgtacggccgtcgtacggaacgtaaaccgtccggtaggtacggtagggagtaggggtagtacggggtaccgtaaaccccttaacgacgtgggtactaccgacgtacgttcgtccttaccacccgtcgtacccgtccgggaaatacgtaacctaccgactaccgaacctaaccgtaccttcccaacaactaaaccacacgtacctaagtagtggtaagttacgaggtcgtaccgtagaacctcgtacgaccggtaaccggaaccgtacccggttccgttaacctttacgtttacgtacgggtaccggaaccggtaccggttaaacccgtacccgtaacgggttaccgtacccgggttacggcggtacccggtacgggacgtaccgggtcccgtttaaccgtttcgggttaacccgtccggggtacccggggg

SEQ ID NO: 207694 - DNA, 766 bp, Homo sapiens
  misc_feature: GYAE6OF01AJBV3.17.25.C03.1.454.CMB.1.raw
  modified_base (231)..(231): a, c, t, g, unknown or other
  misc_feature (231)..(231): n is a, c, g, or t
  modified_base (546)..(546): a, c, t, g, unknown or other
  misc_feature (546)..(546): n is a, c, g, or t
tcagcgtagactagcacgaccggtgctcgatttagtagtgtagatttgggtttggggactcaacaaccacatctgtcctctagagaaacctgtgagcacagctcctcaccagtggactggacctggaggtactccttcttcttggtggcagcagctacgagtcgcccactccaggtgcagctggtgcagtcgtgggctggaggtgaagagccgtggtcctcggtgaggtcnccgtgacgtagtcttacgtgggacgcctaccttcgagccgtaaccttagtttacgtttacgtaacgtttcggggtcggaccgggtacgggtcccctacgtccgggaactaaccggggtcccgtttaggaggttcgggaaggtaggggaacggtactcccgggttacctaggttcggttacgaccaaccgaaacctaaacgtcggactaacgaggtaaccgttacggacggactacggaccttacgaaccacgtaacccggacgaactaaacgtaacgaactaagtacgttactcggtagacgtacaacggtaacncgtaccgttacgacgtacgtagtaacggacgggaaccgttaccgggttacctttacgtttaaccggttcgtaccggtaggtaccggtaaggttaaacccgttaaggtttacctaaacttaaccgtacttccggtttaccttttaccccgtttacttacccctttacccgttacgtttacccgttccgggtaacgttccccggtccggtttaaacccccgg

SEQ ID NO: 207695 - DNA, 997 bp, Homo sapiens
  misc_feature: GYAE6OF01DYL1W.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccagtggactggacctggagatcctcttcgttggtggcagcagctacgaagtcgcccacctcccgaggtgcagcgtggtgcagtcggtggggcctaggacgggtagaacggaacggtccggtcggggtccctacgaaggtacggtaacggttcctacccgtacggaccgtaacggttccgtttacgtacggttacgtttaccgttacccgttttacctaccgttaagttaacgttaccttaccgtaacgggttcggggttccgccccggaccgaccggggtcccgtacgggtaacggaacccgtaaccgtaccggtgggtacggtacgggtaggtacggggtacggtaccgggaaaccccttaaccccggtacgtaccggttgtaccgtaacgtacgttacgttccgtaccccctacgtaacccgtacccgttacccggaccgtaaccgtacgtacccttaaccgacgaccccgtaaaccgtacccgtaacccgttacctaaccgtaaaccgttaaccaacccgtacccgtaacccgtaacggttaggttacgggtaaccgggtttacggaaccgggttaccgtccccgtaagtaaccgttacccgggttaaccggaacccggttaaaccccggaccccgggtttaaccggtttaccccgtttaaaccggttttacggttaaccggtccggggttaaaacccgggacccggttaaacccgggttaacccccggaccccgggttaacggtttaccccggggtaccccggggtacggtaacccccgggttacccccgggtaaccgggtaacccgggtcccggggttttaaccccgtttaccccgggttttaccccggggttaacggtttccccgggggaacccgggggg

SEQ ID NO: 207696 - DNA, 882 bp, Homo sapiens
  misc_feature: GYAE6OF01BR445.17.25.C03.1.454.CMB.1.raw
  modified_base (175)..(175): a, c, t, g, unknown or other
  misc_feature (175)..(175): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtncagctggtgcgagtcgtggggctgaggtgaagagcgtggggcctcgagtgaacggtctccgtgacgaaggtcttcgtaggtattaccgtacgttttaccctccttagtaacgttactaccgtaacgtggggtacgtcccgggcccggggtccgtaccgttacgggaaacccaaccgggtaaccccgttgggtaacgggttaggggtaacggttcgggggggtaacgttaccggggggaacccggtaaaaccccccgttaaaacggttaccggtttacgggggttaccgtaaccggtaacggttaagggttccgttaccccgtttaccccgaaccctaaccccgggttcccggttaaccccgggggtaacctaacccgggttaaacccttaaaccccggtaacggttaacccgtaaccccgtaaacccgtaaacccgtttacccccctaaacctaaaaccggttaaaacccaaccgtaacccggtacccttaacgtaacggtacgggttaacgttacggggaaaccggtacgtccccgtaaggaacgtacgtaccgtaggaacccgtaccggacccggttaccgttacgttaacgtttcgtacggtaccgacggtaagaccccggttccaaaccggtcggtccggtagaccgtccggacccgcgacggtcccggttacgtttaccggaccgttcgggtcgggacccgg

SEQ ID NO: 207697 - DNA, 759 bp, Homo sapiens
  misc_feature: GYAE6OF01ACU2L.17.25.C03.1.454.CMB.1.raw
  modified_base (157)..(157): a, c, t, g, unknown or other
  misc_feature (157)..(157): n is a, c, g, or t
  modified_base (162)..(162): a, c, t, g, unknown or other
  misc_feature (162)..(162): n is a, c, g, or t
  modified_base (175)..(175): a, c, t, g, unknown or other
  misc_feature (175)..(175): n is a, c, g, or t
  modified_base (197)..(197): a, c, t, g, unknown or other
  misc_feature (197)..(197): n is a, c, g, or t
  modified_base (547)..(547): a, c, t, g, unknown or other
  misc_feature (547)..(547): n is a, c, g, or t
  modified_base (667)..(667): a, c, t, g, unknown or other
  misc_feature (667)..(667): n is a, c, g, or t
  modified_base (683)..(683): a, c, t, g, unknown or other
  misc_feature (683)..(683): n is a, c, g, or t
tcagcgtagactagcacgaccggtgctcgatttagtagtgtagatttgggtttgggactcaacaaccacatctgtcctctagagaaaccctgtgagcacagctcctcacctagtcggactggacctggagtactctcttcgtggtcgcagcagctanagtcncccatccgaggtnacagtcgtggtgacacggtcgnggggtactgggtaggagaaacggacggccgtaggggtcctagtaggtaggaacggtctacgacgtaccgtaaggttccgttacgtcggttaccttaccgttaaccggttttaccctaacggttactaacgtacgtaaccgtaacggttacgggtccgaccgaacccggtaaccgggacccggtaccgttacggaaaccgtaaccggtaccggtagggtaaccgggttagggtaacgtacgggggggggaaaccttaccggggtaaccctaaaacccgttaccgtaacggtggtaccgtacgtaaccgtaacgtgtccttaccgtaccgtacgtacccgtaacccggtaanaccggtaacttaacgaccttaccggaacctaaccgtacctacccgtaactaacgtaaccaactccggtaacgtagaagtcggtagtacgcgactcggatacgcctgagaacgtcgacgtncgtagtcagcgtacgngtaccgagtacgtacggtacgcgttacgccgtaacggccgttaacgccgtagttcggtaaccgtcgggtacccggg

SEQ ID NO: 207698 - DNA, 799 bp, Homo sapiens
  misc_feature: GYAE6OF01CZ7WL.17.25.C03.1.454.CMB.1.raw
  modified_base (125)..(125): a, c, t, g, unknown or other
  misc_feature (125)..(125): n is a, c, g, or t
tcagcgtagactagcacgaccggtgctcgatttagtagtgtagatttgggtttggggactcaacaaccacatctgtcctctagagaaaaccctgtgagcacagctcctcaccatggactggaccnggaggatcctcttctggtggcagcagctacaagtcgcccactcccaggtgcagctggtgcaggtcgtggggctggaggtgaaagacggccgtgggggcctcgagtgaacggtcctccgtgacaaggtcttcgtggtattacctacgtttaacctcctaattaagtactacgaacgttggggtcgccgtaccgacggccgcgttacggaaccgaacgaccgtggaacggtcgggaagttcggggaacgttcggggaaccgaaaccccgttaacgaaccgttgggtacgttacctaacgacggtttcgtcctttaccgaaccctacgttaccccggtaccggggaactaaccggtaacctttaccgaacggtaccgtaacccgaaaccgtaaccctacccgtaaccaaaccgttaaaccaacccgacgtaacctaaacacgggttacggtaagttaggaacggtaccgtccgttaagaaccgtaacttccgggacgaccggaaccgtacccgggttccggttactttaaccggtttacgtacgggtaccgtacggtaaacggtaccgttaccccgaacgggttcctaaccgggtggtaaacggccccggttaaacggcccggaacgggttacccggtcccgtttttaggccccggtttcgggggtaacccgggggg

SEQ ID NO: 207699 - DNA, 766 bp, Homo sapiens
  misc_feature: GYAE6OF01ACLPS.17.25.C03.1.454.CMB.1.raw
  modified_base (108)..(108): a, c, t, g, unknown or other
  misc_feature (108)..(108): n is a, c, g, or t
  modified_base (193)..(193): a, c, t, g, unknown or other
  misc_feature (193)..(193): n is a, c, g, or t
  modified_base (255)..(255): a, c, t, g, unknown or other
  misc_feature (255)..(255): n is a, c, g, or t
  modified_base (323)..(323): a, c, t, g, unknown or other
  misc_feature (323)..(323): n is a, c, g, or t
tcagcgtagactagcacgaccggtgctcgatttagtagtgtagatttgggtttggggactcaacaaccacatctgtcctctagagaaaccctgtgagcacagcctccnaccatggactggacctggaggactccttcttcgttggtggcaggcagtcctagaagtcgcccactcccgaggtcgcagctaggtncaggtcgtagggctggaggtagaaggacggccgtacgggtcctaggagtcgaggtctaccgngaccgtaggtcttcgtaggttacttacctaccggtttcctacttagtacgtataccgacgggttggcnccggaccgaggtcccgtagaccggtaacaaccggtaccgtgggaacggttcgggtagtacggggacgtacgggaacccgttaaacctagtaccggttggtactacgtacgttcgttacgtcctaccacccggttcgacccggttacgggaaccacgtaccccttaacggaccgttaccgtaacccgtaaccggtaacccttacccgaaaccttaaccgtaaccgtacccgtaaccgtaccgtaacggtaacggtacgggtacgttacgggaccggtaccgtaccgtacgtactaccgtttaacgcggtaaccggtcccgacggttacccgttacgttacgtacgtcggtacgaccgtaggtacccacggtcgtaccggtacggacgtaccgtaccgacggtacgtaccggttccgtaaccggttcgtccgggtcggtaaccgg

SEQ ID NO: 207700 - DNA, 735 bp, Homo sapiens
  misc_feature: GYAE6OF01D6JU7.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctgggcctcctgctactctggctccgagctcgccagatgtagacactaccgagatcgacccagtcctccactcctcctgtctcgcctctggtggggtcagacgtccaccactctacttcgacccggtacaacgtcgtaaccgggtaacctttaaaaccttaagttttaaacgttacggttaatcctacgtacgaaccgtaaacccgtaaggaaaacccgcccaacgtaacccttcgtacgttactccgtcgttacgggtcgactaaccgttcccaaccttcgtacgacgtaacggtcgtaccctaccgtacgtcggtacggttccgtaaggtcggtaacgtaggtaggtacgtcggtaccggtacacggttacttaccgtaacgtctaaccactacgtacccacccgtacctctacgtaccgtactacggtacgtagttacgtactaaccacgttacctacctacgttacgtaaccaacgtacggtaacttacccgttacccgttacccgtccgttaccttaccggttaccggaaccggtaacgggtaacccgtaagtacgtaacgacgttaacgtaacggtctaggtctaccgtctaaccgtaccgtacttccgttcgtaccccg

SEQ ID NO: 207701 - DNA, 695 bp, Homo sapiens
  misc_feature: GYAE6OF01EYJZR.17.25.C03.1.454.CMB.1.raw
  modified_base (404)..(404): a, c, t, g, unknown or other
  misc_feature (404)..(404): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctgaggtgaagacgccgtggggctatcgagtcgtacgtcgtcctccgtgacaacggccagtggattagtactcttacaactaaatagtaggttataggtaagttgggtacgacggtaccggaccgggacccccggaaggaacgggtccgttagggagggttagggggtgggtgggtcgaggtcggtcgttaggacggtagcacgagtanacgacgaacgaagagtagggaggacgaggtacgtaccgaacgttaaccgtaaccccggaacccggaaccccaaccccccggaaacgtaaaccctaaccgtaacgtaccttaaccgcgtacgaacctaacgtacggaccgacgtaccggtgagaccgtacgacgaacccgtaccgaccggtaccttacgttaacgtcgtaggtacggtaccgtaaggttacgttttcgtttactacgttctacgttaacttaacgttaacgttacggaacttacggtccttaagttaccggg

SEQ ID NO: 207702 - DNA, 711 bp, Homo sapiens
  misc_feature: GYAE6OF01BQIG6.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatcgacccagtctccactccctccctgtctcgcctcgtggtcgggggtcagtagtccaccatctacttgacccggacaacgtccgaccggtaacgtttaaaacctattttaaacgttggtatcgagacgaacgaaaccgtaggaaaaccgccccaagaccctcctagacttccgtcgtggtcgacctactcccctacttcgtacggacgtaacggtcggtcccgtaccctagtcggtacggttcagggtcggcgtaggtaggtacgtcggtaggactagttactttacaactcctacaacctactaccctaccacgttccgtacgaccctaacggtggacgttgttgtacgactaactcgtaacctacgtacgtaacgtaacgtacggttaaccttaccgtcccgttccccgtcttacccgtttaccgggtttaccggaaccggtaaccggggtaaactaaacgggttcgtaaacgtaacccgttaaacgaaaccggttacgtacggtacggaccgtacgtacccgtaaacttcgttaccgttcggtttaaccccg

SEQ ID NO: 207703 - DNA, 762 bp, Homo sapiens
  misc_feature: GYAE6OF01AH53Y.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggagggtgaagaagccgtggggcctcagtgaaggtctcctgcaggtcttctggacttcacgtttacctcctatagtatcaacgtgggtcgccgccgacggccgcgtcggaacaacggacctggaggtggagtgggagtcggggaccgtaaacccgtacgacgttgggtcgtaccacgtaggttcgttcccttaccgaacccccttacgttccccggtacccggggtaacctaacggtaccctttaacccgacgttaccgaaacccgtacccgtaaccctaccccttacctaaaactaaacccaaccctaacggtacccctaaacgtacgttaggggtagtttacgggacggtacgtcccgttacgaacctagttcccggtacggaacccggtaccggacccgggttacccggttactttacggtttaacgtcggtacggaccggtacggtaccccggtccccgtacgggtacccgttcccggggacgtacccgggtcccggtaaccgggacgtccggggtacccggttccgttttacgggtcccgtttccgggggtacccggggg

SEQ ID NO: 207704 - DNA, 844 bp, Homo sapiens
  misc_feature: GYAE6OF01E2816.17.25.C03.1.454.CMB.1.raw
tcagcgtagactagcacgaccggtgctcgatttagtagtgtagatttgggtttgggagtcagtctcagtcaggacacagcatggacatggacgggtccccgctcagctccgtggggcctcctgctactcgtggctccgagctgccagatgtgacatccagatcgaccagtcctccactccctcctgtctgccttcgtgggtggggtacagacgtaccacctatcctacgttcggaccggaactaacgtccgtaaccggttaaaccgtttaaaaaccttaagtttttaaacgttggtaactacgaacgtaaccgtaaacggtaaaacccgtaagggaaaaacccgtccccctaacgggtaccccttccggttaagtaccgtttccgtaccgggttgggtaccgtaccctaaccgtaccccgtaacgtttacggtaccggtaacgggttaaacgggtcccggtacccgttaccgtaacggttaccggttacggttacgagggttacgggacgttaaggtcggtacttcgggtaagggaacctaggttacctttacgaacctttccaaccgtaaccgtactacccctaacctccgttacaaccggttaaccctaaaccgggtggtaaacggttacttacggtaccgtaaccttaacttaccgttacctaagtacgtaacgtaaacgtcggttaaccttacccggtaccctttccgaccgttactttacccgggttaagacccggtaacgggtaaccttacgggtacaaacgttaaccgtaaccgtaaaggtccggttcggtaacgcccgttaaggtaccctaacctttcggtttcccgctttacccg

SEQ ID NO: 207705 - DNA, 659 bp, Homo sapiens
  misc_feature: GYAE6OF01BWJQS.17.25.C03.1.454.CMB.1.raw
  modified_base (317)..(317): a, c, t, g, unknown or other
  misc_feature (317)..(317): n is a, c, g, or t
  modified_base (373)..(373): a, c, t, g, unknown or other
  misc_feature (373)..(373): n is a, c, g, or t
  modified_base (470)..(470): a, c, t, g, unknown or other
  misc_feature (470)..(470): n is a, c, g, or t
  modified_base (502)..(502): a, c, t, g, unknown or other
  misc_feature (502)..(502): n is a, c, g, or t
  modified_base (511)..(511): a, c, t, g, unknown or other
  misc_feature (511)..(511): n is a, c, g, or t
tcagcgtagactagcacgaccggtgctcgattttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgctaggtcgtggggctggaggtgaagagccgtggggcctcgagtgaaggtcctccgtgacaggtcttcgtggtacttctaccgttttacctcctattagtatacgtaacgtgggtcgccgccgtagggcccncgtacgaacaaccgaccgtggaggtggtagtagggagtgggaccgaaaccctaacncgttggtcgtacgactagttcgtcttaccaccctactcccggtaccgggactacgtacttaccattacgaccaccgacctaccctacaactaaaccncacgacctacacggttagtagtaggacggacncgtacgacngtcgagaccgtaccgaccgggttacctattacgttacgtcggtacggcgtacggtaccgtacccgacgtacggtacgggtaccgtccggacccggtacggccgtacgggccggttacccggtttcgtaccggttcgggtaccgggggg

SEQ ID NO: 207706 - DNA, 879 bp, Homo sapiens
  misc_feature: GYAE6OF01ED0PM.17.25.C03.1.454.CMB.1.raw
  modified_base (256)..(256): a, c, t, g, unknown or other
  misc_feature (256)..(256): n is a, c, g, or t
tcagcgtagactagcacgaccggtgctcgatttagtagtgtagatttgggtttgggactcaacaaccacatctgtcctctagagaaaaccctgtgagcacagctcctcaccatggactggacctggaggactcctcttcgttggtggcagcagctacaagtgcccactcccaggtgcagctggtgcagtcgtggggctggaggtgaagagccgtcggggcctcgagtgaaggtctccgtgcaggtcttcgtaggtnttctacgtttacctctatacgtatcgaacgttgggtcgccgtccgacggccgcgtggaaccgaaccgtacctggacggtggagttcgggaggtcgggaacctaaccccgtaacgacgttggtacgtaccagtacgtcgtaccttaccgaccccgtacgtccccggtaccgggaactaacgtaacccgttaaacctagtaacccggtaaaccccaaccggtaacccttccctaaaccgtaaaccttaaaacgaccccgttaacgtaccctaaacggtaaccggttagggggtaaccgtttacggggaaccgggtacccgtacccgtaaccggtaaaccgttcgttaacccgtaaccgggtaaccccggtaaacccggtcccccggggttaaccgggttaacccttttaacggtttaaacccggtttcgggtaaccgggtacccgggtaaaccgggtttcccccgtaaaccccccgggttaacggggtaccccgttaccgggggcccggtaaacccggttacccccccggggtaccgggtaaacccggttcccggggggttaccctttacccccgggttttttaaccggtaccggggttttcccccggggtaaacccgggggggg

SEQ ID NO: 207707 - DNA, 807 bp, Homo sapiens
  misc_feature: GYAE6OF01ED33Q.17.25.C03.1.454.CMB.1.raw
  modified_base (148)..(148): a, c, t, g, unknown or other
  misc_feature (148)..(148): n is a, c, g, or t
  modified_base (171)..(171): a, c, t, g, unknown or other
  misc_feature (171)..(171): n is a, c, g, or t
  modified_base (708)..(708): a, c, t, g, unknown or other
  misc_feature (708)..(708): n is a, c, g, or t
tcagcgtagactagcacgaccggtgctcgatttagtagtgtagatttgggtttggggactcaacaaccacatctgtcctctagagaaaccctgtgagcacagctcctcaccagtgactggcctggagatcctcttcgttggtgcagcngctagagtcgcccactccaggtncagtcgtggtacgcacgttcggtgggcttaggagggtagaaaggtcgccggtcggggtccttacgaaggtggtaaacggttcctaccgtggtaccgaagggttccttacgtagtacgtttacgttaaccgttttaccctacttactagtacttacgaacggttgggtcacccggccggtaacggggtccctaggttccggaaaccgtaaccgtccggttaggaggttacggggaagggttcgggtacggtaacccgggaaaccgttaaaccccgttaaagacccgggttggttaccgtaccgagttaacgttcccggttaaccttccccgaaaccgttaaccgggttccccgtaaaccggggactaaacggttaacccttaaccgattacccgggtaaacccacgttaaaccccgtttcccaaccgaaacgttaaaacccactacgtaacccttaaacgaggttcggtaacggttcggaaggtaccgtacgtacgtaccgtatccggtaaacgccgaaccggttcccgtaacgtttntacgtttacgcggtacgtaacggacgtaccgaccgtcgacgtcgggtcaaccggtacgttaccggccgttcgtacctcggttatccggtgggtaccggg

SEQ ID NO: 207708 - DNA, 830 bp, Homo sapiens
  misc_feature: GYAE6OF01D0NO4.17.25.C03.1.454.CMB.1.raw
  modified_base (526)..(526): a, c, t, g, unknown or other
  misc_feature (526)..(526): n is a, c, g, or t
tcagcgtagactagcacgaccggtgctcgatttagtagtgtagatttgggtttggggactcaacaaccacatctgtcctctagagaaaaccctgtgagcacagctcctacaccatggactggacctggagacttcctctttcgttcggtggcagcacgctacaagtcgaccccacctcccgaggtcgacagtccgtggttcggacgtacggttccggtagggggcttgggaagggtacgaaacgggtaacggtcccggtcggggggtcccttacggaggttaagggtaacgggttcctccgttaggaccgtaaggtccgttcgttagggtactttacctaacccggtttttaccccttaccgttaagttaacggttacgttaaccgtaacggttcggggtacccgaccggaccggtaccgggccgtacggtacggtaaccgaaccggtacgtagggtacgttagggtaggtacgggtacggttaccgggaacccgtaacccgttaacgtacgggtaggtaccgtanaccgtacggttgttacccttaccaacccgtcgtccggtaacccgggactaaaccgttaccctacgtaccgtaccgtaaccaaccgttaaccctacccgttaacccaaacttaaaccaccgttaacgacccttaagtacggtagttagtacggagtacctcgtacgatgtacgtacggaaccgaccggtacggttcccgtaattaccggttactacggtcgacgtaacggcccttaaccgacgtaccgggtcgaacggtcgtaccgtcgaacggtcgtaccgttacgttctcggttcgggccggg

SEQ ID NO: 207709 - DNA, 744 bp, Homo sapiens
  misc_feature: GYAE6OF01BNBUX.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttgggtggcagcagctacaagtcgcccactcccgaggtgcagcgtggtgcagtcgtggggctggaggtagaagacgccgtggggcctcgagtgaggtctccgtgcgaaggtcttcgtggtactttaccgtacccgttttaccctaccgttaagtacttaactaccgtaacggttcgggggttcgccggtaccccgacgggtcccggacgtacgggtaacccgaacgtacccgttgggaggtcgggtaggtacggggtagtaccggggaacccgtaaaccccgtaaccgacggttggtaccgtcgaacggtcgttacggttccctaccgacccctaccgttcccggtacccgggtaaccggtacccttaaccgacgtacccgaacccgaacccgtacccttccctaaccgtaaactaactaacccgacgtacctagaacgttcggtaaggtacgcggacgtccgtgacacgtaccgcgaacgaccgtcggtaccttcttagttcgtcgtacgacgtacgtacgtacccgacggtcgtccgggtacaccggttccgacgccgtaacggtccggttacgttgtaccggtttccgggcgggtacccggg

SEQ ID NO: 207710 - DNA, 751 bp, Homo sapiens
  misc_feature: GYAE6OF01EFENH.17.25.C03.1.454.CMB.1.raw
  modified_base (583)..(583): a, c, t, g, unknown or other
  misc_feature (583)..(583): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggagatcctcttcttggtggcagcagctacaagtcgcccacctcccgaggtgacagcgtgggtgcgtagtcgtggggcgtggaggtagaaagaggccgtcggggcctacgaggtaggacggtcctccgtggacgtaggtcctttgtaggttacttccgttaccgtttacccgttaccttaagttacgttactaccgaacggttcggggtcgaccgtaccggacgggcccgtacggtaaccggaaccgaacccggtaccgtaggtacgggtaggacgggaggggtacgtacgggacccgtaaacccgtacggtcgttacggtgtaccagtacgttcgtcctacccgtaccctaccgtacccgaccgggaacctactaaccgtacactaccggaaccctaccgttaaccctccaacctaaataaccactaccgactacgagtaccgggtagtacgacgntaccgtactactcgtacaaccggaccggtaccggtaccgtcgtttactacttcgtggtacgaacgtccggtaccgaacccgtacggtcggtaccggtcggacccggaccgggtaccggacgtccggggtccgtttaccggtttacgttcccgggtcggggacccgggg

SEQ ID NO: 207711 - DNA, 848 bp, Homo sapiens
  misc_feature: GYAE6OF01DN2O6.17.25.C03.1.454.CMB.1.raw
tcagcgtagactagcacgaccggtgctcgatttagtagtgtagatttgggtttggggactcaaacaaccacatctgtcctctagagaaaaccctgtgagcacagctcctcaccatggactggacctggaggatcctcttcgttggtggcaggcagctacaagtcgcccactcccgaggtgcagcgtggtgcagtcgtgggcgtggaggtagaagaacgccgtggggtcctcgaggtgacggttctcgtcgacgaacggtcttcgtggtacttcctaccgttttacctacttaagttagtacttaccgtaacggttgggtacgccgaccgtacgggccctacggttacgaaccgaaccggtaccgtagggagtggggtagtacggggtagtaccgggaacccgtaaacccgtacggtaacgttgggtacgtacgtaacgtacgttacgttcccttaccaaccccgacgttccccggtacgggaaccaacgttaccttaacccgtacgtacgaaaccccgtaacgtaaacccttacccgtaaacctaaaccgtaaacccaaccggaaccgtacccgtaacttaacggttcgggtaaacggttcggaacggtacggtaccgttaccgaacttacgtacgtacccgggaaacgtacccggtaaccccggttcccggttaaccgttaacgttttaccggttacgggtacggtaacggtacccgggtaacccccgttacccgggtaaccggtaaccgggtttcccgggaaccggtacccggaccggttaccggaccggtcccgggttaccggttaccggtttcggttacccggtttcccgggaaccccgggggg

SEQ ID NO: 207712 - DNA, 823 bp, Homo sapiens
  misc_feature: GYAE6OF01AHKBK.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacagtcgcccactcccgaggtcgcagctggtgcagtcgtggggctaggaggtagaacgacggcccgtggggcctcgaggtggaacggtcctccgtagacgaagggtccttcgtaggtactttaccgttaaccgtttaccttacctaagttacgtacttcgtaacggttggggtcgaccggcccggtaggtcccgtcgtacggaaccaaccggaccgtaggacggtcggtagtggggacgtcggggaaccctaaacccgtagtaccgtggtactacgacgtacgttcgttccctaccgaccctaccggttccggtacccgggaactaccgtaaaccgttccgtactacccgaacccgtacccgtaaccttccccgtaaacccgtaactaaacccgacccgtaacgtaccctaaacgtaggttacgggtacgttaacgggacggtaccgtaccgtagaacctacgttacgaaccggaaccggtaccgtacccgggttacccgttacgtttaaacgttcgtacggggttacgtaacggaccggtacccgtaccggtaaccggttccgggttaccgggaaccggtacccggtacccggttaccggggaccgttaaccggggtccccggttttaccgtttaccggttacccggggttccgggtaacccgggggg

SEQ ID NO: 207713 - DNA, 824 bp, Homo sapiens
  misc_feature: GYAE6OF01COU6C.17.25.C03.1.454.CMB.1.raw
tcagcgtagactagcacgaccggtgctcgatttagtagtgtagatttgggtttggggactcaacaaccacatctgtcctctagagaaaacctgtgagcacagctcctcaccagtggactggaccgtggaggatcctcttcgttggtggcagcagctacaagtcgcccactcccgaggtcgcagctggtgcgtgtcgtgggctggaggtgaagagccgtggggcctgaggtagaaggtctccgtgacgaggtcttcgtggtattacgtaccgtttacctcgtaatagtacttacgaacggtgggtacgtccgaccggtaggcccgtaccgtaacgggaaccgaaacccggtaccgtacgggtagggtacgggtacggtaggggacgttacgggggaacccctaaaccccggttaaccgtaaccgggttcgggttaccttaccggaaacgttcgggtacggtttcccttaaccccggtaaccccgccgttacccggttaccccggggtaaacctacgggtttaaaccccgtttaaaccacggttacccgtaacccccgtaaacccgttaaccccgttaacccttaaccctaaaacctaaacccgtaccgtaaaccggtaacccttaaacgtaccggttaggggtacggttaaggaccgggtaaccgtccgtacgaacccttgtacgtaccgaacggtaacccgtacggtacccgttactttagtaacgtcggtcgaccgaacgttcccgtccaagggtcccgtacgggactcccggaaccgacggtccgacggttccgttccggttgtacccggtcgggtacgggg

SEQ ID NO: 207714 - DNA, 760 bp, Homo sapiens
  misc_feature: GYAE6OF01ESK4H.17.25.C03.1.454.CMB.1.raw
  modified_base (186)..(186): a, c, t, g, unknown or other
  misc_feature (186)..(186): n is a, c, g, or t
  modified_base (254)..(254): a, c, t, g, unknown or other
  misc_feature (254)..(254): n is a, c, g, or t
  modified_base (306)..(306): a, c, t, g, unknown or other
  misc_feature (306)..(306): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccgaggtgcagctggtncagtcgtgggctgaggtgaagacgcgtgggcctgagtgaacggtcctccgtagcgtaacgtcttacgnggtacttccgtaaccgtttacctacgtaatagttactacgtaacgtgggtcnccgaccgacgggtcccgcgtacggaaccgaaccggtaccgtggaggtggacggtaggggacgtaccgggtacctaaacccgtaagcgtagggtcgtacgagtacgtcgttcctacccgaccctacgtcccgtaccgggaactaccggtaaccttaccgactaccggaaccgtaaccgacccttaccctaaccctaactaaacccgactaaccgtaccctaacgtaggtagggtaacggttacggacggtaccgcgtaccgtactacgtacgtacggaacccgtaccggtcccgggtaccgttaactttacgtaccgtaggttaccggaccggtaacgtacccgttaacccgacggttcccggtacccgggttacgaccccggtacccggtaccgggtacccgtacggaccccggtttaccggtttccggtacccgttcggggtaaccccggggg

SEQ ID NO: 207715 - DNA, 881 bp, Homo sapiens
  misc_feature: GYAE6OF01B97ZT.17.25.C03.1.454.CMB.1.raw
  modified_base (185)..(185): a, c, t, g, unknown or other
  misc_feature (185)..(185): n is a, c, g, or t
tcagcgtagactagcacgaccggtgctcgatttagtagtgtagatttgggtttgggactcaacaaccacatctgtcctctagagaaaaccctgtgagcacagctcctcaccagtggactggacctgggaggatccttcttcgttgggtggcagcagctaacgaagtcgcccacctcccgaggtcncagcgtggtacgctaggtcggtgggctggagggtagaaggacggtccggtcgggtcctacgtaggtaggaacggttcctccgtaggacgtacggttcgttcgtaggtactttaccgttaacccgttttaacctccgttaagttaacgttacttaaccggtaacggttggggtcccggtacgtaccggaccgggcccgtacggtaaccggtaaaccgaaccggtaccgtagggtaggtaggtacggtagggtacggtaccggaacccgtaaaacccgttacgcggttaggtacgtacctaacggttcggtttcctacccgttacccacccgttaccggtcccgtaaccgggaacttaaccggtaacccttaacgacgtaacccgaacctaacccgtaacccttacccgtaaacctaaacggtaaaccacccgtaaaccgttaaccggttaacgggtaacgttcggggaaacggtttgggaacccggtaccgttacttaaccgaacgttaaccgtacggtaaccggaacccggttaccccggaccgggttcccctttaaagtttacccggtaagttcgggtaccgtaacgtaccggtaaccccgttaccgaccggtaccggttacgggacggtaaccggtaccccggaggtccgtaccggttccgttaacgggtttccggtcgggtccgggtacgggg

SEQ ID NO: 207716 - DNA, 677 bp, Homo sapiens
  misc_feature: GYAE6OF01EXZX3.17.25.C03.1.454.CMB.1.raw
  modified_base (489)..(489): a, c, t, g, unknown or other
  misc_feature (489)..(489): n is a, c, g, or t
  modified_base (495)..(495): a, c, t, g, unknown or other
  misc_feature (495)..(495): n is a, c, g, or t
  modified_base (598)..(598): a, c, t, g, unknown or other
  misc_feature (598)..(598): n is a, c, g, or t
tcagcgtagactagcacgaccggtgctcgattttagtagtgtagatttgggtttggggactcaacaaccacatctgtcctctagagaaaaccctgtgagcacagctcctcaccatggactggacctgggaggatcctcttcttggtggcagcagctacagtgcccactcccaggtgcagcgtggtgcagtcgtggggctggtaggtaggaaagaaggcccgtgggggcctcaaggttgaagggtcctccgtgacgaaaggtcttcgtggtacttcgtaaccgtttacctactaatagtatacaacgtggagtaccgcgacggcgcgtaggaccaaccggtacctggaaggtcgggaggtagggtagtcggggaaccaacccgttaacgaccgtggttcgaccacgtagtcgtaccttccgaaaccctacggtccgaacccggtactacgacgttaacactcgaacacgaccctacctacctaataaacncgaacncctaagacgttaggagttaaggacggtcgacctagtaaccgactctaacggacggaacccgtaccgggtacctacgttacgttaactgggtacagggttaacnccgtaaccgagtacgggtcccgagtacccgaccggtacgcgtaacggtccggtacctttacggtcggtccggtcggggg

SEQ ID NO: 207717 - DNA, 882 bp, Homo sapiens
  misc_feature: GYAE6OF01C9CCU.17.25.C03.1.454.CMB.1.raw
  modified_base (241)..(241): a, c, t, g, unknown or other
  misc_feature (241)..(241): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccgaggtgcagctggtagctagtcgtggggctggaggtgaagacgccgtgggcctcagtagaaggtcctccngacgtaaggtcttcgtggtacttacctacgtttacctacctagttaacgtacttaccgtaacgtcggggtacgaccggccgaacggtcccggtacgtacggaaccgaaccgtccgtaggtacggtgggtaacgtggggaagtcggggaccctaaacccgttaacgaccgttgggtctaccgtaagtacgttcgttacccttaccgaaccccgtacgttcccggacgggtaactaccgtaaccttactaacgtaccgaacctaaccggtaccctaccctaacgtaaaccaaaccgaccgtaaccgtacccgttaaactacgggttacgggaaggtttaacgggaaccgggtaccgttacccggttaagtaaccgtaccgtttaccggtaacgaaacccgggtacccggtaaccccggggtttccccgttaacgtttaaccgttttacccggtacgggttacccggaacgggtttaaaccggaccccggttacccgggtaaacccggttaaccggggtaccccgggttaacccggaacggttaaccccccggggtaacgggtacccggtaaccccggggtttacccggtttacccggtttttacccggtacccgggtttcccggggggtaaacccccgggggg

SEQ ID NO: 207718 - DNA, 837 bp, Homo sapiens
  misc_feature: GYAE6OF01A2SOW.17.25.C03.1.454.CMB.1.raw
  modified_base (294)..(294): a, c, t, g, unknown or other
  misc_feature (294)..(294): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaacgagccgtggggcctcgagtgacgtctcctgacaggtcttctaggtacttctacgtttacctcttatagtactaccaacgtggggtacnccgccgaggcccgcgtacggaaccaaccggtaccgtgggacggtaggtacgggttacggggtaagtccgggggaacccctaaaaccccgtaacggttaccgtcgggttaccggtacccaacggttacgggttaccttcccgtttacccaacccccggttacttacccggtacccggggtaacctaccggtaacctttacccgaaccgtacgaaccccgtaacgtaacccttaccctacctaaaactaaacccgacctaaccgtacccttaacgtaaggtacggggtttacgtacgggtaacggtaccgtaccgttagaaccctacgttaccaacggggtaacccgaaccggttaacccggtcccgtttaaccgtttaacgtttacccggtacgttaaccggacgggtaccgttaaacccgtaccccggtaacggtcccggttaaccggggtacggtaccccggtaacccgttacggggaccccttaacggggtcccggttttaaaccccgtttcgggttaaccgttcccggggggtaaccggg

SEQ ID NO: 207719 - DNA, 737 bp, Homo sapiens
  misc_feature: GYAE6OF01DNQ7Q.17.25.C03.1.454.CMB.1.raw
  modified_base (182)..(182): a, c, t, g, unknown or other
  misc_feature (182)..(182): n is a, c, g, or t
  modified_base (241)..(241): a, c, t, g, unknown or other
  misc_feature (241)..(241): n is a, c, g, or t
  modified_base (441)..(441): a, c, t, g, unknown or other
  misc_feature (441)..(441): n is a, c, g, or t
tcagcgtagactagcacgaccggtgctcgatttagtagtgtagatttgggtttggggactcaacaaccacatctgtcctctagagaaaaccctgtgagcacagctcctcaccatgactggacctggaggactcctcttcttgggtcggcagcagctacaagtcgcccactcccgaggtgacngctggtgctgtcgtggggctggaggtgaaagacgcgtgggcctgagtgtagtcctctgngagtctgtgtacttctaaccgttacctctaatcgtactacgaacgttcgggcgccgaccgacgggtccgtacgtacggaacctaaacggccgtaggaggtcggagtcgggtacggcggaaacccgtaaccctaaacgtcgttagggtctaccgaatcgttacgtcccttacctaaaccctcggtacccggtaaccgggtntaaacccgtaccgttaaccacgtacccggtaccaaaccgtacccgtaaccctaactaaaccgaaaacgtcctaacccgtaaccgttaacgacggttagggtaaggttaaccgggacggttaccgtacccgtagtaacccacggttacgaaccggttacccgaacgtacccgggtttaccttagttaacgttacggtcggttacggaccgtaccggaccctaccggtacgtcggtaccgcggaccggtaccgtacggccgtacggtcgtttaaccgtcgtccggggttgacccgggg

SEQ ID NO: 207720 - DNA, 786 bp, Homo sapiens
  misc_feature: GYAE6OF01A8RSG.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatccgtcttcttggtggcagcagctacaagtgcccactcccaggtgcagctggtgcagtctggggctgaggtgaagagccgtggggcctcgagtgaaggtcctccgtgacgaaggtcttcgtggattcaccgttttacctccgtatagtatcgaacgtgggtcgcgtccgacggtccgcgtcggaccaacggacctggacgtggagtgggagtcgggaccgaacccgtaacacgtcgggtcgtccacgtacgttcgtaccttccacccgtacgtcccggtacccggggacacgtaccgtttaccgacgtacgaaccccgtaacgaaccttccctaaccgaaacttaaaccgacgaccgtaccctacgagttacgggtacggtttacggaaggtacgacccgtttagaactaccgttacgtacgggtaaccgaacccggtaccggggtaccctttaccgtttaaccgttaaccggttggtacccggtacgggtaaacgttaccccggtaaccccggtaacgggtacccggttttaccccggggacggttccgggtaaaccccccgggttaaggggacccccggttaaacggggtcccccggtttaaccccggtttttaacgggtaccccgttttcccgggggttaaccccggggggg

SEQ ID NO: 207721 - DNA, 706 bp, Homo sapiens
  misc_feature: GYAE6OF01CFPW4.17.25.C03.1.454.CMB.1.raw
  modified_base (220)..(220): a, c, t, g, unknown or other
  misc_feature (220)..(220): n is a, c, g, or t
  modified_base (234)..(234): a, c, t, g, unknown or other
  misc_feature (234)..(234): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtgggcctnagtgaaggtctccngcaaggtcttcgtggacttctacgttttacctccttatagtatcgaacgtgggtgcgtccgaggccgcgtaggacaacgtactgagtggagtgggagtgggaccgaaacccgtaacacgtggtcgtacaagtagtcgttaccttaccaccccgtaacttcccgtaccggggaacctacggtaacctttaaccgataccggaacccgaaccggtaacctacccgtaaccaaactaaaaccaacccacgtaccctaacgacgtaggacggttaacggagggtacacccgttagaacctaacgttcgtacggaaccggaccgtacccggtacccgttaccttaacgtttacgtggtacgaccggtaaggacccgtacccgacggtaccgttacccgggtaggaccccggtacccgtaaccgggccgtacgggtccgggtttacccgtttacgtaccgtttcccgggtaccggggg

SEQ ID NO: 207722 - DNA, 726 bp, Homo sapiens
  misc_feature: GYAE6OF01B5D0N.17.25.C03.1.454.CMB.1.raw
  modified_base (186)..(186): a, c, t, g, unknown or other
  misc_feature (186)..(186): n is a, c, g, or t
  modified_base (322)..(322): a, c, t, g, unknown or other
  misc_feature (322)..(322): n is a, c, g, or t
  modified_base (478)..(478): a, c, t, g, unknown or other
  misc_feature (478)..(478): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtgcagcagctacagtcgcccactcccaggtgcagctggtgacnggtcgtggggctaggaggtaggaaacgaggccgtagggggcctgagtaggtaacggtcctccgtggactacggtcttcgtaggtactttacgttaaccgtttacctacgttaataagtatacgtaacgtggggtcncgaccgtcggcgacgtacggaaccgaacgtccgtaggtaggtacggagaggggtacgacggggtacgtaaacccctacgtacggtcgggtactaccgtagtacggtcgttacccttaccgacccttacgcccggtacggactacgtaacgtaaccncgtaaccggacctaaccgtaaccctaccctaactaaacctaaaccaccgtaaccgtaccgtaacgtgtaacgggtaggttacggaacgggtacctaccgtacgaacttaggttaccaacgaaccggacccggtacgttcccgttaattaaccttgcggtacacggacgtcctaaccgtgtaacgggtcgacgtaccggacggttaacgcggtaaccgtcgttaccggttcgttcggtcgggtacgggg

SEQ ID NO: 207723 - DNA, 706 bp, Homo sapiens
  misc_feature: GYAE6OF01C9KOC.17.25.C03.1.454.CMB.1.raw
  modified_base (338)..(338): a, c, t, g, unknown or other
  misc_feature (338)..(338): n is a, c, g, or t
  modified_base (425)..(425): a, c, t, g, unknown or other
  misc_feature (425)..(425): n is a, c, g, or t
  modified_base (538)..(538): a, c, t, g, unknown or other
  misc_feature (538)..(538): n is a, c, g, or t
  modified_base (559)..(559): a, c, t, g, unknown or other
  misc_feature (559)..(559): n is a, c, g, or t
  modified_base (569)..(569): a, c, t, g, unknown or other
  misc_feature (569)..(569): n is a, c, g, or t
tcagcgtagactagcacgaccggtgctcgatttagtagtgtagatttgggtttggggactcaacaaccacatctgtcctctagagaaaccctgtgagcacagctcctcaccatggactggacctggagactcctcttcttggtgcagcagctacagtcgcccactcccgagtgcagctggtgacgtagtcggtggggactaggtaggtagaaagaacggccggttcggggcccttgaggtacgtaagggtcctactcggtaccaagggttccttgtaggtaacctttccgtaaccgttttacctccgttaatagttacttaccgtaacgttggggacncccggtacgaaccgggccgacgttaccggaaccgtaaccgacgtggaggtaggtacgagggtacgacgggtacctaaacccgtacgngtaggtaccgacgactcggttacgtaccttacccaaccgtacttacccggacgggtaacacgttaaccctacgacttacgaccctacgacctacgacaataacacacgaccanagtaggtacgtagacggtacncagtacctanacggtacacggtaaccgaccggttacctaacttacgtacgtcggtacgagtacgaccgtaccgtaacggtcggtaccgacgtcgacccgtacgggacgtccggtaccgggttaccttcggttacgtcgggtacccgg

SEQ ID NO: 207724 - DNA, 1031 bp, Homo sapiens
  misc_feature: GYAE6OF01D1KC4.17.25.C03.1.454.CMB.1.raw
tcagcgtagactagcacgaccggtgctcgatttagtagtgtagatttgggtttgggactcaacaaccacatctgtcctctagtagaaaaccctgtgagcacacgctcctcaccatggactggacctggaggatcctcttacttggtaggcagtcagctactaagtcgcccacttcccgaggtacgtcaagccgttggtacgctaagtccgtgggggcttggaaggttaggaagaacgtccggtagggggtaccttcgaggttacgtaacgggtttccttcccgttacggaccgtaaagggtccttttacggtacgggttaacttttacccgtaaccggttttaaccccttaccgttaaagttaaggttacttttaacccgaaacggttttcgggggtaacggtccccggaaccccgtaagggggttccccccggagtttaccggggaaaaccttaaaacccggggaaccccgttttaggtaacgggttacggggtaaacggtttaccgggggtaacggtttccggggtaaaaccgtaaaaccccgttacctaaccggtttcgggttaagtcccgtaaaccgttaacgggttccggtttaacccgtttaccgtaaccccccgtaaacgttcccccggtaaacccgggtaccgtaaacggttaaccgtttaaacccctacggtaaccgtaaccccggtaaaccggtaaaccgttaccccctaaaccggtaaaccttaaaacccggaaaccccttaacggtaacccgtaaaaccgttacggttaacggggttaacggtttcggaaccgggggtaaactccccgggtacgttaactacggttaccctaaccgggaacccttacggacccgggggtttaaccttacgttacccgtttaccgttacgggaacgtcccggtaaccggtaacccgttacccggaacccggtaccgttacccggtacgtaacccggtccgtaaccggaacgtacccggaccggtttacccgttacggtcccggttcccggtacccggggg

SEQ ID NO: 207725 - DNA, 712 bp, Homo sapiens
  misc_feature: GYAE6OF01DZLSF.17.25.C03.1.454.CMB.1.raw
  modified_base (294)..(294): a, c, t, g, unknown or other
  misc_feature (294)..(294): n is a, c, g, or t
  modified_base (323)..(323): a, c, t, g, unknown or other
  misc_feature (323)..(323): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagcgtggtcgcagtcgtggggctgaggtgaagagccgtgggcctcgagtgaaggtctccgtgcgaaggtcttcgtggacttcgtaccgtttacctcctatagtatctaacgtgggtcncgccgaggccgcgtcggaccaacgtccgnggacgtggagtgggagtcgggaccgtaaccctaacgacgtggtcgtacacgtcgtctaccttcaccctacgtcccggtaccgggactaacgtaaccttaacacgtacgacccaaccgtaaccttacccgaacctaactaaaccacctacgaccctacgacgtagggtaggtacgaacggacgtccctagacctacgtcgtaacggaaccgtaccggaccgggttccttaacgttcgtttaccgcggtacggttaacccgagggtaccgtaccccgacgggtaaccggttacccggggtacggtacccgtacccgggtaccgggaccctacccgggttccccggggttacccttttaccgggccccgtttacggggggtaaccccggggg

SEQ ID NO: 207726 - DNA, 786 bp, Homo sapiens
  misc_feature: GYAE6OF01BVPAP.17.25.C03.1.454.CMB.1.raw
  modified_base (199)..(199): a, c, t, g, unknown or other
  misc_feature (199)..(199): n is a, c, g, or t
  modified_base (255)..(255): a, c, t, g, unknown or other
  misc_feature (255)..(255): n is a, c, g, or t
  modified_base (303)..(303): a, c, t, g, unknown or other
  misc_feature (303)..(303): n is a, c, g, or t
tcagcgtagactagcacgaccggtgctcgatttagtagtgtagatttgggtttgggactcaacaaccacatctgtcctctagagaaaaccctgtgagcacagctcctcaccatggactggacctggaggatccttctttcgttggtgcagcagtctacaagtcgcccactcccaggtgcagctggtgcagtcgtggggntggaggtgaagagccgtgggcctgagtgaggtctccgtagcgtaaggtcctttagnggtacttccgtaacgtttacctcgtaattagtactcgaacgtgggtcncgccgaggcccgcgtaggaacccaacggacctaggaggtaggacgtaggggtaactacggggaaccctaaaacccgtacgaccgttagggttacttaccgaacgtacggttacgtttccctaacccgtaccctacgtttacccgggaccgggtaaacctaaacgttaaccccgttaacctacggttaacccggaaacccaaccgtaacccttacccttaaacccgaaactaaacccgacgtaaccggtaaccctaacggtaacggttaagggtaacggtttacggaaacggtaccgttaccgacgttaacgaccttacggaacggtaccgaccgaccggttacccgtagttaacttccggtataccggacggtaacgtacccgtaacccgtaacggtccggtacccgggtaacggcccggtaccgtaacccgggagttacccgggtccggttaccgtttaccggtacgttcggggaacccggg

SEQ ID NO: 207727 - DNA, 828 bp, Homo sapiens
  misc_feature: GYAE6OF01BT2T2.17.25.C03.1.454.CMB.1.raw
  modified_base (408)..(408): a, c, t, g, unknown or other
  misc_feature (408)..(408): n is a, c, g, or t
tcagcgtagactagcacgaccggtgctcgatttagtagtgtagatttgggtttgggagtcagtctcagtcaggacacagcatggacatggacgggtccccgctcagctccgtgggcctcctgctactctggcctccgagctgccagatgtagacactccagatcgacccagtcctccactcctcctgtctcgtccttcgtagggtggggtacagtacgtaccaacctactcgtacgttcggaccggaactaacggtaccgtaaccggttaaaccgtttaaaaacctttaagttttaaacggttggtaactaccgaaacggacctaaaacggtaaaaccgaacgggaaaacctcccgaacgtacccttcgtagtccttcgtcggaggtcacctacctccctgtaccggnggaccgtaagggtccgaccccgttacgtacgttacggacggtttacgacgggtacgacggtaggttacgacgtttaccggaaggggtaaccctagtttaactttacccgaaattcccgtaacccaacctaccgtacccaccttacgctaacgaaccccgtaagtcggtaacggttcttaagggacttaaccgttaacttacgttaccggtacttacgaaacctaaggtacggttttaaccctacccggtttacccttcccggttattaccccggtttaccggtaccggggaaaccgtaacgggaaacctttaagggtaaccttaaacgaacgggttaaacccgtaaacggttcgtaaccgggttacccgtaacgttacccgaaactttccccggttaaatttccgttcgtttaacccccg

SEQ ID NO: 207728 - DNA, 806 bp, Homo sapiens
  misc_feature: GYAE6OF01AYRI2.17.25.C03.1.454.CMB.1.raw
  modified_base (219)..(219): a, c, t, g, unknown or other
  misc_feature (219)..(219): n is a, c, g, or t
  modified_base (243)..(243): a, c, t, g, unknown or other
  misc_feature (243)..(243): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctnagtgaaggtctcctgcaaggcttntggattcacgtttaccctctatagtatcaacgtgggtagcgccgaggcccgcgtcggaaccaacggacctggacggtggagtggggatcggggaccgtaaaccctaacgacgttcggtacgtacgaacgtagttacggttccctttaccaacccccgtacttcccggtacccggggaactaacggtaaccctttaaccaacgtaccgaaccccgtaaccgtaaccttaccccttacccgaaaacttaaacccaacccgtaacgaccccttaacacggttacgggtaacgttagggaacggtaccggtaccgttacgaccttacgtaccgttacggaacccggtacccgtaacccggggtccctttaaccgttacgtttaccgttacgggtacggtacccggaacgggtacccggttacccccgggaaacccggttaccggttaccccgggggtacggaaacccgggttacccccgttaacccgggggacccgtaaccgggggttccccggttaaccccggtttttccggtacccggtttttccccggggggacccgggggggg

SEQ ID NO: 207729 - DNA, 652 bp, Homo sapiens
  misc_feature: GYAE6OF01BGVES.17.25.C03.1.454.CMB.1.raw
  modified_base (222)..(222): a, c, t, g, unknown or other
  misc_feature (222)..(222): n is a, c, g, or t
  modified_base (247)..(247): a, c, t, g, unknown or other
  misc_feature (247)..(247): n is a, c, g, or t
  modified_base (266)..(266): a, c, t, g, unknown or other
  misc_feature (266)..(266): n is a, c, g, or t
tcagcgtagactagcacgaccggtgctcgatttagtagtgtagatttgggtttggggacgtcaacaaccacatctgtcctctagagaaaaccctgtgagcacagctcctcaccatggactggacctggaggatctcttcttggtggcagcagctacgaagtgcccactcccaggtgcagctggtgcgagtctgggctggaggtagagagcctggggcctcgngtgagtctccgtgcaaggtcttcgnggtattcgtacgtttaccncctatagtatcgaacgtgggtcgcgaccgtaggcctacgacggaccaaacggacctggacgtggaacgtgggacgtgggaccgaaaacccgtactacggtcgggttagtccaagtacggttgtacccttacgacccgtaactcccgccggggtaacacggtacctttaccagttccgaacctacgaacctccgtacccaataaaccgtacacggtacctacgtatgggtaccttaggacgaagtcccagacctgtacgtacggacgacgaccggtacgtacttacgtacgttcgcggtaccgtagccgtaacccgacgtcggttcggacggtacgccccgttaacgccgtacgtacgtccgtttaacggtcgttcgggtaccgggg

SEQ ID NO: 207730 - DNA, 741 bp, Homo sapiens
  misc_feature: GYAE6OF01CJS70.17.25.C03.1.454.CMB.1.raw
  modified_base (245)..(245): a, c, t, g, unknown or other
  misc_feature (245)..(245): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctggaggtgaagaagccgtgggcctcgagtgaagtctcctgcgaggtctntgtattctaccgtttacctctatagtatactaacgtgggtcgcgtaccgacggccgcgtcggaactaaccgacgtggagtggtagtgggtacgtcgggaaccgaaacccgtaacgaccgttggtacgacctaacggtcgttacggttccttaccaaccccgtcgtcccgacccggggaactaaccgttaccttaacccgacgttacccgaaacccgtaaccgtaaacccttacccccgtaacctaaaacctaaaaacccgtacccgaacccgtaaccctaaacgtaacggttaaccgggtagtttaaccgggaacgggtacgtacccgtaggtaacctacgttacggtacgaacccggtaaccgacccggttcccgttaaccttacgttaaccgtcgtacggtacgaacggtcccgtaacccgacggtaccgtaccgggaggtacgacccgtacggacgtacgggtccgttaccgtttcgtccgtcgggtaccggg

SEQ ID NO: 207731 - DNA, 883 bp, Homo sapiens
  misc_feature: GYAE6OF01B6JDI.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactcggaccgtggaggattccttcttcgttggtggcagcagctaacaagtcgccctacctcccgaggtgcgagcgtggtgcgtaggtcgtggggctggaggtaggaaggaacggtccggtaggggtccctagacggtaggtaacggttcctaccgtacggacgtaacggtcgtttcgttacggttactttaccgttaacccgttttacccttaccgttaacttacgttaacttaccgtaacggttgggtcgaccggccgcggtccgcggtacggaccgtaaccgaccgtaggacggtagggtacgggtagggaggtaccgggaaccgtaaacccgtaacgtacggtaggtacgtacgacgttacggttacttccgttacccacccgttaccgttaccggtacccggggtacgttaacccgttaacgtacggtaccgtaacccaaccgttaaccctccccgtaaacaaaccttaaaccgaccgttaaccgtacctaacgtaacgggtacggttaggttacggaaaccgggtccgtaaccgttacgaacgttacttaaccggtacggaaacccggtaacccggacccggttacccgttacgtttaaccttacgggtccgttacggaacccggttacggtaacccgtccccgggtaaaggtaccccggttccgggaacgggacccgtttaccgggacccgggtccggtaaccggttccccgggttttaccgttacgggtccccggtttacgggggtccggggtacccggg

SEQ ID NO: 207732 - DNA, 766 bp, Homo sapiens
  misc_feature: GYAE6OF01BIINJ.17.25.C03.1.454.CMB.1.raw
  modified_base (455)..(455): a, c, t, g, unknown or other
  misc_feature (455)..(455): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccacctcccaggtgcagctgggtgcagtcgtggggctggaggtgaagaacgccgtggggcctcaggtgaaggtcctccgtgcgaaggtcttcgtggtactttccgtaccgttttaccctactatagtactacgtaacgttggggtcgccgccggacggcccgcgtacggacctaacggaccgtggaggtggtagtggggacgtacggggaacctaacccgtaacgcgtcggtcgtaccacgtacgtcgttcctaccacccgtacttcccggaccggacacgtaccttaaccncgtaccgaacccgtaaccgtacccttacccctaacctaaacttaaaaccccacgtaacccgtaacccttaacgaaggtttacgggtaacgggtttacggaaccgggtcacccgtaacggtaacctacgttaccgtaccggaaccggaacccggtacccgggtacccgtttaacttaaccgtttacgtacggtacggaccggtaacggtacccgtacccggtacggtaccggttccgggaacggtcccgtaccgggtaaccgggacggtccggtccggtttaccgtttcggaccggtttcgggtaccggggg

SEQ ID NO: 207733 - DNA, 1042 bp, Homo sapiens
  misc_feature: GYAE6OF01E3SWT.17.25.C03.1.454.CMB.1.raw
  modified_base (897)..(897): a, c, t, g, unknown or other
  misc_feature (897)..(897): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttgggtggcagcagcctacaagtcgccctacctcccgaggtcgacgcgcgtgggtcgcaggttcggtcgggggcctgggaagggtagaaacggtaacgtcccggtacgggggtccctacggtaaggtaggtaaccggttccctccgtaggactaacggtcctttcgtacggttacgtttaccgtaacccgttttacccgtaccgttaacgtttaacggttaacttacccgtaaacgggttcggggtaccggtacccggaccccgggtacggtaccccggtacgtaaccgggaacccgtaaacccgggtaaccttaggggtaaggggtacgggtacgggtaggggaaccgggttacccgggggtaaacccctaaaaccccgttaaccggtaacggttaccgggttaccgtaacgtaacggttaaggttcccgtttacccgtaacccgttaaccccggtacccgtaccccgggttaaccccggggtaaactaccccgggtaaacctttaaccggtaaccttaacccgggaaccccgtaaaccggtaacccctttaccccgtaacccgtaaaacgtaaaacccctaacccgaaccccgttaacctaaagggttaaaccggtagggggtttaaccggttaaggggaacggtacccgttaacggtaccgaacgtttacccgtacgtaacccgggtaaacccggtacccggtacccgggttaaccttttaccgttaaccggtttccggtacggttaacccggnggtaacccggttacccggtaacccgtacccgggtacggtttacccgggaaccggttaccggacccccgggttaaccccgggtacggtaccccggttcccggtttaccggtttccgggttaacccgttcgggggttaaccccgggg

SEQ ID NO: 207734 - DNA, 862 bp, Homo sapiens
  misc_feature: GYAE6OF01ERK8J.17.25.C03.1.454.CMB.1.raw
  modified_base (128)..(128): a, c, t, g, unknown or other
  misc_feature (128)..(128): n is a, c, g, or t
  modified_base (149)..(149): a, c, t, g, unknown or other
  misc_feature (149)..(149): n is a, c, g, or t
  modified_base (171)..(171): a, c, t, g, unknown or other
  misc_feature (171)..(171): n is a, c, g, or t
  modified_base (179)..(179): a, c, t, g, unknown or other
  misc_feature (179)..(179): n is a, c, g, or t
  modified_base (183)..(183): a, c, t, g, unknown or other
  misc_feature (183)..(183): n is a, c, g, or t
tcagcgtagactagcacgaccggtgctcgattttagtagtgtagatttgggtttgggactcaacaaccacatctgtcctctagagaaaaccctgtgagcacagctcctcaccatggactggacctggnggactctctttcgtggtggcngcagctacgtagtcgcccaccnccgaggtnacgngtcgtggtcgactggtcggtgggtcgtaggagggtacgaaacggcggtccggtcggggtccctacggaggttaggtaaccggttccttccgaggaccggttacggttcgttacgtcgttactttaccgttacccgtttaccgtacgttagtacgtactacggtacggttcggtaccgccggtccggaccggtccgtacggtaacggaaccgtaccggtacggtaggtacgggtagggtacgggtacgggtacggtacccggtaaccgtaacccgtacgtcggtacggtacgtacggtagttacgttcgtaccctaccgtacccggtacccgttacccggaccggtaaccacccgttaaccgtaccgtaaccgtaccgacccgtaaccgtaaccctacccgtaacctaaccgtaacccgacgtaacctaccgtaagtacgggttacggtaacggtaccggtacgtacccgtacgtacgtacgtaccgtacgtaccggaccgtacccggtaccggttaacccgtttacgttacgttacggttcggaaccggtaccgttaccgggtacccgtacccggtaccgggtaccggttacccggaccgggttacccgggaccggtaccggaccgggttcccggttaccccgttacccgggtttccggtccgggttcggggaccccgg

SEQ ID NO: 207735 - DNA, 752 bp, Homo sapiens
  misc_feature: GYAE6OF01EZODO.17.25.C03.1.454.CMB.1.raw
  modified_base (150)..(150): a, c, t, g, unknown or other
  misc_feature (150)..(150): n is a, c, g, or t
  modified_base (172)..(172): a, c, t, g, unknown or other
  misc_feature (172)..(172): n is a, c, g, or t
tcagcgtagactagcacgaccggtgctcgatttagtagtgtagatttgggtttgggactcaacaaccacatctgtcctctagagaaaaccctgtgagcacagctcctcaccatggactggacctggaggatcctcttcttggtggcagcngctacagtcgccactccaggtnctagcgtggtgctagtcgtgggctaggagtgaacggaacgtcggtcggggtacctgaggtacggaacggttcctaccgtggacgtaacggttcttcgtaggttacttcgtaccgtttaccgttacttagtagttactacgtaacggttcggtcgtccggccggacggcccgacgtacggaaccaaccgtaccgtaggtacggtgggtaggtagggacgtacggggtacctaaacctaacgtacgtacggtagtacctacggtacgtacgttaccgtacctacccgaccggttacccgacggtactacggtacctaccgacgtacctaccgtaactacccgttaccctaacgaactaaacacctaccgtacctacgacgtagggtacgtggaacggtacgtaccgtacgacctagtacgtaacgtaaccggaacccggtccgttacccgtttaacttcggttaacgtcggccggtaacggaccgttaccgtacccggtacggtaccggttaccggtacgacccggacggtaccgggcggtacggttcccggttaacgtttcgtcgggttccgggtacgggg

SEQ ID NO: 207736 - DNA, 837 bp, Homo sapiens
  misc_feature: GYAE6OF01BNZXN.17.25.C03.1.454.CMB.1.raw
  modified_base (681)..(681): a, c, t, g, unknown or other
  misc_feature (681)..(681): n is a, c, g, or t
tcagcgtagactagcacgaccggtgctcgatttagtagtgtagatttggggtttgggggactcaacaaccacatctgtcctctagagaaaaccctgtgagcacagctcctcaccagtggactggacctggaggactcctcttcgttgggtggcagcagctacaagtcgcccactcccgaggtcgcacggtcgtaggtcgacgtggtcgtgggggcttagggagggtaggaaacggaacggtcccgggtcgggggtacctacggtaaggttacggtaacgggttcctaccgtaggacgtaacggttctttccggtaggtacgttttacccgttaaccgttttacctacgttaacgtaacgttaattaccggtaacggttcggggtacgacccggaccggaccggggtcccgtacggtaacgggaaccctaaaccgggtaccgtagggtacgggtagggtaacggttagggggacgtaaccgggaaacccgtaaacccgtacgtacgggttcgggtactacgtacgtacgggttacctaccgtcccgtaacccgtaccggtccggtaaccgggaaccacggttaccctacgacgtaccgacccaatacccgttaccactaaacggtaaccactacctactaacgtacgtagggtacgtaacggagacccggtacaacggtacncggttaacgacgaaccgggaactacccgttactttaccggttaatacgggtcggtaaccgcggggttaaaccaccgggttaccgaacggttccggttaagggccgttaaccgcccgtagggcctaacggtcgttaccgtggttccggcggtacggg

SEQ ID NO: 207737 - DNA, 729 bp, Homo sapiens
  misc_feature: GYAE6OF01D0M25.17.25.C03.1.454.CMB.1.raw
  modified_base (198)..(198): a, c, t, g, unknown or other
  misc_feature (198)..(198): n is a, c, g, or t
  modified_base (272)..(272): a, c, t, g, unknown or other
  misc_feature (272)..(272): n is a, c, g, or t
  modified_base (593)..(593): a, c, t, g, unknown or other
  misc_feature (593)..(593): n is a, c, g, or t
tcagcgtagactagcacgaccggtgctcgatttagtagtgtagatttgggtttggggactcaacaaccacatctgtcctctagagaaaccctgtgagcacagctcctcaccagtggactggacctggaggactccttcttcgttgggtggcagctagcctacaaggtcgccccactcccgagggtgcgagcgtgggtnacgtagttcggtggggcttaggagggttagaacgacgggtccggtcggggccttacgagtacggtacggttccnccgtagacgtacggtctttacgtggtacttccgttaaccgttttacctactttatagtactcgtaacggttggtacgccgaccgcggtccgcgtacggaccgtaccgcgtagtcggaggtaggacggtggaccgggaccgtaacccgtaacgcggtaggtcgtactacgtattcgttacctaccgaccccttcgtccggtaccggtaacacgtaaccttccgacgtaccggtaaacctaacccgtacctacccgtaacctaaactaacctaacgtaccgaactacgtacggttaggagttacggacggcctcgtaagctancgtacgaccgacgtcgtaccgttactagttcgagtacgacggtacctccgtaccgacggtccgtaggtaccgggtcctaccgggtaccgcgggttccgttaccggttacggttccgtcgggttcgggtacccgggg

SEQ ID NO: 207738 - DNA, 720 bp, Homo sapiens
  misc_feature: GYAE6OF01DHX47.17.25.C03.1.454.CMB.1.raw
  modified_base (105)..(105): a, c, t, g, unknown or other
  misc_feature (105)..(105): n is a, c, g, or t
tcagcgtagactagcacgaccggtgctcgatttagtagtgtagatttggggtttgggggagtcagtctcagtcaggacacagcatggacatggacgggtccccgntcagctcctgggctcctgctactctggctccgagctgccagatgtgacatccagatgacccagtcctccactccctcctgtctcgcctcgtggtggggtcagagtccacatcactcggaccgacaacgtcgaacggtacgttaaaacttattaaattcggtatacgagacaacgaaactaacggaaaacgcccaacgacctcctagtactcgtacgtggtacgaccactacccaccttcgtacggacgtaaagggttcgggccctacctaggtaccggtaagggttcaggtacggcgtacggtagggtaagtccggtaggggaacctagtttacgttaactaacttacccgacctaaaccaccgttaccctaacctacctcgtaacggtaacccaacgttaagggaacgttagttgtagtaaccaactttacccttaacttaacgttacgttaaacaacgtaacgttaaccgtttaaccttacccgttccccttctaccggtttacgttacgggtacccggtaaaccggggtaactaaagggtttagaacccgtaattaacccgaaacggtacttaggccggtactacggaacctaccgtattcgttccgttacc

SEQ ID NO: 207739 - DNA, 871 bp, Homo sapiens
  misc_feature: GYAE6OF01BN3VG.17.25.C03.1.454.CMB.1.raw
  modified_base (191)..(191): a, c, t, g, unknown or other
  misc_feature (191)..(191): n is a, c, g, or t
tcagcgtagactagcacgaccggtgctcgatttagtagtgtagatttgggttggggactcaacaaccacatctgtcctctagagaaaccctgtgagcacagctcctcaccatcggactggacctggagactcctcttcgtggtaggcagcaggctacgaacgtcgcccactcccgaggtcgcagtctggtnacgagtcgtgggcctaggacggtagaacgacgtccgtggggtacctacggagtacggtaacggttcctccgtaggacgtaacggtccgtttggaggtaccttaccggtaccgttttaaccgtacgttaacgtacgttactaaccgtaacgtcggggttcacccggtaccgaccggtccgttacgacgggaacccaacgggttacctagggtacgtacgggtagtacgggacgttacggggacccccgtaaaccgtaaacgtccgggttagtaccggtaccgtaacgttacggttaccgtttacctaccccaaacccggtttacgtacccccgggtacgggtaacgtaaacccggttaaccttacccgtaacggttaccgaacccggtaaccttaaccctacccggttaaccaaacggtttaaacccaaacccgtaccggtaaccgtaaccggtaaggttaccggtacgttaccggacgttaaccgggtaccctaagttacccgtaaccgttacgtaaccgaaccgggtaactccggggttacttacgttaaccttacgggtacgacgggtacccggaaactccggtaacccgtacggtacccgggttacctacgggaccgtttcccgaaacgggttacgccggttaccttacgggttaccgttcggccggtacccggggg

SEQ ID NO: 207740 - DNA, 777 bp, Homo sapiens
  misc_feature: GYAE6OF01CPPTV.17.25.C03.1.454.CMB.1.raw
  modified_base (185)..(185): a, c, t, g, unknown or other
  misc_feature (185)..(185): n is a, c, g, or t
  modified_base (220)..(220): a, c, t, g, unknown or other
  misc_feature (220)..(220): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcaactggtncagtcgtgggctgaggtgaagacgcgtggggcctnagtgaaggtctcctgcgagtcttcgtgtacttctaccgtttaccctctatagttactacgtaacgttggggtacgccggaccgagggccccgtgtacgggaaccaacgtacctggaggtggagtgggatcggggaccgtaaacccttacgacgtggtacgtcctacgaggttcgtcttacccacccgtacgttcccggccggtaacgtcgtaaccgtttaccagttaccgaacccgtacgtaacctttcccaaccgtaaacctaaaccgaccgtaccgtaacccttacgtaacggttagggttacgttacggaacgggaccgtacccggtaccgtaccgtacgttccgttaacgggacccgtaacccgggacccgggtcccttttaacgttacgttttaccggttgggtacccggtacgtaaccgggtaccgtacccccgtaagggttaccggttccggggaccggttaaccggtcccgggtaacccggacggttaccgggtcccggggtttacccttttacggaaccggtttccggggtccggggggtaacccggg

SEQ ID NO: 207741 - DNA, 854 bp, Homo sapiens
  misc_feature: GYAE6OF01BXPAM.17.25.C03.1.454.CMB.1.raw
tcagcgtagactagcacgaccggtgctcgatttagtagtgtagatttgggtttggggactcaacaaccacatctgtcctctagagaaaaccctgtgagcacagcctcctcaccatggactggacctggaggtactcctcttcgtggtggcagcagctacagtcgcccactcccaggtgcagcgtggtagctagtcggtgggcgtggtaggtaggaaggacgtccggtcggggcctcgaggtaggaacgttcctccgtagacgaacggttcttgtaggtacttccgttaacgttttaccctacttaagtacgtacgtacaacggttcgggtcgccgccggaggcccgtacgtcggaaaccgtaacgtccgtgggaggtcgggtaaggacggggtacggtaccggggaacccgtaaaaccgttaaccgtacgggttggacggtacctaagtacggtttcgttacccttacccgaaccccgttacttaccccggggccggtaactaaaccgtttaccgttaacctacggaccgtaaaaccccgtaccgaacccctttcccgtaaacctaaactaaaaccccgtaacgaccgttaaccgtaacgtagggtttaacggacggttaacgggacgaacgcggttaacactacgtacggtaacgacccgggtaaccgtccgggtttaccctaagtttcccgttaggacgttcgaaccgggtacgtaacccggtacccgtagggtaccggggtttacccgaacgggggtaccccttacccggtaacgggaccccgggttaccgggtttaaccccgttgggtttttaaaccccggcggggttttccgggggtaaacccgggggg

SEQ ID NO: 207742 - DNA, 1029 bp, Homo sapiens
  misc_feature: GYAE6OF01B1IQG.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatgactggacctggaggactccgtcttcgttggtggcagcagctacagtcgcccactccaggtgcagctaggtcgcaggttcgtcggggtctagggtaggtacgaacggtaccgtccggttacggggccttacggtaaggtccggtaacgggttcccttccgtaggaccgttaaacggtccgttttcggttaacgggttaacttttacccgtttaaccggtttttaacccccgttacgttaacggtttaaaccggttaaccgtttaacccgtaaacggggttttcgggggtaccggccccggtaaccccgggtaccggggcccgttaaccgggttaccgggaaaacccggttaaacccggtcccggttaggtaaacggggttccgggtaaagggttcggggtaacggtaacccgggggtaaccgtaaaccccccgttaaacggtccgggttaggttaaccggtaccctacggggtttagtttaccccggttccccgtttaaaccgaccccccgttaccggttaccccggggtaacccggggtaaccttaaaccgggttaacccttaaccgggtacccttaaccggaaccccgtaaacccgttacccgttaacccctaaccgtaaaccgtaaaccaccgtaaccgtacctacggtaacgtcgggttaagtcggaacgtaccggtcgtaaacggtactaccgtacggtaccgtaacccgggtaaccggtaccggttacccggttaccttaaacggttccggtaccggtaaccggtccgggttaaccgtacccgtaacccgggttacggtttaccccgggaccggttaacccgggtacccggtttacccgggaaccgtccccggttacgggtccggttttaaccccggttacgttccggggttccgggtaaccccggggg

SEQ ID NO: 207743 - DNA, 563 bp, Homo sapiens
  misc_feature: GYAE6OF01EE5G0.17.25.C03.1.454.CMB.1.raw
  modified_base (332)..(332): a, c, t, g, unknown or other
  misc_feature (332)..(332): n is a, c, g, or t
  modified_base (416)..(416): a, c, t, g, unknown or other
  misc_feature (416)..(416): n is a, c, g, or t
  modified_base (432)..(432): a, c, t, g, unknown or other
  misc_feature (432)..(432): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaaccctaanactggtgtcacagtgtccttcacccatcccgtccgggacagacttaccatcgaaccacgaactccacaataaacacagcctaanagtggagttgacggancctagacatctagacgacgacggtccttctaattacgtgtgcgaggtactaccccgagacgttcccgggtgacgacccgttagggacctacgggccgggttacccttttgggaccgtttcggtacgggggg

SEQ ID NO: 207744 - DNA, 841 bp, Homo sapiens
  misc_feature: GYAE6OF01EFM1C.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggactcctctttcgttggtggcagcagctacagtcgcccactccgaggtgcgagcgtggtgcgtgtcggtgggcgtggaggtagaacgacgtccggtgggcctgaggtcggtaacggttccgtccgtgacgtaacggttcctttcgtaggtactttaccgttaccgttttacccttacgttattacgttataccgtaacggttgggtcgccggcgacggccggcgtacgggaaccgaaccggtccgtagggtaggtaggtacgggtagggtacggaccgggtaacccgtaacccgtaacgtcggttcggtacgtacgtacgttacggttcttacccgttacccgaccctaccggttacccggacccggactaaccgtacttaaccgaccgtaccgaacccgttaaccgttaacccgttcccctaaactaaaccgtaacccacgtaaacccgtacctacgtacggttagggttacggtacgaacgggtacctaccgtaacgtacctacggttccgaaccggtaccggaaccgtttcccgggttaacccgtttacttaaccggttacgggcgttaaccggggacgtaaaccgtcccgggtaacccgtacgggttccgggtaacccggttacggacccccgggttccggtaacccggtcgggttaccccggttcggtttaccccgttttcgggtccggtacccgggggtacggggg

SEQ ID NO: 207745 - DNA, 868 bp, Homo sapiens
  misc_feature: GYAE6OF01DLSSK.17.25.C03.1.454.CMB.1.raw
  modified_base (368)..(368): a, c, t, g, unknown or other
  misc_feature (368)..(368): n is a, c, g, or t
tcagcgtagactagcacgaccggtgctcgatttagtagtgtagatttggggtttggggactcaacaaccacatctgtcctctagagaaaaccctgtgagcacagctcctcaccatggactggacctggaggtactcctcttcgttggtggcagcagctacagtcgcccactccgaggtgcagcgtggtgcgtagtcggtgggctagacgggtagaaggaacgccggtcgggcctacgaggtgacgtctcgacgactaggtcttgtggtaactttccgtaaccgttttacctcgttaagttacgtaacgtacgtaacggtgggtacgccggacggacggtccgtagtaacggaaccgtacggtaaccgnggaggtaggaggtcgggtacggtaccggtaaccgaaaaccgtacgtcggtaggtccgtaacgtagtacggttacgtccttaacccggtaaccctaccggtacccgggttaaccggaaccgtaacggttaaacccttacgaaccgttacccgtaaccgtaaccggttaacccttacccttaaaccgtaacgtaaaaacccgtccctaaaccggttaaccgttaacggtaaccggtttaggggtacgtttaacgggaaacggtaccgttaccggtaacgaaacgtttccgtaacgtaacccgggtaaccggtaacccggttaacccggtttccgtaaacgtttaacggttcctagggtaccggtaccggtaaacggttacccgtaaccggaaacccggttaccgggtaccggcggtaacccgttaccgggtaccgggtaccggtacccgggttacccgggttacccgtttacggtccccggggttacggggtaacccggggg

SEQ ID NO: 207746 - DNA, 901 bp, Homo sapiens
  misc_feature: GYAE6OF01CYW0L.17.25.C03.1.454.CMB.1.raw
  modified_base (181)..(181): a, c, t, g, unknown or other
  misc_feature (181)..(181): n is a, c, g, or t
  modified_base (186)..(186): a, c, t, g, unknown or other
  misc_feature (186)..(186): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctaacaagtcgcccactcccaggtgcagntggtnctagtcgtggggctaggacggtagaagaacgccgtacggggtacctgaggtacggtaacggtcctaccgtcggaccgtaaggtccttcgtgggtactttacgtacccgttttaccgttaccttaatacgtacttaccgtaacggttgggtaccgacggcccgaccgggtcccggtaccgtacggaacccaaaccggtaccgtacgggtaggtacggggtagtagggggtaacgtaccggggaacccgtaaacccgtaaccgtacggttcggtacgtacgtaaccgtaggtttccgttacccgttaccaaccccgtagttccccgtacccggggtactaaccgttaacctaccgtactacgtaacccgaacccgtaccgtacccaacctaactaaacccgaactaccggtaacctaacggacgtttacggggacttacgggaacggtacgtaccttacgggaacctacggttacctaacggacccgttaaacccggtaccgggtacccttaacggtttaaccttaccggtagggttacccggttaacggaaacccgggtccccggttaacccgggtaaaccccgggtaacggttacccccggggttaaggtacccccgttaacccggggtacccggtaacccggttaaccccgggggttacccgtttaccccggttttagggttaacccccgggtttcggggtaaccccggggggg

SEQ ID NO: 207747 - DNA, 1030 bp, Homo sapiens
  misc_feature: GYAE6OF01A8PC0.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccagtggactggaccgtggaggactcctcttcgttggtggcagcagactacaaggtcgaccccaccgtcccgaggtcgcgagtcgtgggtgcgtaggtcggttggggcgttggaggtagaacggaacgccggttcggggcctacgtagtacggtaacggttcctccgtggaccgtaaggtcgttcgtggtacttccgtaccgttttacctcgtatacggtactacgtaacgtcgggtcgccgtaccgacgggccgtcgtacggaacccgtacgtaccgtggtacggtaggtaacgggtggaaccggtaccgggtaacccgtaaacccgtagtaccggttcggttacggtaaccctaacggtccgggtttaccgtttacccgtaaccccggttacccctacccgtttaccccgggaaccggggtaaccctaacgggttaaacccccgttttaaccctaccgggttaaaccccgtaaccccgtaaaccccggttaccccgtttaacccccaaaaccccttaaaaccggttaaaaccccgtaacccggttaaacccggtaaccccgttaaacgtaaacgggggtttccggggtaaacggtttaaccgggggaaccggggtttaaccctaccccggtttaaacgggaacccgtttacgtaacccgggtacccgggtaaacccgggtaacccggtaaccccccggggtttaacgtttaaccttaaccgttttaaccgggtccgggttaaaccgggaaacccgtttccgggtaaaccccgttaccccgggtaacgttaccccgggggtttccgggtaaaccggacccccggtaacccggggtaaccggacgggttaaaccccccggggtcgggtttttaccccggtttaacggtccccggggtttacccgggggtaaccccggggg

SEQ ID NO: 207748 - DNA, 809 bp, Homo sapiens
  misc_feature: GYAE6OF01BLGTI.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttggtggcagcagactacgaagtcgccccactcccgaggtcgacagtccgtgggtgcgtaggtcgtggggctgggaaggtaggaagacgccgttggggacctgaggtaggtaacgtcctccgtgacgaaggtcttcgtaggtacgttctaccgtttaccgacttagtacgtatacgtaacgtcggtacgtccgccgacggccgtccgtacggtaaccgaccggacgtaggtacggtaggtacggtaggggtacgtaccgggaaacccgtaaaccccttaccgacggttcggtacgtaccgacgttacgtcggtttacccttacaacccgtacgtacccggtaccggaacgtacgtactaccgatccgaaccgtaccgtaccctacctaccgtaaacctaacctaacgtaaccgtaccgtacgtacgttacggtagttaacggcgtaaccggtcgtaacgtaactagtaccggtagaacccgaaccgttacccgggtaccttttacggttacttacggttaggaacccgtgggttaaacccgtccggttaacccgaaccggggtttcccggttaccccggtacgggtcccgtacccgggttaaccgacccgggttacggtacccgggtttaccccgtttacggtacccggtttcggggtaaaccccgggg

SEQ ID NO: 207749 - DNA, 831 bp, Homo sapiens
  misc_feature: GYAE6OF01AUED7.17.25.C03.1.454.CMB.1.raw
  modified_base (278)..(278): a, c, t, g, unknown or other
  misc_feature (278)..(278): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcgttggtggcagcagctacagtcgcccactcccgaggtgcgagtcgtggtgcgtagtcgtggggctggaggtagaacgagccggtgggcctgagtggacggtctccgtgcagtcttcgaggtacttctaccgtttaccncgttatagtactacgtaacggtgggtcgccgtaccgacggcccgacgtaccggaacctaaccggtccgagggtacgggtaggaggtacggggagtcggggtaaaccctaaacccgtacgtacggttcggtcgtacgaacgttgggttccttacccgtaccgtaacccgtacgttaccccggtacggggtaacctacggttaaccttacccggtaatacccggtaaacccgtaaccgtacccttaaccccaccttaaaacgtaaccccgaacgttaccggaacccttaacggtacggtaaggggttaacccgtttaggggaaaccgtacccgtaccgtaacgttaacgttaccgtacggtaaccggtaacccgggtaccgtaaaccggggtttccctttaacccgttaagttacgggtacggtacggaccggttaaccggtacccggtccccggttaaaggtcccggtcgggttaaccgcccgttacccgggttaccgggaccgtacggggtttcccttaccggttttacggccccggtttagggacccggggg

SEQ ID NO: 207750 - DNA, 688 bp, Homo sapiens
  misc_feature: GYAE6OF01E5NX8.17.25.C03.1.454.CMB.1.raw
  modified_base (319)..(319): a, c, t, g, unknown or other
  misc_feature (319)..(319): n is a, c, g, or t
  modified_base (499)..(499): a, c, t, g, unknown or other
  misc_feature (499)..(499): n is a, c, g, or t
  modified_base (531)..(531): a, c, t, g, unknown or other
  misc_feature (531)..(531): n is a, c, g, or t
  modified_base (627)..(627): a, c, t, g, unknown or other
  misc_feature (627)..(627): n is a, c, g, or t
tcagcgtagactagcacgaccggtgctcgatttagtagtgtagatttgggtttggggactcaacaaccacattctgtcctctagagaaaacccgtggtgagcacagctcctcaccgatggactggacctggaggatcctcttcttggtggccagcagctacaagtcgcccactcccgaggtgcagcgtggtgcagtcgtgggctggaggtagaaggacgccgtggggcctgagtggaacggtcctcctgaccgtaaggtccttcgtaggttacttccgtaaccgttttacctccttaatacgtactcgaacggtggtcnccgtccgacgccgagtacggaacctaacgacgtggaggtggagtcgggacgtaccggaacctaaacccgtagtcggttagtacgtactacgtacgttctaccgtacccacccgtacgtacccggacgactacgtaccttacgacgtaccgaacctaccgtaccctaccactaaacgaccncgacgtacctagtcgaggtagtacggacgtcnccgtagacctggacgtacgaccggtaccctgggtaccctttagtaccgttaggtcggacgtaccggtccgacccgaccgtaagcccgggttacggnggtaacccgtcccgtaggttacgccggtttcttaccggttcggtcccgttggggacccggg

SEQ ID NO: 207751 - DNA, 805 bp, Homo sapiens
  misc_feature: GYAE6OF01BJXHA.17.25.C03.1.454.CMB.1.raw
  modified_base (156)..(156): a, c, t, g, unknown or other
  misc_feature (156)..(156): n is a, c, g, or t
  modified_base (640)..(640): a, c, t, g, unknown or other
  misc_feature (640)..(640): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctanaagtgcccactcccaggtgcagctggtgcagtcgtgggctggaggtagaaggaagccgtcggggcctcgaggtggaacggtcctccgtgacgtaaggtctttacgtaggttattaccgtaaccgtttttacccttaccttagtaacgtttaacgtaccgtaaaccggttgggtacgacccggaccggtaccgggccgtccgtacgggaaacccgtaaccgtacccgtgggtagggttaggggaggttaggggtaacggtaccggggaaacccgtaaaccccgttaacgaaccgttgggtaccgtacgaacgtacggttcgttaccttacccgaacccgtaccgttacccggtacccggggtaacaacggttaccttaacccgtacgttaacccgaacccgtaaccgtaaccttacccctaacgtaaacctaaaccaccgaaacgtacccgttaatacgtagggtacgtttaggaacggtaaccnccgttaagaccttagtaccgtcgaacgtaccgaccgggttacccgtacgttacttacgcgtacggacgtacgtacccgacggaacgcgggttacccgacggaaaccgtcccgtacggaccgttcgggacccgttccgtttacggtaccggttcgggtaaccgggg

SEQ ID NO: 207752 - DNA, 796 bp, Homo sapiens
  misc_feature: GYAE6OF01C8MAT.17.25.C03.1.454.CMB.1.raw
  modified_base (636)..(636): a, c, t, g, unknown or other
  misc_feature (636)..(636): n is a, c, g, or t
tcagcgtagactagcacgaccggtgctcgatttagtagtgtagatttgggtttggggactcaacaaccacatctgtcctctagaagaaaaccctgtgagcacagctcctcaccatggactggacctggaggactcctcttctggtggcagcagctaacgaagtcgccccactacccgaggtgacgagcgtggtcgcgagttcgtggggactaggaaggtagaagacgccgtcggggcctcgaagtggaacggtcctccgtagacgtaaggtccgttagtgggtactttaccgaccgttttaccctacgtaattaggtaatacgtaacgttgggtacgccggaccgaggccgtacgtaacgggaaccaaccgtacgtaggaaggtcggtaaggtgggaacgttaccggggaacccgtaaaaccctaaacgcggttaacggtcgttaaccaacgttagttacggttacccgttacccaaccccgtaacgtttcccggtaaccggggaaactaacgtaaacccgttaacccgaacgttaaccggaacccgtaaccggtaaaccctcccggtaaaccctaaactaaaaccgaacccgtacggtaaccctaaacgtaagtagggtaacggtacgaggtacnccgtagacctgtacgagaacgaccgaaccgggttctaagttacttacgtacggtgaaccgtaaggtacccgtaacccgacgtaacggtacccggtagaaacccgtccggttaccgaccgggtacgttacccgtagttcggtaccgttcgggaaaccgggg

SEQ ID NO: 207753 - DNA, 781 bp, Homo sapiens
  misc_feature: GYAE6OF01BUFRM.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcgagtgaaggtctcctgcaaggcttcgtaggtattcgtaccgtttaccttcctatagtatcaacgtggtgcgccaggccgactaggacaacgaccttggacgtaggacgtcgggagtcgggacctaaaccgtaacgacgtggtcgtacacgacgttcgtccttccgaaccctcgtaccgtacccggggtaacaacggtaacccttaaacccgtagtacggtaacccctaacggtaacccttaccccgtaacccgtaaactaaaaaccgtaacccgaaaccggtacccgttaaaccgaacgttaggggtaaacggttttcggaaaccggggtaacgacccgtttaacgaacccgtaacgttaccgtaacgggaacccggttaaaccgttaacccggggtcccggtttaaactttaaccgtttacgtaggtaccggtaaccgggtacgtaccgtaaccccggtaccgaaccgtttcccgggggttacgccgtaacccgttaaccggggacaccgggtacccggttaccccgttttcggtaacccgtttcgggaacccgggggg

SEQ ID NO: 207754 - DNA, 779 bp, Homo sapiens
  misc_feature: GYAE6OF01B5MPU.17.25.C03.1.454.CMB.1.raw
  modified_base (232)..(232): a, c, t, g, unknown or other
  misc_feature (232)..(232): n is a, c, g, or t
  modified_base (264)..(264): a, c, t, g, unknown or other
  misc_feature (264)..(264): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcgttggtggcagcagctacaagtcgcccactcccaggtgccagctggtcgctaggtcgtggggctggaggtagaagaacgccgtggggcctgngtaggaaggtcctctgacaaggtcttcgtggnttcgtacgttcctctatagtactacgtaacgtggtgccgaccgaggcccgtcgtacggacgtaaccgaccgttagacgggtggtaagtggggacgtcgggaaccgtaaacccgtaacgtacgttgggtctacggtacaggttacgttccttccgaaccccgtacgttacccgtacccggggactaacggaacctttaacccgagttaccgaacccgtaaccgtaaccttcccctaaccgtaaactaaacccgaccggttaaccaacccggttaaacctaggtaacgggtaacggttacggaacgggtaccgtaccgtaacggtaactacgtttacccggacgtaaccgggaccgtaccgggttacccgttactttaacgtcggtacgtacggtacggtacgtacccgtaaccggtaacggtccggtacccgggtaggttacccggaccggtaacgggtacccgtacgggttcccggttacccttttcccgggttaccgtccgggttacccggggg

SEQ ID NO: 207755 - DNA, 802 bp, Homo sapiens
  misc_feature: GYAE6OF01B95NH.17.25.C03.1.454.CMB.1.raw
  modified_base (237)..(237): a, c, t, g, unknown or other
  misc_feature (237)..(237): n is a, c, g, or t
  modified_base (249)..(249): a, c, t, g, unknown or other
  misc_feature (249)..(249): n is a, c, g, or t
tcagcgtagactagcacgaccggtgctcgatttagtagtgtagatttgggtttggggactcaacaaccacatctgtcctctagagaaaaccctgtgagcacagctcctcaccatgactggacctggaggatcctcttcttggtgcagcagctacgagtcgcccactcccgaggtcgcagcgtggtgcagtcgtgggctagagtagaagacgccgtgggcctagagtacgagtctcgngacgagtcttgngtacttactaccgtttacctactatacgtactacgtaacgtggtcgccgccgaggtcccgagtacggaaccaacggtccgtaggaggtacggaggtgggacgtacgggtaaccaaaccctacggtacgttggtccgtacgacgtaggttcctaccgtaccctaccctaccggttacccggtaaccgggtaacctaacggttaacccttaaccgtaacgtacccgtaacctaacccgtaacccgttacccctaaccaaacctaaacgtacccgtaaccgtacccgttaaacgtacggttaacggtacggttaacggtaacggaaccgttccgtaacgtactaaccgtacgtaccggtaaccggtaccggtacccgggttaccgttaccgttaacgtttaccggtacggtacggtacggtaacccgtaccgtaccccgtaacggttacccggtaccggtaaccggtacccggtaccccggttaaccgggtaccgtacccgggttccgggtttaaaccccggtttcggttcccggttccgggggtaacccccgggg

SEQ ID NO: 207756 - DNA, 694 bp, Homo sapiens
  misc_feature: GYAE6OF01DT0A8.17.25.C03.1.454.CMB.1.raw
  modified_base (560)..(560): a, c, t, g, unknown or other
  misc_feature (560)..(560): n is a, c, g, or t
  modified_base (653)..(653): a, c, t, g, unknown or other
  misc_feature (653)..(653): n is a, c, g, or t
  modified_base (672)..(672): a, c, t, g, unknown or other
  misc_feature (672)..(672): n is a, c, g, or t
  modified_base (688)..(688): a, c, t, g, unknown or other
  misc_feature (688)..(688): n is a, c, g, or t
tcagcgtagactagcacgaccggtgctcgatttagtagtgtagatttgggtttgggagtcagtctcagtcaggacacagcatggacatgagggtccccgctcagctccgtggggctcctgctactctggctccgagctgccagatgtgacatccgagactcgacccagtcctccactccctcctgtctcgcctgtggtggggtcagtacgtcaccatctacttcggaccgtactaacggtccgaacggtaaccttaaaaaccttagtttaaagttcggtactacgacgaacaacgaaaaccgtaacggaaaccgccctaacggtacccttacgtacgtaacgttccgtttacgtacggttacacctacgttccgtaaccgttccgtagggtaccggtaaacggtcgggtaccccgttaccccgaaggttcccgggtaacggtttcgtaacgggttcggacgtacggtacggtaacgtcggtacggtaactaggttacttaccgaacgttcctaaccgtactaacgtccctaccgtagtcctacgaaactaccgagtagtnttacggtacaacttacgtactaacgtcgtcgtaacacgtaacgttacgtaccctacgttcctagtccttagttcggacgaacgtactagtganactacgagttcgcggtacnctcgaccatgtccgtnttaccg

SEQ ID NO: 207757 - DNA, 916 bp, Homo sapiens
  misc_feature: GYAE6OF01DBJHJ.17.25.C03.1.454.CMB.1.raw
tcagcgtagactagcacgaccggtgctcgatttagtagtgtagatttgggtttggggactcaacaaaccacatctgtcctctagagaaaaccctgtgagcacagctcctcaccatgactggacctggaggatcctcttcttggtggcagcagctacaagtcgcccactcccaggtgcagctggtgcagtcgtgggctggaggtgaagacgcgtggggcctcgaggtagacggtctaccgtcggacgaaggtccttcgtagggtactttaccttaccgttttacccgttacctaagttagttacttaccgtaacggttcggggtcggcccggaccgtacgggtcccgtacggttaccgaaaccgtaaccggtaccggtagggtaacgggttacgggtaaggttcggggtaaacggttccggggtaacccggtaaaaccccgtaaaccggtacgttcgggtaaccgtctaaccgaacgggtttcgtttaccctttacccggaaacccctacgtttaccccggtaccggggaaaccttaccggtaaccctttaaccccgaagttaccccggaaaccccgtaaacccggtaacccccttacccgttaaacccaaaaccttaaaacccgaaaccccgtaaccgtacccgttaaacgaaccggtttagggtaacgttacgggtaacggaccgttacccgttacgaaccgttaacgttcggtaacccgaaccggtaccccgggtaccggggttacccgttaacttttacgttaaaccgtcgggttaggtaacccggtaagttacccccggtacccgtaaccgggtaaccgttaccgggttaccggtaacggtaccccgggttaacggaccgttaccgggttacccgttccggtttaccggtcccggttcgggtacccgggggg

SEQ ID NO: 207758 - DNA, 698 bp, Homo sapiens
  misc_feature: GYAE6OF01CCOKO.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacagtgcccactcccaggtgcagctggtgcagtctggggctggaggtgaagagccgtggggcctcagtgaggtctccgtgcaggctgtggattcacgtttacctccttatagtactcaacgtggtgcgccgtacggccgcgtacggactaaccgaccgtgaggtcgggtagtggggtagtcgggaccgtaaaccctaacgtacgtggtcgtcacgtagtcgttctccgaaccctctcccgtaccgggacacgtaccttaccacgtacgaaccctacgaacccttcccgtaccaaactaaaccaactaccgacccgtaactaggttacgggtaagttaggaacggacgtacccgtacgaacgacttacgacggaaccggtaaccggacccggtcccggttacttaacctttacggttcgggtacgtccgggtaaccgtcccgtaccccggtaacggtccgtacccggggtggaccgtaccccgggtaccgccggtaacgggtccccggttaccgttttctacccgggtttccgtaaccggggggg

SEQ ID NO: 207759 - DNA, 867 bp, Homo sapiens
  misc_feature: GYAE6OF01DFVC5.17.25.C03.1.454.CMB.1.raw
  modified_base (717)..(717): a, c, t, g, unknown or other
  misc_feature (717)..(717): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctaacaagtcgcccactcccaggtcgcagctaggtgcaggtcgtggggctggaggtacggaaagaaggtcccggtgggggtaccctagaaggttacggaacgggttcctccgttagcgtaacggtcgttctgggtactttcccgttaaccgttttaacccgtccgttaagttacgtaagttacctaacggttgggtcggaccgaccgaccgggtccggtacgtacggaacgtaaccggtaccgtaggtaaagggttcggaggttggggacggttcggggaaaccctaaacccgtaaccgtaccggttggtaccgtacgtaccgtacggttcgttacccgttaccgaaccccgtacgtacccccggtaaccgggtactaaaccggttaccttaaccgaacgttaccggaacccaacccgtaacccttacccgtaaccaaagtaaacctacgacgttaccctaagtacggtaggtcggtttaacggacggtacgtcctacgaactttacgccgttaacggaacccgtaacggtaccccggggttattaccgttaacgtttaccggngttacgggtacccgggtaaacggttccctaaccccggtaacgtcccggggttaagcccgggttaaacccgtcccgggtttacgggacccgttaacggggttccccgtttacccggtttaaacggtcccggttacggggggttaccccggg

SEQ ID NO: 207760 - DNA, 730 bp, Homo sapiens
  misc_feature: GYAE6OF01DY25B.17.25.C03.1.454.CMB.1.raw
tcagcgtagactagcacgaccggtgctcgatttagtagtgtagatttgggtttggggactcaacaaccacatctgtcctctaagagaaaaccctgtgagcacagctcctcacatggactggactggagatctcttctggtgcagcagctacagtcgcccactccgaggtgacgacgtcgtggtgcgtaggtcgtggggctaggaggtaggaacgagtccggtagggcctacgagtaggtacggtcctccgtgacgacgttctcgtagtacttccgttaccgtttacctacgttatacgtactacgtacggttggccacgaccgacggcccacgtacggaacgtaccgtacgtggtacggtaggtaggtacggaggttaccgggaaaccctaaccctaagacggtggtactacctagtcgttacgtcccttacgaacccgttcgtcccggtacggactaacgtaccgtactacgtaaccggacctacgtaacccttacctaacctaaactaacccggtaactacgtacccgttaagtacggtagggtacgtagggacggtccgtacgtagacctacgtacgggaacgtaccggtaccggacccggttacgttacttacgtttaccgtacggcgtaaccgtaggtccctaacggtaccgtcggtaccgggcaacccggtaccgtacggtaccgacggttcccgttacgttaccggtgtccgggggacccggg

SEQ ID NO: 207761 - DNA, 858 bp, Homo sapiens
  misc_feature: GYAE6OF01A5DNE.17.25.C03.1.454.CMB.1.raw
  modified_base (196)..(196): a, c, t, g, unknown or other
  misc_feature (196)..(196): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacagtcgcccactcccaggtcgcagtcgtggtgcgagtcgnggggctgaggtagaagaacgcgtcggggcctcgagtacgaaggtctccgtgacgaacggtcttcgtaggtactttactaaccggttttacctaccttaattaacggttaattaccgtaaacgttcggggtacggaccccggaccgaccggggtaccccgggtacttaaccggggaacccgtaaaccggtacccggttgggaacgggttacgggtagggtacggggtacggtaccggggtaaccccggtaaacccgttaaaccgtacggttcgggtacggttaccgaacgtaaggttcgtaccgttaccctaccgtaccttaccggtaccgggtaccgtacgttaaccttacgtaacgtaccgaacccttaacgtaacccttcccctaaacggaaccttaaaacctccgtaaaccgtccaacgtaacgtgggttaacggttacggaacggttacgacgttaccgaacgttaccgttacgtaacggaacccggtaccggtacccggttaaccgttaaccgttttaggttacccttacgggtaacgaccggtacgtacccggtaacccgtacggtacccggttagggacggacccgttaccggacggaccccggtacggttccccgtaaccgggtttacggttcccggttaggggtaccccgggg

SEQ ID NO: 207762 - DNA, 851 bp, Homo sapiens
  misc_feature: GYAE6OF01BAKSN.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttgggtggcagcagctacaagtcgcccacctcccgaggtgcagtctgggtgcgagtcgtggggtctggagggtaggaaaggaacggtccggtcgggggcctacgaaggttacggaaacgggttcctcccgtaggacggtaacgggtcctttcggtacggtactttaccgtaacgttttacccttacttaattacgttactacgtaacggtggggtcgaccgtccggtcggcccgtcgtacggaaccgtaaccggtaccgtagggaggtaggacggtaggggacggtccgggaacccgtaaaccgtaacggtcggtcggtacgtaccgtacgtagttcgttacccttaccgaccccgtaccgtcccggtaccggaacgtacctaaccgtttaccgaacgtaaccggtaacccctaaccgttaaccccttaccgaaacctaaaactaaacccgtaaccctaacccgttaaccgtaaacgttaagggttaacgggtaaccgggttagggaaaccggttaccgtacccgtaaacgtaacgttaccgtaacggtaaccgggaacccgttaacccgggtacccgttacccgtttactttaaaccggttcgtcgggtacgtacggtaaccgtccgaacccgggtattccgggacggttaccggctacccgggacgacgtccgggttaccgttcgttacgtccgggtgggtaccccggg

SEQ ID NO: 207763 - DNA, 735 bp, Homo sapiens
  misc_feature: GYAE6OF01EGJ36.17.25.C03.1.454.CMB.1.raw
  modified_base (375)..(375): a, c, t, g, unknown or other
  misc_feature (375)..(375): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtctccgtgcaaggtcttcgtggtacttctaccgttttaccctccttatagtactcaacgtgggtgccgccgaggccgctgggaaccaacggaccgtggaggtcgggagtgggagtcggggaccgaaaccctaacgacgtgggtntcgactagtcgtccgtcaccctacgtcccggtaccggactacggaccttaaccgagttaccgaaccctaacgtaacccttacccgtaacctaaacgtaaaaccaccgaacgtaccctaacgtacgtagggtaaggttcgggaaacggtaccgtcccgtacgtaacgtacgttaccgtaacgggtaacccgaacccggtacccgggtacccgttttaacccgttaagtttaacccgttcgggtacggtaccggaaacggttacccgtaccccgtaacggtaccggttccgggtaacggccggtacccggtacggaccgtacggccgggttacccgtttcgtccgttcggggtacccggggg

SEQ ID NO: 207764 - DNA, 1078 bp, Homo sapiens
  misc_feature: GYAE6OF01AS3CR.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatgactggacctggaggactcctcttcttggtggcagcagctacagtcgcccactcccaggtgcagctggtgcagtcgtgggctggaggtagaagagccgtggggcctcgagtaggaaggttcctaccgtggacgaacggtcttcgtaggtactttcccgtaacccggttttaccctaccgttaagttaacgttaacgttaccgtaaacgggttcggggttacgccccggtaccgaacggggtcccccggtacggtaaccgggtaaacccaaacccgggtacccgttagggaacgggtttggggaagggtttacgggggtaacggttaaccggggggtaaacccccgtaaaaccccgtttaaaccggtacgggttttcggggttaccggtaacccgttaaccggtaacgggtttacccgtttacccccgttaccccgtaaacccccggttaccttacccccgggtaaacccgggggtacccgtaaaccggtttacccctttaaacccggaaggttaaccccgtaaccccgtaaacccgtttaaccccgttacccccgttaacctaaaacccgtaaacccgtaaaccccggtacgttaaacccccgaaacgtttaaggttaacccggggttaaaggtttcccgggtaaaccggggtaccttacccggttaaaccggttaaccgtaaccgttttacccgggaacgggtaaacccccgggtaaaccggtaaccccggggtttaccccgtttacgttttaaacccgtttaacgggtacgggtaacccgggttaccggtaaaccggtttaacccccggttaaaccccggtaccgggttaacccgggtttaccccggggtacggtaaacccggtacccccgggtttaaacggaccggttaacccccgggggtccccgttttaacgggtttttacccggtacgggttttccccgggggggtaaacccccgggg

SEQ ID NO: 207765 - DNA, 822 bp, Homo sapiens
  misc_feature: GYAE6OF01ANR85.17.25.C03.1.454.CMB.1.raw
  modified_base (504)..(504): a, c, t, g, unknown or other
  misc_feature (504)..(504): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcgttggtggcagcagctacaacgttcccactcccgaggtgcagctggtgcagtcgtggggctgaggtagaagaagccgtggggccctcgaggtcggaaggttcctaccgtgacgtaacggtcctttcgtaggtacttccgtaccgttttaccctaccttaagttacgttaacttaccgaacgttcgggggtcgaccggaccccgtagggccccgtccggttacgggaaccaacgtcccgtaggacggttagggagtcgggagtcggggaccctaaacccgtaaaccgtacgttcggtactacaccgtaggttcttccgttaccacccgtacgtcccgttacggaccgtaacgtaccctttaaccncgtacccgtaacccgaacccgtaacctacccgttaccaactaaacccctacgtaaccaccgttaacgtaacgtacgggttacgttacgggaaggtaccgttcccggaactacgttaccgtaccgttaccggaaccggtaacccggtacccggtacccgtttacggttaacctttaacggttcggttacgacgggtaacgtacccggttaccccgaacgggttacgttcccccggggttaaagccccggtacccgtaacccgggtgaccggttcccggttcccgttacggttacccgttccgggtacggggaccccggg

SEQ ID NO: 207766 - DNA, 702 bp, Homo sapiens
  misc_feature: GYAE6OF01D4V6Y.17.25.C03.1.454.CMB.1.raw
  modified_base (98)..(98): a, c, t, g, unknown or other
  misc_feature (98)..(98): n is a, c, g, or t
  modified_base (161)..(161): a, c, t, g, unknown or other
  misc_feature (161)..(161): n is a, c, g, or t
  modified_base (310)..(310): a, c, t, g, unknown or other
  misc_feature (310)..(310): n is a, c, g, or t
  modified_base (492)..(492): a, c, t, g, unknown or other
  misc_feature (492)..(492): n is a, c, g, or t
tcagcgtagactagcacgaccggtgctcgatttagtagtgtagatttgggtttggggactcaacaaccacatctgtcctctagagaaaaccctgtgancacagctcctcacatgactggacctggaggatcctcttcttggtggcagcagctacgaagtcncccactcccgaggtcacagcgtggtgctaggtcgtgggctaggaggtagaagaacgccgtcggggccttcgagtagtacggtctccgtgacgagtcttacgtggtacttactaccgttacctacttaatagtactacgaacgtggtacnccgtcgacggccgacgtaggaacaccgactggaggtaggtggtggacggtcggaacccgtaacctaacgtgtggtctacgacgtattctcccgtacacccgtgtacccggtaccgataccctacgttaccagtacccgacctaaccgtaccttaccccaataactaacactacgtactaacngtaagtcggtagacgtccgtaccgtagaacttcgtaacgacggaccgtaaccgaccgggtttaccctaatttacgtaccgtgtaggacgtaaccggtccgtaacccggacgttaaccgggttcccggacggtaacccggaccgggttccggaccggtacccggttaccggttacccggtttagttacccgggtcgggtaaaccccggggg

SEQ ID NO: 207767 - DNA, 794 bp, Homo sapiens
  misc_feature: GYAE6OF01A7SYQ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggagatcctcttcttggtggcagcagctacaagtgcccactccaggtgcagctggtgcagtcgtggggctggaggtgaaagacggccgtggggcctcgagtgaacggtcctccgtgctaaggtctttcgtggtactttccgtaccgttttaccctaccttattacgttatacgaacgtgggtcgaccgtccgaaggtcccgtacgtacggaacctaaaccggtaccgtaggtaacggtgggaacggttggggacggtacgggtaacccgtaaaaccccttaacgacgttcgggtcgtacgacgtacgttcgttaccttaccacccgtaccgtcccgtacccgggaactacggtaaccttaacccagttacccgaacccgaccgtaacccttcccgtaaccgtaaacgtaaacccaccgaacgtaccccgttaaataacgggttacgggttaaacgtgggaacgggtaaccgtcccgttaagggacttaaccgttccgaacgaaccggtaccgtaccggggtccttaacttaccgttacgtcgttacggaccgtacggtaacccctacccgttaccggtaccggttacccggaacggtaccgtaccccggtagggtacccgacgggttcccggttacccgtttccggtaagtttcccggggacccggggg

SEQ ID NO: 207768 - DNA, 660 bp, Homo sapiens
  misc_feature: GYAE6OF01E41TE.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctccgtgcgaaggcttcgtggattcacgtttacctcctatagtatcaacgtgggtcgccgccacggccgcgtcggaccaacgacctgaggtggagtgggacgtcgggaccgaaaccctaacgacgtggtcgtacacgaagttcgtacgttaccacccgtacgtccccgtaccgggaacacgtaccttaaccgactacgaaccctaaccgtaaccctccctaccaaacgtaaaccacgtaacgtaccctacgaacgttgggtaagttaggacggtacgccgttacgaactactacgtacggaacgacccggaccggtccgttacttaactttacgtgtcgacgacgtaccgtacccgacggtcgttaccggaggtaccgacccggtacggaccgtacggtccggtaccgtttcgaccgttcggtacccggggg

SEQ ID NO: 207769 - DNA, 774 bp, Homo sapiens
  misc_feature: GYAE6OF01BRPC1.17.25.C03.1.454.CMB.1.raw
  modified_base (295)..(295): a, c, t, g, unknown or other
  misc_feature (295)..(295): n is a, c, g, or t
  modified_base (709)..(709): a, c, t, g, unknown or other
  misc_feature (709)..(709): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaacgagccgtggggcctcgagtgacggtctccgtgacaggtcttcgtggtattccgtaccgtttacctcttaatagtactcaacgtgggtcnccggtcgacggccgtctacgggaccaaccgtacgtggacggtaggagttggggacgtacggggacctaaacccgtaacgacggttggtcgtacgaacgtagttcgttccctacccgacccgtaccgttcccggaccgggtaactacggttaacccttaacctaacgttaccggaacccaccgtaacccttcccctaacccgtaaataaaccccacgtaaccgtaccccgttaagcggtttacgggtaacggttacggtaacggacgtcccgtaacgtacctaggtttcaaacgggtacccgaaccccgtacgggttacccctttagttaaccgttacgttcggaacggtccggtaaacggtcccggttaaacccccgacgtaccgggtttcccggaacgggtcccgggtaaccnccggggtaaccgtaccgggttccccggttacccgtttaggttacccggtttcgggggacccgggg

SEQ ID NO: 207770 - DNA, 950 bp, Homo sapiens
  misc_feature: GYAE6OF01BI8VD.17.25.C03.1.454.CMB.1.raw
  modified_base (185)..(185): a, c, t, g, unknown or other
  misc_feature (185)..(185): n is a, c, g, or t
tcagcgtagactagcacgaccggtgctcgatttagtagtgtagatttgggtttggggactcaacaaccacatctgtcctctagagaaaaccctgtgagcacagctcctcaccatggactggaccgtggaggactccttcttcgttgggtggcagcagactaacaagtcgccctactccgaggtcncacgcgtgggtgcgtacggtcggtcggggctggaagggtaggaaaggtacggtccggtcgggggacctagtaagggttaggtaacggttccgtaccgtgggtaccgtaacgggttccttttacggtacgggttaaccttttcccgttaaacccggtttttaacccctttaccgttaaaggtttaacgtacggtttaccggtaaaccggttgggggtacggtcccggacccgacggggtcccgtaccggtaacggaacccgaaccggtaccggttggacgggtacgggtaggtacggggtacggtaccgggaacccgtaaacccgtaaggttaccggtgggtaccgttacgaaccgttagggtttccctacctttacccgaacccgttaccggttcccgggaacgtaaccgtaacgtaacccttaacgaaccgttccgaaccgtaaccgtaaccctaccctaacctaacgtaaaccaccgtaaaccgtaccgtaacgtaacgggttcgggtaagggttacggaacggtaccgtaaccggtaacgtaccggtaacgtttcccggaaacggtaacccggtaccgggttaaaccccggttcccgttttaaccggttaacgtttcggaacgggttaccggaccggttaccgacccggttaccccgaagggttcccgtaccgggttacggtacccggtaacccgggtacccggacgtacccggggtttaccggttaccggttacgggtttcccgggcggggttaaccgggg

SEQ ID NO: 207771 - DNA, 857 bp, Homo sapiens
  misc_feature: GYAE6OF01B8WT3.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtgcagcagctacaagtcgcccacctcccaggtcgacagcgtggtgcaggtcgtggggctggaggtgaaagacgccggtggggtacctgaggtaggacgtcctccgtggacaacggttcttcgtggtaactttaccgtaccgtttacctaccttatacgtaatcgtaagttgggtcgccgaccgaggccgcgtaggaaccgaaccggaccgtaggacggtacggtaggtcgggacggtaccgggacccgtaaacccgtaaccgtaacggttgggtaccgtacgtaaccgtaggttcgttacctaccctaaccctaccgtcccggtacccggtaacacgttaacctaccgacgttaccgaacccgtaacctaacccgttccctaaaccgtaacctaaaaccgtaaccgaaccgtaaccctaacgtaacgggttacgtaagggttaacccgaacgggtaaccgtaccgtaacgtaaacccgttcgtaacgggtaaccgggaaacccggtaaccgttacccggggttacccgtttaagttaacccgtttaaccggtagggaccggacggttaaacccggtacccggtaaacccggtaccgggtttaaccggttccgggtaaccggtaacccgggtacgggtaaaccccgggcggtaaacccgggttcccggttacccggtttttaccgggtccgggttccggggtaaccccgggggg

SEQ ID NO: 207772 - DNA, 735 bp, Homo sapiens
  misc_feature: GYAE6OF01DHYXN.17.25.C03.1.454.CMB.1.raw
  modified_base (148)..(148): a, c, t, g, unknown or other
  misc_feature (148)..(148): n is a, c, g, or t
  modified_base (360)..(360): a, c, t, g, unknown or other
  misc_feature (360)..(360): n is a, c, g, or t
  modified_base (501)..(501): a, c, t, g, unknown or other
  misc_feature (501)..(501): n is a, c, g, or t
tcagcgtagactagcacgaccggtgctcgatttagtagtgtagatttgggtttggggactcaacaaccacatctgtcctctagagaaaaccctgtagagcacagctccctcaccatgactggacctggaggatcctcttcttggtgcngctagctaacaagtcgcccactccagtgcagctggtgctagtcgtggggtctggaggtacgaaagtacgccggtcggggtcctcgaggtacgaacggttcctcgtacgacgtaaggtcttgtggtaactttacgttacccgtttaccgttaccttagttacgtactacgtaacgtggtcgacgccggacggtccgcgtacggaacaccgacncgtaggtgagtggacgtcgggaacctaccgtaacgcgtggatccgagtgtcgtccgtcctaccgtcgtaccctacggtactacctaccttaacgcgttaccgaacccgtaacgtaaccctacccgtaacctaaacgaaccngtacccgaacttacggacgttagggtcggttacgaacgacgtccggtacgaacgtcgtacgtacgtaacccgacccggtaccggttaccgtcgtttaacgtcgtccgggtacgacccggtacgtaccccgttacccgtacggtaccgttaccgggtcgaaacccgttcccgtaacggacccggtccggtttcgttacccggtttaacggtcccgtttcccggggtaacccgggg

SEQ ID NO: 207773 - DNA, 745 bp, Homo sapiens
  misc_feature: GYAE6OF01B7A1T.17.25.C03.1.454.CMB.1.raw
  modified_base (176)..(176): a, c, t, g, unknown or other
  misc_feature (176)..(176): n is a, c, g, or t
  modified_base (307)..(307): a, c, t, g, unknown or other
  misc_feature (307)..(307): n is a, c, g, or t
tcagcgtagactagcacgaccggtgctcgatttagtagtgtagatttgggttgggactcaacaaccacatctgtcctctagagaaaaccctgtgagcacagctcctcaccatggactggacctggaggactcctcttcttggtgcagcagctacaagtcgcccactcccgaggtcncagctggtgctagtcgtgggctggaggtagaagacgccgtaggggcctagtaggtagacggtcctcgtgacgagtctgtggtacttcgttacgttacctctatagtactacgaagtggtacgccgtaccgnggtcccgagtacggaaccacgtaccgtggtaggttacggagtacggggtacgtacggggaacccctaaaccctaacgtcggtggtacctacgtacgacggtttcgtacccttaccgacccgtaccgtacccggtaccgggtacacggttaccctacgtaacgtaccggaaccctaccggtaacccttaccgtaaccaacgtaacccacgtaaccgtacaaccgttaggcggttaggtacggacgtaccgtacctaacggactaccgtaacggccgaaccgtacccgtaccgttacccgttattaccgtcgttacggaacgccggtaacgtcccgttaacccggagttacccgggtaccgtacggacccggtacccgtacccgggtacgtcccgggtttacccgttaccgtttacgggtcccgttgggggaacccccgg

SEQ ID NO: 207774 - DNA, 684 bp, Homo sapiens
  misc_feature: GYAE6OF01BIL5K.17.25.C03.1.454.CMB.1.raw
  modified_base (186)..(186): a, c, t, g, unknown or other
  misc_feature (186)..(186): n is a, c, g, or t
  modified_base (188)..(188): a, c, t, g, unknown or other
  misc_feature (188)..(188): n is a, c, g, or t
  modified_base (240)..(240): a, c, t, g, unknown or other
  misc_feature (240)..(240): n is a, c, g, or t
  modified_base (288)..(288): a, c, t, g, unknown or other
  misc_feature (288)..(288): n is a, c, g, or t
  modified_base (344)..(344): a, c, t, g, unknown or other
  misc_feature (344)..(344): n is a, c, g, or t
  modified_base (352)..(352): a, c, t, g, unknown or other
  misc_feature (352)..(352): n is a, c, g, or t
tcagcgtagactagcacgaccggtgctcgatttagtagtgtagatttgggtttggggactcaacaaccacatctgtcctctagagaaaaccctgtgagcacagctccctcaccatgggactggacctggaggatcctcttcttggtggcagcagctacaagtgcccactccgaggtgcagctggtncngtcgtgggctgaggtgaagagcgtgggcctgagtgagtctctgcaggcttcngacttactacgtttacctctatagtatcacgtggtgcgtaccacggcncgtaggacctaacgcgtagacgtggacgtagggagcgggtaaccgacccgtaaacngtacggtntcgaacgtagttcgttaccgttaccacccgtacgtccgtaccggggacacgtaccgttaacctagtacgtaccctaacgaaccttccctacctaactaaacctaacgaacgtcctaacgtaacgttagggtacggttacggtacgggacgtacccgttacggaactacgtacgttaccggaccgtaaccggtaccggttaccgtacgttacgttacggtacgttcggactaaccggtacgtaccccgtacggtaccggttccgggtacggtcggacccggtacgtcggtaccggtaccggttccgtttcggtaaccgttcgggtaaccgggg

SEQ ID NO: 207775 - DNA, 798 bp, Homo sapiens
  misc_feature: GYAE6OF01BGC1D.17.25.C03.1.454.CMB.1.raw
  modified_base (686)..(686): a, c, t, g, unknown or other
  misc_feature (686)..(686): n is a, c, g, or t
tcagcgtagactagcacgaccggtgctcgatttagtagtgtagatttgggtttggggactcaaacaaccacatctgtcctctagaagaaaaccctgtgagcacagctcctcacatggactggacctggagactccttcttcgttggtggcagcagctaacagtcgcccacctccgaggtgccgagtcgtggtcgcgtacggtcgtggggtcgtaggtaagggtaggaaacggaacggtcccgggttcgggggaccctacggtaggttacggtaacggttcctacccggttagaccggtaacgggttcctttacggtacggttacttttacccgttaccgttttaacccctacgtttaaaggtacttaacgtaccggttaaacggtggggttaccgccgaccggtcgggacccgtacgtacgggaaccgaaccgtaccggtaggtacggtaggtagggtcgggacggtaccggaaaccgtaaccctaggtaccgtggtccgtagtacgtacggtcgttaccctaccgaccccgtacgttcccggacggaactcgtaacctacgtacgtaccgaaccgtacctaccgtacccaacgtaaacaacctacgtaccgtaacgtacgtaggtgtacggtacggacgtcgtacctagacctagtaccgtaagacccgtaccggtcttaccgtnttaacgttcgtcgacgacgacgtccgtaacccgacgtaccggttaccggacgtacccggtacgaccggcggtaaccgttccggttaacgttcggttcgggcgggtacccggg

SEQ ID NO: 207776 - DNA, 737 bp, Homo sapiens
  misc_feature: GYAE6OF01AO6CT.17.25.C03.1.454.CMB.1.raw
  modified_base (302)..(302): a, c, t, g, unknown or other
  misc_feature (302)..(302): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggccctcgaggtagaacggtcctccgtgacgaaggtcttcgtggtacttcctaccgtttacctctaatagtatactacgtgggtcncgccgtacggccgtcgtacggaacctaacgaccgtagaggtcggtaggtacggggagtaccggggaaccctaaaaccccgtaacgtaccggtggtcgtactacgtaggttcgttccttacccacccgtaccgtcccggtacccgggtaactaccgtaaccttaaccgacgttaccgaaccccaaccgtaaccttacccctaaccgaaaactaaacccacccaccgtacctaacgtagtacgggtaggttacggacgacgtcctaggaacctacgttccgaacgtacccgacccggaaccgggttccttaacggttacttaccggtacggtccgaaacggtccgaacccgttcccggaaggtcccggttacggacggcccgtacccgacggccgtacggtcccggtttacgttccggtaccggttcgggaccgggg

SEQ ID NO: 207777 - DNA, 738 bp, Homo sapiens
  misc_feature: GYAE6OF01D006H.17.25.C03.1.454.CMB.1.raw
  modified_base (153)..(153): a, c, t, g, unknown or other
  misc_feature (153)..(153): n is a, c, g, or t
  modified_base (177)..(177): a, c, t, g, unknown or other
  misc_feature (177)..(177): n is a, c, g, or t
  modified_base (186)..(186): a, c, t, g, unknown or other
  misc_feature (186)..(186): n is a, c, g, or t
  modified_base (253)..(253): a, c, t, g, unknown or other
  misc_feature (253)..(253): n is a, c, g, or t
  modified_base (561)..(561): a, c, t, g, unknown or other
  misc_feature (561)..(561): n is a, c, g, or t
  modified_base (581)..(581): a, c, t, g, unknown or other
  misc_feature (581)..(581): n is a, c, g, or t
  modified_base (583)..(583): a, c, t, g, unknown or other
  misc_feature (583)..(583): n is a, c, g, or t
  modified_base (587)..(587): a, c, t, g, unknown or other
  misc_feature (587)..(587): n is a, c, g, or t
  modified_base (723)..(723): a, c, t, g, unknown or other
  misc_feature (723)..(723): n is a, c, g, or t
tcagcgtagactagcacgaccggtgctcgatttagtagtgtagatttgggtttggggactcaacaaccacatctgtcctctagagaaaaccctgtgagcacagctcctcaccagtggactggacctggagattcctcttcgttggtggcagcngctaacaagtcgccctactcccgnggtcgaccnggtctggtgacctaggtccgtgggggacttgggaggtaggaagtacgcccggtcggggcccttaggngtacggacgttccgtcgtcggacgtacggtctttcggtagtacgtttaccttaccggttacccttacgttaactaacgttactacggttaacgttcggggcgtaccggccggtaccggtccggtacggtaaccggaaccgaaccggaccggttaaggtcgggtagggtagggtaccgggtaacggtaccggggaacctaaaccccgtagttaccggtcggtacggtactaggtacttcgttaccctaccaccgtacgtccgtaaccggactacgtactacacgtacaaccactccgtaccacaacacncgactcagtagagtgacggngntcanatcgctacggctacggtcgtacttcgttaactcgtggtacgaccggtacacccggtaaccgtcggtaccggttccgtacgccgtaccggtaacgggaccgtccggttacccgtttaccgggtacggtttcccgggnggggttaaccccggg

SEQ ID NO: 207778 - DNA, 737 bp, Homo sapiens
  misc_feature: GYAE6OF01AXVDV.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccacctcccaggtgcagctcggtgctagtcgtggggctggaggtgaaggaacggccgtcggggcctcgaggtagaacggtcctccgtagccgaaggtctttcgtggtacttcgtaaccgtttacctccgtatacgtactcaacgtgggtcgccgcgacggccgcgtacggacaaccgacgtggaggtgggagtgggagtcgggacccgaaaccctaacgacgtggtacgtcgacgtagttcgtcctaccctaccctacgtcccgtaccgggacctagtaacccttacgacgtacgaaccaccgtaaccttccctaaccaaacttaaaccgaaccctaaccgtaccctaagtagtacgggaaggttcggaacggtactaccgtagtaccaggttcgaacggaaccgaaccgcccgggttaccctttacgttaacggtttacctgggtaacgtccggtaaacggtcccgtacccggtaacgttacggtaccccgggttaggccccgggtaaccccggcggtacccggtaccggtccccgggtttacgtccgttcccgggttccggggtaacccgggg

SEQ ID NO: 207779 - DNA, 794 bp, Homo sapiens
  misc_feature: GYAE6OF01D1GQA.17.25.C03.1.454.CMB.1.raw
tcagcgtagactagcacgaccggtgctcgatttagtagtgtagatttgggtttgggggactcaacaaccacatctgtcctcctagagaaaaccctgtgagcacagctcctcaccatggactggacctggaggatcctcttcttgggtggcagcagctacaagtcgcccactcccaggtgcagcgtggtgcagtcgtggggctggagggtagaagtaacgccgtggggcctcgaggtagtacggtcctccgtgacgaaggtcttcgtggtatttccgtaccgtttacctcctaattacgttatacacggtgggcgaccggcgacggtccgcgtacgggacgaaccgccgttaggaggtggaggtgggacggtacgggacctaaaccctaacgcgtggttacgtacaagtgtacgttcctaccacctacgtcccggtaccggactacgtaaccttaccgagttccgaaccgtaacccgtaaccctccccgtaacctaaactaaaccgaaccgtacgtaacccttaaccgtaacggttagggtaacgttaccgggtaacgtccgtacccggttaacaacccgttacgttaacccggtaagaaccccgggtaaccggtacccggggtccctttaaccgtttaagttaccggtacggtaccggtaccgggtaacgtcccctaacccgggtaacgtacccgggttaccgggcccgggtaaccggcccggggttaacgcccggttaaccgggtccccggtttaacccgttttcggacccggtttcgggggtaaccccgggg

SEQ ID NO: 207780 - DNA, 867 bp, Homo sapiens
  misc_feature: GYAE6OF01DVJ32.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggaccgtggaggactcctcttcgttgggtggcagcagctacaagtcgcccactcccaggtgcagctggtgctaggtcgtgggggctggagggtagaagaaggccgtggggtcctcgaggtagaacggttcctccgtcgacgtaaggtcgtttcgtggtactttaccgtaccgttttaccctaccttaagttaacgttacttaccgtaaggttcggggtcgccggaccgtacggggcccgtacgtacggaaccgaaccggtaccgtgggtaacggtcgggtaagtcgggggtacgtaccggggaacccgtaaaaccccgttaacgtaacggttgggtcgtaccgtaccgttaggtttaccggttcccttacccgaaccccgtacggttcccccgggtaccgggtaactaccggtttaaacccgtaccttaacggtaccgtaacccgtaaccgtaaccccttccgtaacccctaaattaacccgaaacctaacggtaccctaacgtaacgttcgggtaacgtacgggaagtaccgtccgtaacgtacgttacgtaccgtacggaaacccggtaccgtacccgggttacccttacgttaacgtttaaccggcggtaccggtaccggtacgtacccggtaacccggttaccgggacggtttacccgggggaattaccccggacccggttaccgggaccgtcgggtcccccgtttaagtttcccgggttaaccgttcgggggtaacccggggg

SEQ ID NO: 207781 - DNA, 899 bp, Homo sapiens
  misc_feature: GYAE6OF01AOLJ6.17.25.C03.1.454.CMB.1.raw
  modified_base (582)..(582): a, c, t, g, unknown or other
  misc_feature (582)..(582): n is a, c, g, or t
  modified_base (691)..(691): a, c, t, g, unknown or other
  misc_feature (691)..(691): n is a, c, g, or t
tcagcgtagactagcacgaccggtgctcgatttagtagtgtagatttgggtttggggtacgtcaacaaccacatctgtcctctagagaaaaccctagtgagcacagctccctcaccatcggacgtggacctggaggagtcctctttcgttggtggcagcagctacaagtcgccactcccaggtgcgacgcgtggtcggctagtcgtgggggtctgggagggtagaaaggaacggccgttgggggaccctcgaggttacggaaagggttccgtccgtacggtaccggaacggtcttttccgtagggttactttaccgttaccgttttacctaccttaacttaacggttattaccgtaaacggttggggtcgtaccggccggacggacccgtccggtaacggtaaccgaaaccggtaacccgtaggtacgggttacgggagggttacgggggtaaggtacggggaaccctaaacccggttaaaaccgaccggttaggtacggtacgtaacgtacgggttaccgttaccgttccctaacccgtacgtaccccggtaccgggaacgtaaccggtaccttaaaaccncgtaaccgtaaccaccgtaaccgttacctaaccgaaaccttaaacaacccgtacgtaaccgtaacgacgtaaggggtccgttaggtaaccggtcgaaccgtacgtaacncgttaacgcccggttaacaacccggggaccttaccggtacccggttttataacccgttggacggtaacccgggtagtaccccgggtaacccgtaccgggtacggtttaccccggggtcgggaaccgttccccgggtaaaccgggtacccttacccggggtccggttttaaacccgttacgggttccggttcccgggggtaacccgggg

SEQ ID NO: 207782 - DNA, 687 bp, Homo sapiens
  misc_feature: GYAE6OF01BQQNE.17.25.C03.1.454.CMB.1.raw
  modified_base (220)..(220): a, c, t, g, unknown or other
  misc_feature (220)..(220): n is a, c, g, or t
  modified_base (249)..(249): a, c, t, g, unknown or other
  misc_feature (249)..(249): n is a, c, g, or t
  modified_base (290)..(290): a, c, t, g, unknown or other
  misc_feature (290)..(290): n is a, c, g, or t
tcagcgtagactagcacgaccggtgctcgatttagtagtgtagatttgggtttgggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtagaagagccgtggggcctnaggtgaaggtcctcctgcaaggtcttcgnggtattctaccgtttacctctatagtatcaacgtggggtcnccgtccgacggcccgcgtaggaaccaaccggtacctggacggtgggagtaggggagtcggggaacccgtaaacccgtaacgtacgttggtacgtaccaacgtgttcgttaccttaccaccctacgtcccgaccgggaactacgtaccttacacgtacgaaccacgtacctaccctacaactaaccacgacgacctagacgtggtacgttagacggtacgctagactacgttcaacggaccgacgtaccgggtaccttacttacgttcgtggtcggaaccgtagtacccgtacccgtacggttaccgggtaccggtaacggccggtaccccggtacgggaccggtacgggttaccccggtttacgttttacgggttcccggttcggggtacccggggg

SEQ ID NO: 207783 - DNA, 717 bp, Homo sapiens
  misc_feature: GYAE6OF01E4RXN.17.25.C03.1.454.CMB.1.raw
  modified_base (502)..(502): a, c, t, g, unknown or other
  misc_feature (502)..(502): n is a, c, g, or t
tcagcgtagactagcacgaccggtgctcgatttagtagtgtagatttgggtttggggactcaacaaccacatctgtcctctagagaaaaccctgtgagacacagctcctcaccatggactggacctggaggatcctcttcgttggtggcagcagctacaagtcgcccactcccgaggtgcagctggtgcagtcgtggggctggaggtagaagagccgtggggcctacgtagtaggacggtctccgtgacgtaacggtcttcgtggtacttccgtaaccgttttacctcgttaatacgtactcgaacgtgggtcgccgccgacgccgcggtacgaacaaccgtaccgtggtaggtggtaggtacgggtacgtccgggaacccgtaaaccctaaacgtcggttggtccgtacgacgtacggttcgttccttacccgaccctcgtcccggtaccggactacgtacctacgacgtacgaaccctacgacctacctacaactaaccnctaacgtcctagtacgtcggtagttagacggtacctcagactcgtgaacgtaaccggacgtacccggtagttacttaacgttccggtgtaccggacgtacggacccgttacccgaaggttcccgtttaaccggggacttaccccgggaccgtaccgggcggtaacggtttcccgggtttacccgtcgggttcccgtttaaccgggggtcccgggg

SEQ ID NO: 207784 - DNA, 859 bp, Homo sapiens
  misc_feature: GYAE6OF01CMFW5.17.25.C03.1.454.CMB.1.raw
tcagcgtagactagcacgaccggtgctcgatttagtagtgtagatttgggtttggggactcaaacaaccacatctgtcctctagagaaaaccctgtgagcacagctcctcaccatggactggacctggaggatcctcttcttggtgcagcagctacaagtcgcccactcccgaggtgcagcgtggtgcagtcgtgggctggaggtagaagacgccgtcggggcctcgaggtacggaacggtcctccgtgacgtaaggtccgtttcgtagggtactttccgttaaccggttttaaccttaccgttaattacggttactaccgtaacggttggggtcgccggcgtaacgggcccgtacgtacggaacctaaccggtaccgttggaggtgggtaaggtgggagtcggggaacccgtaaaccctaacgtacgttcgggtctacgaacgtaggttcgtaccgttaccaacccgtcgtccccgtacggggaactacgtaacctttacgacgtaccgtaacccgtaaccgtaacccttacccctaacctaaactaaacccgaaccgtaccggtaaccttaaacgtaacggttacggggttaaacgttacgggaaccgggtaccgtaacccgttagggtaaccctaacggttccgtaaccgggaaccggtaaccggacccgggttaccgtacgtttaaccgtttacggtacggtaccggtacggtaacccgggtaccgtaaccccggaaccggttaccgggttacccgggtaacggtcccggtaaaccccggtaccgggtaacggttaccccgggtaccggtttcccggttttaaccgggttcccgtttaccggggggacccggggg

SEQ ID NO: 207785 - DNA, 816 bp, Homo sapiens
  misc_feature: GYAE6OF01ENHFL.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccgaggtgcagctggtgcagtctggggctgaggtgaagaagccgtggggcctcgagtggaagttctccgtgacaaggtcttcgtggtattctaccgttttacctccttaattagttactactaacgtcgggtcgaccgaccgaggtcccgacgttacggaacctaaaccgggtaccctaggacggtacgggacttacggggaacgtttacggggacccgtaaaacccccggttaaactaccgttcggggtactaaccgtacccgttaaggttcggtttacccgttaccgtaacccccgttaacgttccccggttaccggggaaacctacggttaaaccctttacccggaactttaccggaaccccgtaacgtaaccccttacccgttacccaaaacgttaaaacccacctaaccgggacccttaacaacggttaggtaacgttagaacggtactcccgtgtaaccagttcacggaccgtaccgacccgggtacctttccgtaaagttccgtacggtacggtacggacggtaacccggtccccgtaaccgggttaacgttccccgggtaagcccggttacccgtaaaccgggtcccgtaaaccggtcccggttacccgttttggtaaacccggtttcccggaccggggg

SEQ ID NO: 207786 - DNA, 1036 bp, Homo sapiens
  misc_feature: GYAE6OF01BHZGL.17.25.C03.1.454.CMB.1.raw
  modified_base (133)..(133): a, c, t, g, unknown or other
  misc_feature (133)..(133): n is a, c, g, or t
tcagcgtagactagcacgaccggtgctcgatttagtagtgtagatttgggtttggggactcaaacaaccacatctgtcctctagaagaaaaccctgtgagcacagctcctcaccatggactggacctggaggntcctcttcttggtggcagcagctacaagtcgcccactcccaggtgcagtcgtggtgcgtaggtcggtgggctggaggtaggaagtaggccggtcggggccctgaggtacgtaacggtcctaccgtggaccgtaggtcctttacggtcggtaactttaccgtaccgtttaccctacttatacgtactacgtacgtgggtcgccgccgacggccgcgtacggacctaacggaccgtggtacgggtaggtacgggtagggggtacgtccggggtaaacccccgtaaaaccccgtaaacggtcggttacgggttccggttaacgaaacccggtttggtttacccgtttacccgtaaccccctaaacccccggttaaccgttacccccggggttaaccccgggtaaccttaaaccgggtaacccttttaacccgtacccggtaacccgtaaacccccgtaaaaccggttaacccccttacccgtaaaacccgttaaaacccttaaaaccccgaaccccgttaaaacccggtaccctttaaaggtaacgggtttaacggggtttaggttaaaacccgggaacgggttcccgtaacccgttaagtaacccgtttaccgttaacgggtaaccgtaaacccgggtaaccccgggttccccgttacccggttttaaaccttttaaccgtttcgggtaccgggtaacggtaaccccgggttaaacccgggttaccccggtaaacccccgtaacggggtttacccccgggtttaaccccgggaacgggtaaacccccggggtttaccccccggtaacccgggggttaaacgttacccccgggggggttttaccctttttaacccggttttacccggggtacccgggtttaccccggggggttaaccccggggggg

SEQ ID NO: 207787 - DNA, 695 bp, Homo sapiens
  misc_feature: GYAE6OF01D7HN5.17.25.C03.1.454.CMB.1.raw
  modified_base (180)..(180): a, c, t, g, unknown or other
  misc_feature (180)..(180): n is a, c, g, or t
  modified_base (372)..(372): a, c, t, g, unknown or other
  misc_feature (372)..(372): n is a, c, g, or t
  modified_base (526)..(526): a, c, t, g, unknown or other
  misc_feature (526)..(526): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagcctacaagtcgccctaaatcccgaggtncgagtcgtcggtgactggtcgtgggctggaggtagaagacgccgtgggcctgagtgagtcctcgtgacgtagcttcgagtacttctaccgtttacctcgttatagtacgtactaacgtgggtcgtacgccgacggccgtcgtacggaacaacggtccgtggaacgtggacgtgggacgtcggacaaccctanacggttgtcgtacgacgtacgtcgttactaccgaaccctaccgttacccggtacccggaacgtaaccgttacccgtaaacgtactacccgggtaaacctaaccggtacccctacccgtaactaaaccgtaaacctacccgtaacacccgttaanaccggttaggacgtttacgggacgtcgacccgaggtaactcgttaacgaccgacctaaccggcccggttctagttactcgaggtccacgtaacgtccaaccggtgtccgtgaccgtcggtccgacggtacctggtaaccccgttggttcctacggttcgggacccgggg

SEQ ID NO: 207788 - DNA, 902 bp, Homo sapiens
  misc_feature: GYAE6OF01BQW2O.17.25.C03.1.454.CMB.1.raw
tcagcgtagactagcacgaccggtgctcgatttagtagtgtagatttgggtttggggactcaacaaccacatctgtcctctagagaaaaccctgtgagcacagcctcctcaccagtggactcggaccgtggaggactccttctttcgttggtggcagcagctacaagtcgcccacctccgaggtgcctagcgtggtgcgtacggtcggttcggggactagggtacggtaaggaaaggaaccgggtcccggtccgggggtaccctacggtaaggtacggtaaccgggttcctacccggtaggaccggtaagggttccgtttacggacggggaccgtccgttaacccgttacgacggtaccgtaacgttaactttaacgtttacgtaacgggtttgggcggtaccggggaccggtcccgtcggtaacgggacgtaccggtttcgttacggaggttcgggtaagggtacggggtaacggtaccggttccgtaacccgttacgttcggttaccaaccgtaaaccccaaacccgtaaaacgtacccgaactaacccggtaaggttaaccgtaccggacggtacgaccgtaaccgtccgaaacccgtaacggacccggaaactaaaccgtaaaacgtaaccgtaacgtaaccgttaagttaacctacggtaacggtacgtactaacggaaccgtaccggtctaccggttactaccgtacggtacggaaccgaccggttacgttaccgtttacccgttacgttaccggtggtaccgacggtaaagttaacgttaacgttaaaccttaaccgtacgtaccgtttacgtttcccttttaaccccgtttacccttaccccgtttacgtttacccgttacccgttcgggtaaccccggttggtaacccccggg

SEQ ID NO: 207789 - DNA, 653 bp, Homo sapiens
  misc_feature: GYAE6OF01BM7UA.17.25.C03.1.454.CMB.1.raw
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
  modified_base (249)..(249): a, c, t, g, unknown or other
  misc_feature (249)..(249): n is a, c, g, or t
  modified_base (260)..(260): a, c, t, g, unknown or other
  misc_feature (260)..(260): n is a, c, g, or t
  modified_base (279)..(279): a, c, t, g, unknown or other
  misc_feature (279)..(279): n is a, c, g, or t
  modified_base (318)..(318): a, c, t, g, unknown or other
  misc_feature (318)..(318): n is a, c, g, or t
  modified_base (396)..(396): a, c, t, g, unknown or other
  misc_feature (396)..(396): n is a, c, g, or t
  modified_base (529)..(529): a, c, t, g, unknown or other
  misc_feature (529)..(529): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctaacaagtaccccactcccaggtgcagcgtggtgcagtcgtgggctggaggtgaagaacgccgtgggcctcgagtgaaggtctcngcagctntggntctacttaccnctaatagtatcagtgggtncgccaggccgctaggacaaccgctggaggtggatgggancgggaccaaaccctaagacgtggtacgcacgtagtcgtactaccacctacgtccgtaccggactaccgtacttaccanacgacctaacgtacctcctaaccaaactaaaccaacctacgaccctaagtagtagggtacgttaggaacgcgtacgtacgactaacgtccgacgaaccgaacggacccggtaccgttacttaacgtttacggngtacggtaccgaacggtaccgttcccgaaaccgttacgggtccgggtacgaccggtacccggtacggaccgaccgggtccggttaccctttcggtaaccgttcgggtcccgggggtaaacccgg

SEQ ID NO: 207790 - DNA, 739 bp, Homo sapiens
  misc_feature: GYAE6OF01BL3VB.17.25.C03.1.454.CMB.1.raw
  modified_base (480)..(480): a, c, t, g, unknown or other
  misc_feature (480)..(480): n is a, c, g, or t
  modified_base (561)..(561): a, c, t, g, unknown or other
  misc_feature (561)..(561): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactccttcttcgttggtggcaggcagctacaagtcgcccactcccaggtgcagctggtgcaggtcgtggggctggaggtagaagacgccggtggggcctcgagtggtaacgtcctccgtgacgacggtcttcgtaggtacttccttaccgtttaccttacctaagttacgtataccgtaacgttgggtcgaccgccggacggtcccgtcggtaacgggaacctaaaccggtccgttggaacggggttcggtaacggttggggaaccggtacgggtaaacccgtaaaccccgtaaacgtcgggttacggtcgtaaccgtacggtagttccgttccttcccgaaccgttccncccgggtaaccgtacgtaccgaaccgtttaccacgttacccgaaacccgtaacctaccttaccctaactaacgtaaaaccncgaaccgtccgtaataggtggtaggttacggacggcgtaccgtacgactccgtacgtacgaaccggaccgcgttaccgttagttacgttagtcgacgtcggaacgtccgtaaccgtcggtagtccggacggtaccgtcgagacgtccggaccgttagttcgtacggttccggacgggg

SEQ ID NO: 207791 - DNA, 727 bp, Homo sapiens
  misc_feature: GYAE6OF01AZEEE.17.25.C03.1.454.CMB.1.raw
  modified_base (197)..(197): a, c, t, g, unknown or other
  misc_feature (197)..(197): n is a, c, g, or t
  modified_base (262)..(262): a, c, t, g, unknown or other
  misc_feature (262)..(262): n is a, c, g, or t
  modified_base (295)..(295): a, c, t, g, unknown or other
  misc_feature (295)..(295): n is a, c, g, or t
  modified_base (300)..(300): a, c, t, g, unknown or other
  misc_feature (300)..(300): n is a, c, g, or t
  modified_base (407)..(407): a, c, t, g, unknown or other
  misc_feature (407)..(407): n is a, c, g, or t
tcagcgtagactagcacgaccggtgctcgatttagtagtgtagatttgggtttggggactcaacaaccacatctgtcctctagaagaaaaaccctgtgagcacagctccctcaccatggactcggaccgtggaggactctcgttcttggtgcagcagactacgaacgtcgcccacctcccgaggtgccagcgtggtncgtagtcggtggggtctaggaggtagaagaaggtccggtcggggctcgtagtggaggtcctccgngacgtaagcttcgtagtcttctaccgtttcccncttanagtactcgtaaggtcggtagccgtccgcggccctggtacgtaaaccgaccgacgtggacggtggagtcggtagcgggaacctaacctgtagtcgcgtacacgtcgtnttaccgcctacccgtagtcccggaccgtaacgactaactcgtacgtaactaacccgacctaccttacccgtaacgtaaccttaaacaaccgtaccgtaacccgtaacgttagggtaaccgttacggttaacgggaacgtaccgtaaccggtctaaacgttcgttaacggaccggaaaccgtacccgggtacccgttaccttaacgttaaccgtttcgtaagtccggaacgttaccggaacccgttcgtaccggtaccggtcaaaccgggtcccgacccgtcgacggtaccgtagttcccgaggttccgtcgggtcccggg

SEQ ID NO: 207792 - DNA, 799 bp, Homo sapiens
  misc_feature: GYAE6OF01BF4N0.17.25.C03.1.454.CMB.1.raw
  modified_base (175)..(175): a, c, t, g, unknown or other
  misc_feature (175)..(175): n is a, c, g, or t
tcagcgtagactagcacgaccggtgctcgatttagtagtgtagatttgggtttggggactcaacaaccacatctgtcctctagagaaaacccctgtgagcacagctcctcaccatggactggacctggaggactcctcttcttggtgcagcagctacagtgcccactcccaggtncgagctggtgcagtcgtgggctggaggtgaagagccgtgggcctcagtggagtctccgtgacgaggtcttacgtaggtacttccgttaccgtttaccctacgttagtaacgttacgtaccgtacggttgggtccgaccggacccggacggtccgtaccggtacggaacccgtaacggtaccggtaggtaggtacggtaggtacgggtacggtaccgggtaacccgttaaaccgtaacggtacggttcggtacgtaaccgtacggttacgtttccgtaccgttacccgaccccgttaccgtacccggtaccgggtaacctacgtaaccgttaaccgacgtacccgacccgttaccgtaacccgttacctaacctaaacgtaactacccgtaccgtaccgttaagacggttacggttacggttaacggacggtacgtaccgttcgtaaccgttacggttcgaaccgtacggtacccggtaccggttaccttattaccgtaggtaccggtaggtaccgtaccggttaccgtacccgtacggtaccgggttaccgtaccggaccggttacccgacggtaccggtaccggttcccgtttaccgttccggtccggttcggggtaaccggg

SEQ ID NO: 207793 - DNA, 880 bp, Homo sapiens
  misc_feature: GYAE6OF01CT0SY.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatgactggacctggaggatcctcttcgttggtgcagcagcctacaagtcgacccacctcccgaggtgacacggtcgtggtacgcgtaggttcggtcggggtcgtaggtagggtaacggaaaggtaaccggtcccgggtcgggggtcccttacggtaaggttacgggtaacggttccccgttaccgtaggaaccgttaacgggttccgtttacggttacggtaacttttacccggttaacccgttttacccgttaaccgttaaagttaacgttaaccgttaccggtaaccggggttcgggtaccgacccggtaccccggccgggtaccccggtaccgggttaaccggtaaccgtaaccggttaccgtagggtagggtacgggtacgggtacgggtaaccggtaccgggtaaaaccccgtaaccgttaaccggtcggttacggtaccgtacgtaacgttcgttaccgtcccttaacccgtaccgtaccgtaccggtaccggtactaaccgtactaccgacgtacccaaccgtacccgtacctaccaacctaactaaccgacctactaccgtagtaggtacggtacgtacgacgtacgtacacgtactcgtacgaccgtaccgaccggtaccgttccgttacgttaccgttacggtacgtacggtaccgtaccggtacccgtacgtaccggtaccggtaccggtaccggtacccgtaccggtacgtccggtaccgttccgttacggtacccggttcggtccgggtaccggg

SEQ ID NO: 207794 - DNA, 696 bp, Homo sapiens
  misc_feature: GYAE6OF01C3DZL.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttgggtggcagcagctacaagtcgcccactcccaggtgcagctggtgcagtcgtggggctggaggtgaagagccgtggggcctcgagtagaacggtctaccgtgacgaaggtcttcgtggattccgtaccgtttacctcctattagtactacgaacgtgggtcgccgccgaggccgcgtacggaacaccgtacgtggagtcggagtgggagtacgggacctaaccctaacgtacgtggtcgtcaacgtagttcgttccttaccaccctacgtacccggtaccgggactaacgtacccttacaagtacgacccaacgtaccctccctacaaacaaccgacacgtacctagagtagggtagtaggaagcgtaccgtgtacagttccgagacccgaacggtccgtacgttactacgttaacggtcgtacggtacgtaacgacccgttacccgaacggttaccgttaccgggacggtacccggaccccgggttaacggtcccggtaccggggtaccccggtttaccgtttaccgggtcccggtttcccggggacccggggg

SEQ ID NO: 207795 - DNA, 778 bp, Homo sapiens
  misc_feature: GYAE6OF01EC7KG.17.25.C03.1.454.CMB.1.raw
  modified_base (305)..(305): a, c, t, g, unknown or other
  misc_feature (305)..(305): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacagtgcccactcccaggtgcagctggtgcagtcgtggggctgaggtgaagaagcctggggcctcagtgaagtctcctgcaaggcttcgtggattactacgtttacctccttatagtacttcaacgtggggtcgtccgaccgaggccccgngtacgggacctaaccggtacccgttaggacggtgggaagtcggggagtacggggacccgaaaccccgtaacgacgtgggtacggtccaacgtaggttcgttacccttacaaccccgtcgttcccgtacccggggactaacgtaccctttaaccgagtaccgaacccttaacccgaactttcccccgtaacctaaaacttaaaacccgaccgtaaccgtacccttaaacgtaggtacggttaagggttcggaaaccggtacgtcccgtagaacctagtaccgtagaacccgtaccgacccggggttaccctttacgttaaaccgtttcgttcggacggtaacgtacggtaacccggtcccccgtaaaggtacccggtttccggggttaacgcccgggttaccccgtaacccgggaccgtagggtccccgggttaccccgtttttacgacccgttttcccgggggaaccgggggg

SEQ ID NO: 207796 - DNA, 744 bp, Homo sapiens
  misc_feature: GYAE6OF01BZ5BY.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtagaagaacgccgtaggggcctcgaggtgaacggtcctccgtgacaaggtcttcgtaggtacttcctaaccgttttacccttaccgtaatagtaactctaacgtgggtcgcgccgacggtccgcgtacggaacgaaccgtaccgtacggaggtcggaggtagggagtacgggaccgtaaacccgtaacgtacgtggtcgtacacgtacgttcgttcctaccgaaccctacgttcccggtaccggtaaccgtaacgtaaccttaacccgacgttaacccgaacccgtacgtaaaccccctacctaacccgtaaataaacccacgtaaccgacccctaacgttaaagtgggtaacggttcggaacggtactacccgagtaactaacgtcgtacgaaccgccggtaaccgtcccgtatttaacgttcgtaggtcgacggtacgtaccgtacccgtacggccggttaccggtacggacccggtaccggttacggacgtaccgggtacccggtttcccgttaggtaccccgttgggaccccggggg

SEQ ID NO: 207797 - DNA, 840 bp, Homo sapiens
  misc_feature: GYAE6OF01AT35C.17.25.C03.1.454.CMB.1.raw
tcagcgtagactagcacgaccggtgctcgatttagtagtgtagatttgggtttggggactcaacaaccacatctgtcctctagagaaaaccctgtgagcacagctccgtcaccagtggactggacctggaggatcctcttcgttggtggcagcagctacaagtcgcccactcccgaggtgcagcgtggtgcagtcgtggggctggaggtagaagagtccgcggggtcctgtagtacggtacgtccgtccgtgaccgtaaggtccttcgtagggtaccttaccgttaaccgttttaccctccgttaagtaacgttactaccgtaacggttgggtccgacccgaccggaccggccggtacgttaccggaacctaaccggtaccgtaggtaacggtgggtaacggtgggtaacgtaccgggaaccctaaacccgtaaccgtaccggtggtcgtaacaccgtaggtccttaccgttacccgaaccccgtaccggtacccgtacccgggtaacgaacgttaacccgttaccgaacgtacctaacccgaacccgtaaccctccctaaacccgtaacgtaaacccacgttaacccgtaccctaacgggtcgttaacgggtacgtaacgggacgtacccggtccgtaaccgtacgttaaccgtcgtaaccggaacccgcccggttaccggtcccgtttaaacgttcgttacggtacgtccggaacggtaccggtaccccgtaccggtaaccggtcggttacccggtaaccggggtaccgacccggtaccggtcgacccgggttccccggttaggttttccgtaaccgggttccgggggtaacccgggg

SEQ ID NO: 207798 - DNA, 659 bp, Homo sapiens
  misc_feature: GYAE6OF01A0GUS.17.25.C03.1.454.CMB.1.raw
  modified_base (186)..(186): a, c, t, g, unknown or other
  misc_feature (186)..(186): n is a, c, g, or t
  modified_base (567)..(567): a, c, t, g, unknown or other
  misc_feature (567)..(567): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggactcctcttcttggtgcagcagctacaagtcgcccactcccaggtgcagctggtncagtcgtgggctggaggtagaagagccgtggggcctcgagtgaacgtcctcgtgacgaggtcttgtagtacttcttacgttacctctatgtactcgtaacgtggtcaccgtccgacggccgtcgtacggaaccacgtaccgtggacggtggaggtggacgtcggaccaacccgtacgcggtgtcgtactaacgtgttccgttcctaccaacccgtctcccggtaaccggacgtaaccgttacctaccgacgttaccgaaccctaacgtcccgttacccaactaacgtaaccaccgtactaccgtaacgtcgtaggtgttaacgaccgtacgcgttacgactacgtacgtacgaccgtaccgcgttaccgtattactcggtnacggacgtacgtaccgacccgtacgtccggttcggacgtcggtaccgtcggaccgtacggtcccgttactttaccgcggttcccgggacggg

SEQ ID NO: 207799 - DNA, 710 bp, Homo sapiens
  misc_feature: GYAE6OF01APFWN.17.25.C03.1.454.CMB.1.raw
  modified_base (255)..(255): a, c, t, g, unknown or other
  misc_feature (255)..(255): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccacctcccaggtcgcagctgggtgcagtcgtggggctggaggtagaagaacgccgtggggcctcgagtagaacggtctcctgacaggtcttntggtattctaaccgtttcctcgttatagtatacaacgttggtgccgccgacggccgcgtaggaccgacgaccgtgaggtggagtgggacggtcgggaccgtaacccgtaacgcgtagggtacgtacgacgtagtcgttccgttaccgaccctcgttacccgcccggggtaactaccggtaaccttaacccgacgttaaccgaacccgtaacccgtaaccgttacccctaaccctaaactaaaccaaccgaccgtaaccctacgtaacgtgggttaacgtacgggacggtacgaccgtacgtacctacttacgaacggtaccgaccggacccggttacccgttacgttaagtttaccgtggtacgacggtcgaccgttacccgacggtaccgtcgggttaacgcggtacccggtacgacgtaccggcggttcgtttacgtcggttcgggtaccggg

SEQ ID NO: 207800 - DNA, 737 bp, Homo sapiens
  misc_feature: GYAE6OF01DH2O5.17.25.C03.1.454.CMB.1.raw
  modified_base (103)..(103): a, c, t, g, unknown or other
  misc_feature (103)..(103): n is a, c, g, or t
  modified_base (371)..(371): a, c, t, g, unknown or other
  misc_feature (371)..(371): n is a, c, g, or t
  modified_base (585)..(585): a, c, t, g, unknown or other
  misc_feature (585)..(585): n is a, c, g, or t
tcagcgtagactagcacgaccggtgctcgatttagtagtgtagatttgggtttgggggagtcagtctcagtcaggacacagcatggacatgacgggtccccgntcagctccgtggggctcctgctactctggctccgagctgccagatgtagacatccaagtatcgaccagtcctaccacttccctccctgtccgtcgtccgtcgtgggtcggggtacagcgtaccactactcgtacgttcggaccgtaacgtaacgtaccgaacggttaaaccgtttaaaaccttagttttaaacgttgtactcaacgaacaacgtaaaaccgtacggaaaccgcccacgtacccttcgtgtacgttcgtcggtcggtcnctaccgtccctacgtacgtcgtacggtacgtcggtcccgtaacctaggtcgggttacgtcggtagtacgggagtaggtcgtacgttcgggaacgtagtaacgtttataacgacttacccgtaacacctacgttaccctaccttacgtaccgtaccgtaaccgtacgttaggtagtaccgttggtaacctacgttaactacccgttaccgttaanaccgttacgtaacgtacggttactacccggtaacccgttccttacgttaccgttcggtacggacccggtaacggtaacgttaggtacgactaccggttaaacaacggttcgaggtactcgggtactaactacctttcgtccgtttacgtccg

SEQ ID NO: 207801 - DNA, 737 bp, Homo sapiens
  misc_feature: GYAE6OF01AQYMW.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgccccactcccaggtgcagctggtgcagtcgtggggctggaggtgaagacggccgtgggcctcgaggtagaggtcctccgtgacgaaggtcttcgtggtcttacctaccgtttaccttcctaatagtactacacgtgggtcgccgccgaggcccgcgtacggaaccaaccgacgtggagtggagtagggcgtcgggacccaaaccgtacgtacgtcggtacgcacgtagtcgttccttaccaccctacgtccgtaccggggacacgtaaccttacctacgtacgaaccgtaaccgtaacctaccctaccaactaaccactaacgacctacgacgttaggtaggtacggagacggtcctacgacgtacgtacgtacggaacccggacgtcccgggttacccttacgttacgtttacggtcggtacggtacccggacggttacccgtaccccggtaacggttacccggttacccggggtaccggtacccggttaccccggggttaaccggaccggtacccgggttacccgggttacccggttttaccggttcccggtttccgggggtaaccccgggggg

SEQ ID NO: 207802 - DNA, 709 bp, Homo sapiens
  misc_feature: GYAE6OF01CWJQQ.17.25.C03.1.454.CMB.1.raw
  modified_base (175)..(175): a, c, t, g, unknown or other
  misc_feature (175)..(175): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtncagctggtgcagtcgtggggctggaggtgaagaagccgtggggcctcagtgaaggtctcctgcaaggcttctggattctacgtttacctcctatagtatcaacgtgggtgcgccgaggcccgcgtggaacaacgacctgaggtgggaagttggggatcggggaacccaaaccctaacgaccgttggtacgtacacgtaggttcgtcctttacccaccttacgtcccgttacccgggggactacggtaaccctttaccgagttaccgaacccgaaccgtaaccctcccttaacccgaaacttaaaaacccgacctaacggtacccctaaacgtacggttaacgggtacgtttaacgggaaggtacgacccgttacggacctaagtcgtacggaacgaccgacgggtccgttacttattacgtgttcggacgtagtaccggtcccgtacggtacgtccgggtacgaccggtacccgttaacgggccctaacgggtcccggttaccgtttcgtaccggtttcgggtaacccgggggg

SEQ ID NO: 207803 - DNA, 728 bp, Homo sapiens
  misc_feature: GYAE6OF01ASGTY.17.25.C03.1.454.CMB.1.raw
  modified_base (180)..(180): a, c, t, g, unknown or other
  misc_feature (180)..(180): n is a, c, g, or t
  modified_base (189)..(189): a, c, t, g, unknown or other
  misc_feature (189)..(189): n is a, c, g, or t
  modified_base (309)..(309): a, c, t, g, unknown or other
  misc_feature (309)..(309): n is a, c, g, or t
  modified_base (655)..(655): a, c, t, g, unknown or other
  misc_feature (655)..(655): n is a, c, g, or t
tcagcgtagactagcacgaccggtgctcgatttagtagtgtagatttgggtttggggactcaacaaccacatctgtcctctagagaaaaccctgtgagcacagctcctcaccatggctggacctggaggatccttctttcgttggtggcagcagctacaagtcgcccactcccaggtgcngctggtgcngtcggtgggctgaggtaggaagacgccgtgggcctgagtgacgtctcctgcaggtcttcgtagtagttctacgttacctctactagttacacgtacgtgggtcgccgccgaggttcccgngtacggacaaccggacgtggaaggtggtagcggggtagtcgggaacccaacggttaccaggtacggttgacaacgttacggttacgtccttacccacccctagttcccggaacccggggacaaccctttaaggtaaccctaccgggttaacgaaccccgaacggtaaccccttaccctaacctaacccttaaacgtaacctaccgtaacccgttaacaccggttagggtacgttcggaaacggtcggaccgttagaacgtacgttacgacggacccggttaacgacccggttaccggttacctttaacgtccgtacgtcggttaaccgacgggtaccctacccggnggtaacccggtggcggtaccgcccggtaacgcggtaccggtccggtccgttaacgtcggtccggtacccgggg

SEQ ID NO: 207804 - DNA, 810 bp, Homo sapiens
  misc_feature: GYAE6OF01C2DCQ.17.25.C03.1.454.CMB.1.raw
  modified_base (180)..(180): a, c, t, g, unknown or other
  misc_feature (180)..(180): n is a, c, g, or t
  modified_base (339)..(339): a, c, t, g, unknown or other
  misc_feature (339)..(339): n is a, c, g, or t
tcagcgtagactagcacgaccggtgctcgatttagtagtgtagatttgggtttgggactcaacaaccacatctgtcctctagaagaaaaccctgtgagcacagctcctcaccatggactggacctggaggactcctcttcgttggtggcagcagctacaagtcgcccactcccgaggtcnccgagtcgtggtcgccagtccgtggggcttggagggtagaaacggaacgccggtggggcctcgtaaggtgaacggttcctccgtgacgtaacgggtcttcgtaggtacttacgtaaccgttttacctactaagtaacgtactaccgtaacgttgggtcnccgacgacgggcccgtacgacggaaccgaaaccgcctaggaggtaggaaggtgggagtaccgggtaaccgaaaccccgtaagtcggttggtaccgtcgaacgtaggttccgttaccttacccgaacctacgttcccggtacccgggaacaacggttaaccctaaccgtactaccggaacctaacgtaacccctacctaaccaaaactaaaccctacggacctacgtaaacgtaggttaccgggtagttaaccgagggtaccctaaccgttaacgacgttaacctacggtaaccggaaaccgtacccggaccgggttccctaaacgtttacgttaccgagggtacaaccgggtacgacccccgtaaccgaacggtccggttccgggtaacaacccgggtcccgttacgggaacccttcccggggtacgtttaccccgtttagggttaacccggttcccggggaaaccggggg

SEQ ID NO: 207805 - DNA, 810 bp, Homo sapiens
  misc_feature: GYAE6OF01BSEQN.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatcggactggacctggagacttcctcttcgttggtggcagcagactacgaagtcgcccacctcccgaggtgcagtcgtggtgcgacgttcggtggggcctggagggtagaaacgaacggccgtcggggcctacggtaggtcgaacggttcctaccgtacgacgtaacggtcgtttaccggtaggttaacttccgttaaccggttacccttacgttaacgtaaacgtttacgtaccgtaacggtttcgggaccggaccgacccggaaccggtcccggtacgttaccgggaaaccccgtaaccggtaacccgtggggtaaccgggtgggtacgggtacggggtaaacgggtccgggtaacccgttaaaaccccgttacgtacgggttaacggtcgtaccgaacgttacggttctaccgttaccaccgtacgttccggacgtacgacgttacctacacgtacgtaccgaacccgtacttacccgaacaacgtaaacacccgtaacggcctaaacggtacggtaggttacggtacggaaacggcgtaccaacgtacgtactcggtacgaaccgtccgaccggttcttaacgttacgttagtccggtagacccgtaggacccttcccggaggttacccgagggtcccgaacggcccacggacgtccgtacgttccctaggttccccgggtcgtaacccggggg

SEQ ID NO: 207806 - DNA, 781 bp, Homo sapiens
  misc_feature: GYAE6OF01BW6N3.17.25.C03.1.454.CMB.1.raw
  modified_base (101)..(101): a, c, t, g, unknown or other
  misc_feature (101)..(101): n is a, c, g, or t
  modified_base (136)..(136): a, c, t, g, unknown or other
  misc_feature (136)..(136): n is a, c, g, or t
  modified_base (476)..(476): a, c, t, g, unknown or other
  misc_feature (476)..(476): n is a, c, g, or t
tcagcgtagactagcacgaccggtgctcgatttagtagtgtagatttgggtttgggggagtcagtctcagtcaggacacagcatggacatgagggtccccntcagctcctggggctcctgctactctggctccganctgccagtatggtcactaatccgaagatcgacccagtcctccacttccctccgtagtctggtcctgtgggtcgggggtacaggtacgtacacctattctacgttcggaccggaacgtaacgtccgaacgggttaaaccttttaaaaactttagttttaaagttggtaactacgaacggtacctaaaacggtaaaaccgttacgggaaaacccgtccccgaacgtaacccttcgtacgaccttcgtacggtggtacacctacgtaccctaccttgtacggaacggtaggtcccggtccgtaacctagtaccgggtagttccagggtacggtaccttagggngttacgtacggtaacggaacttagtttaacgtttaccaaacgttccccgttaacaaaccgtccgttaacccaaccccgtttaacgttacccgtaacggtaacccttaaccggtagggtaaacgtttaacgttacgggttaaccttaaacgttacccttacggttaactacggtttacaacctaacggttacgtacgttaaccgtccccgttactccgttaacggttcctaacgggaccgtaacggtaactacggttagactacgaacgttacgcggttagcgtactcctacgacttcgcttcgta

SEQ ID NO: 207807 - DNA, 849 bp, Homo sapiens
  misc_feature: GYAE6OF01ETY8M.17.25.C03.1.454.CMB.1.raw
tcagcgtagactagcacgaccggtgctcgattttagtagtgtagatttgggtttggggactcaacaaccacatctgtcctctagagaaaaccctgtgagcacagctcctcaccatggactggacctggaggatccttctttcttgggtggcagcagctaacaagtcgcccacctcccaggtgcagctggtgcagtcgtggggctggaggtggaagaacggccgtcggggcctcgaggtgacggttctccgtcgacgaaggtctttcgtggtactttcgtaccgttttacctaccttaagtacgttactacctaacggttgggtacgccggccgacggggcccgcgtacgggaaccgaaccgggtcccgtagggaacggtggaggtggggacgtcgggggaacccaaacccgtaacgacgttcgggtcgtacgaaccgtggttcgttcccttacccgacccctacgtacccggtaccgggacctaacggtaccgtttaaccagtacgtaccccgtaaaccgtacccctccccggtaaccaaacgttaaacccacccgtaacgtacccttaaccagttacggggtagtacgggaaacttccggcccgtaggaccctaaggttccgtacggaacccgtacccggtccggggttaccgtttacccttaaacgttttccgaaggttccgggaacgtaacccgggttacccgaaccccgggtacccgggttaaccgttaccccgggggtagtaaccccggaaccccggggtttacccggacccgggttacccggggtaccgggtttacccggtttttacccgggttacccgttacccggggggtacccggggggg

SEQ ID NO: 207808 - DNA, 813 bp, Homo sapiens
  misc_feature: GYAE6OF01BCSC1.17.25.C03.1.454.CMB.1.raw
  modified_base (249)..(249): a, c, t, g, unknown or other
  misc_feature (249)..(249): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactccaggtgcagctggtgcagtcgtggggctggaggtgaagagccgtggggcctcgagtgaaggtctccgtgctaggtcttgnggtattcgtaccgtttacctctaagtacgttactacgtaacgtggggtcgccggccgacgggccgacgttacggaaccgaacggaccgttaggacggtggtagtggggaggtacggggaccgtaaaccctaacgtacgttacggtacgtacgtaacgtaggttccgttaccttacccgacccgtacgttcccggtaccggggtaaccaaacggtaccttaaccgaacgttaccgaacccgtaacgtaaccccttccctaaccgtaactaaaaccgacctaacgccctaacgtacggttacgggtaagggttacgaacgggtacgacccgttacgaacctacgtacgtaaccggaaccggtacccggaaccccggttacccggtttaaccgttttaacgttaccgttacggttacggacccggtaacggtaacccgttacccccggtaacggttacccggttcccgggtaacggttacccgggaacccggtaccgggaccggttaccgggttacccggtttacccgttttaccggttaaccggtttcccggggtaacccgggggg

SEQ ID NO: 207809 - DNA, 734 bp, Homo sapiens
  misc_feature: GYAE6OF01BSXJP.17.25.C03.1.454.CMB.1.raw
  modified_base (238)..(238): a, c, t, g, unknown or other
  misc_feature (238)..(238): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagcctggtgcagtcgtgggctggaggtgaagaagcgtggggcctcgagtgaaggtctccgngcgaaggtcttcgtggtacttcaccgttttacctcctatacggtattccgaaacgtcgggtcgccgaccgacgggccgtcgtacggaacccgtaacgtaccgtaggtaggttacggaaggttggggacgtacggggacccgtaaacccgttaacgtaccggttgggtacgtcctaacgtacggtcgtttacctaccgaccccgttactcccgggtaccggacgtacgtaccgttacccattaccgaaccctaccgtaaccttcccgtaacctaactaaaccacgaaccgtacctacgtacgtagggtaacgtttacggaagggtaccgtaccgtagaaccgtactacgtcgaaaccggccgtaaccggtccgttacgttacttacgtacgtacgacggtaacgtaccgtacccgtaaggtcccgttcgggtacgtaccgtcggtaacccggacgtacggtaccgtccgtttaccgacggtttccggtacccggggg

SEQ ID NO: 207810 - DNA, 662 bp, Homo sapiens
  misc_feature: GYAE6OF01CXB7U.17.25.C03.1.454.CMB.1.raw
  modified_base (519)..(519): a, c, t, g, unknown or other
  misc_feature (519)..(519): n is a, c, g, or t
  modified_base (544)..(544): a, c, t, g, unknown or other
  misc_feature (544)..(544): n is a, c, g, or t
tcagcgtagactagcacgaccggtgctcgatttagtagtgtagatttgggtttggggactcaacaaccgacatctgtcctctagagaaaaccctgtgagcaacagctcctcaccatggactcggacctggagatcctcttctgggtgcagcagctaacagtcgcccactcccgaggtcgactgcgtggtcgctacgtcgtggggactaggaggaagaaaggtaacgcgttacggggcctcgaaggttacgtaaggtctccgtaggaccgtaaggtccttacgtggttaacttaccgtacctttaactctaagtatataccgaacggttggggtacacgtaccgacggcccgtagtaccggaactaaccgtaaccgtggaagtaggacggtggtaacgttacggggaaccctaaacccctagaacggtgggaacttacgacgttaggtcttaacctaccaacacgttccgtacggggactagtacctagattacgacctaacgaactccacaactaaacncacgtaacacgatcgagtcgagacncgtacgatcgtatacgacgacggacgtactactacgtactagtcgacgacgtccgccgaagtcgacgtaggcccgaacgtccggacgacggttacgtacttacgcggtccgtacgggg

SEQ ID NO: 207811 - DNA, 811 bp, Homo sapiens
  misc_feature: GYAE6OF01AB6EJ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagaacgccgtggggcctcgagtgaaggtctccgtgcgaaggtcttcgtggtactttctaccgttttacctcctaatagtactacgaacgttggggtcgccgtccgacgggcccgcgtacggaaccaaccggacctaggaggtacggagtggggacgtcggggacctaaacccgtacgacgtgggtcgtaccgacgtaggttcgtccttaccgaaccctcgtcccgtaccggggactacggtaacccttaccgacgttacgaaccctacgtaaccctccctaacctaaagtaaacccaaccgtaccgtacccttaacgtacggttagggtaacggtttacgggaacgggtaccgtcccgttaacggtaacctacgttacccgtaacggaacccgtaaccgggtaccccgggtaccggtttaccttaaacgtttaccgttcgggtaaccgaacccgggtaacggttaacccccggtaccccgtaacgggttacccggttaccccgggggttacggtacccggtaccccggtaaaccggggcccgtaccggggttccccggtttacccgtttacccggttaccgggtttcccggggtaacccgggggg

SEQ ID NO: 207812 - DNA, 705 bp, Homo sapiens
  misc_feature: GYAE6OF01CHCHD.17.25.C03.1.454.CMB.1.raw
tcagcgtagactagcacgaccggtgctcgatttagtagtgtagatttgggtttggggactcaaacaaccacatctgtcctctagagaaaaaccctgtgagcacagctcctcaccatggactggacctggaggatcctcttcttggtggcagcagctacaagtgcccactcccaggtgcagctggtgcagtcgtggggctgaggtagaagaagccgtggggcctcgagtgaaggtctcctgacaaggcttgtggattctacgtttacctcctatagtatacgacgtgggtcgcgccgacggccgcgtaggaccaacgaccgtgaggtggagtgggagtcgggaccgaacctaacgcgtggtcgtacacgagttcgtcttacacccgtactcccgtaccggacacgtacctaccagtacgacctaaccgtaacctcccgaaccaaactaaaccacctacgtaaccctaacgaggttacgggtaggttacggacggtaacgtcccgttaagaaccttaagtcgtaaccgggtaacccggtaccggaacccggggttcccctttaactttaaacgtttaccggttggtacccgggtaacggaacggtacccgtacccgtaacggtcggtttcccgggaacggccgggtacccgtaacgggacggtaccgtccccgggttacttttcgggtccgttcggggtcccggggg

SEQ ID NO: 207813 - DNA, 778 bp, Homo sapiens
  misc_feature: GYAE6OF01CEL5A.17.25.C03.1.454.CMB.1.raw
tcagcgtagactagcacgaccggtgctcgatttagtagtgtagatttgggtttggggactcaaacaaccacatctgtcctctagaagaaaaccctgtgagcacagctcctcaccatggactggacctggaggactcctcttcttgggtgcagcagactaacgaagtcgcccacctcccgaggtcgcagtcgtggtgcgtaggtcgtgggctggaggtagaagacgccggtcggggcctcgagtgaaggtcctcgtagacgacggtacttgtggtacttaccgttaccgtttacctacttagtagtactacgtaacggtgggtcgaccggaccggacggcccgtcggtaacggaaccaaccggtaccgtggaacggtggtaaggtcggggaggttaccgggaaccctaaaacccgtaacgtacggttacggtactaacgtacgtagttacttccttacccaccccgtaacgttcccggtacgggactaaccgtaccttaccgaacgtaccgaacccgtaacctaaccgtaccctaaccgtaaactaaaaccacgacgtaccctaagtaaggtcgggtaaagtcggaaggtccgtactcgtaacgccttacggaacggtacccgtaccggtaacccggttaccttaacgtttaacgtaccgtaggtcggaacgtaacggtacccgtaccgaacggtccggtcccggtaggtaccccggtacgtacgggacgtaaccgggtccgtttccggttacggtaaccccggttgggtaacccgggg

SEQ ID NO: 207814 - DNA, 979 bp, Homo sapiens
  misc_feature: GYAE6OF01CW6WT.17.25.C03.1.454.CMB.1.raw
tcagcgtagactagcacgaccggtgctcgatttagtagtgtagatttgggtttggggactcaacaaccacatctgtcctctagagaaaaccctgtgagcacagctccctcaccatggactggaccgtggaggactccttccttcgttgggtgcgagcagctacgaagtcgacccacctcccgaggtgacgagcgtggtgcgtaggtcgtggggtctaggaggtaggaaacgaacggcccggttcggggtccctagtaacggttacgggtaacggttccgtcccgtggaccgtaacggttccgtttacgtcggttactttaccgttaacccgttttacccttacgtaacgttaagttacgttaacgtacggttcggggtaccgaccggtcccgacgggtccccggtcggtacggaaaccggaaccgtacccggttaggagggttacgggttaacgggtacgggtaacgggttaccggggaaccccggtaaaaaccccgtaacgggtaaccggtttcgggtaacgtaaccgtaacggttaaccggtttccggttacccgttaacccgtacccccggtaccgttacccgggttaaccccggggtaacaaacccggtttaaacccttaaccgtaacccgttaaccggaaaccccgtaaccggttaacccccgttaaccctaaaccccgttaaaccttaaaaccccgaaccgttaacccggtaaccctttacgggttaaaccgtacggggttaacggttaacggaaccgggttacccgtacgttaacgtaacccggtacgtttaaccggacgtaacccggtacccggaccgttaacccgttacgtttacgttacggtacggttaccgacggttacccgtaccggcccttaacgggcccggttacggaccggtaccggacccggtcggtaaacccggtgggttacccctttacgggttaccgttaccgggttcggtaccccgggg

SEQ ID NO: 207815 - DNA, 780 bp, Homo sapiens
  misc_feature: GYAE6OF01BDY33.17.25.C03.1.454.CMB.1.raw
  modified_base (102)..(102): a, c, t, g, unknown or other
  misc_feature (102)..(102): n is a, c, g, or t
  modified_base (276)..(276): a, c, t, g, unknown or other
  misc_feature (276)..(276): n is a, c, g, or t
tcagcgtagactagcacgaccggtgctcgatttagtagtgtagatttgggtttggggactcaacaaccacatctgtcctctagagaaaaccctgtgagcacngctcctcaccatggactggacctggagactcctcgttcttggtggcagcagctacaagtcgcccactcccgagtcgcagctggtgctagtccgtgggctggaggtaggaagacgccgtagggctcgagtgacggtctccgtgacaggtcttcgaggtacttcctacgtttaccncttagtagtctacgaacgtggtcgccgcgtacggcctacgtcggaaaccgtaaccggtcccgtagggtaggttacggggaacgttacggggtaacggtacgggggtaacccctaaaacccgtaacgtaaccggtttcgggttaccgtacgtaaccggtaacgtttcggtaccctttaccgaccccgtaacgttccccgtaccgggaacgtacgtaacccgttaaccgtactaccggtaacccgaaccttaacccttccaacctaaacgtaaaccgaccctaccgaccttaaacgtcgtaagggtacggtaaacggtgtaaacccggtcaaccgtacgaacgttccgtaaacggacccgttaaccgaacccggttaccggttaccttaacgttacgtacggacggtaccgaacgtacccgtacggacgttacgggtaccggtacaccccggttacggaaccggccgtacggtaccggttcgttccgtaccggtttgggacccggg

SEQ ID NO: 207816 - DNA, 763 bp, Homo sapiens
  misc_feature: GYAE6OF01BCU4W.17.25.C03.1.454.CMB.1.raw
  modified_base (147)..(147): a, c, t, g, unknown or other
  misc_feature (147)..(147): n is a, c, g, or t
  modified_base (181)..(181): a, c, t, g, unknown or other
  misc_feature (181)..(181): n is a, c, g, or t
  modified_base (202)..(202): a, c, t, g, unknown or other
  misc_feature (202)..(202): n is a, c, g, or t
  modified_base (427)..(427): a, c, t, g, unknown or other
  misc_feature (427)..(427): n is a, c, g, or t
  modified_base (626)..(626): a, c, t, g, unknown or other
  misc_feature (626)..(626): n is a, c, g, or t
tcagcgtagactagcacgaccggtgctcgatttagtagtgtagatttgggtttgggactcaacaaccacatctgtcctcgtagaagaaaaccctgtgagcacagctcctcaccatggactggacctggaggactcctcgttcttggnggcagcagctacaagtgcccacgtcccgaggtcncgagcgtggtgacagttcggngggccttaggaggtgaaacgtacggtccggtggggtccctagaggttcggaacggtcctccgtagacgtaggtcttcgtagtacttacgttaccgtttacctctagttagtactactacggtcgtacgccgaccgtacggccgtacgtacggacccaacgaccgttaggacgggtaggtacggtgggtaacgtaccgggaacctaaaccctaagcggttggtacncgtattacgttcgtacctaccgacctccgtaccgtaccggacgtaactacctaccgtagacccgactacgtacccttccaacctaacaaccgcgtaaccgtactaagtagttcgggaattcgggaacgtacctccgtagtaactacggtctaacggaacctcccggtacggtttccgtaacttaagggttccgtacggngaccggttaccgtaccgcccggtaaccggttcgggttaacccggccggttacgggtaaccccgggtagtaccccggggtcggttaacccccggttttggtttaaaccccgtccgggtttacgggggtaaccccgggg

SEQ ID NO: 207817 - DNA, 820 bp, Homo sapiens
  misc_feature: GYAE6OF01ALP1G.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatcggactggacctggagtatcctcttcttggtcggcagcagactacaagtcgcccctactacccgaggtcgacagcgtggtgctacgtcggtgggtctggaggtacgaagacgccgtgggcctacgtaggtagtaacggtctccgtggaccgtaaggttcttacgagggttaactttccgttaaccgttttacccgttacttaacgttaacgttacgttaccgtaacgggttcgggttccggaccggtaccccgaacgggtcccgtaccggttacggaaacccggtaaccgtacccggtagggtacggtttacgggggtaacggtacgggtacgggtaaccggaccccggtaaaaccgttaccgtacgggttcggtagtaccgttaacggacttcgttaccctaccgtaccctacgtacccggtacggaccgacgtaacctaccgatacccggactaccgtacctccgtaacctaaactacgacccgacgtacctaaggtacggtagtacgggtaggtacgaccgtacgtacgtactaacgtcggtaactaccgggtaaccgtcggttacccgagtttacgttaaccgcgttaacgacgtaccgttaacccggaccggtacccgtacgggtccgtaacggtacccggtaccggtaccgacggtacccgtacgggttccttaccgggttcggtaccggtacccggggg

SEQ ID NO: 207818 - DNA, 751 bp, Homo sapiens
  misc_feature: GYAE6OF01BOTSI.17.25.C03.1.454.CMB.1.raw
  modified_base (730)..(730): a, c, t, g, unknown or other
  misc_feature (730)..(730): n is a, c, g, or t
tcagcgtagactagcacgaccggtgctcgatttagtagtgtagatttgggtttggggactcaacaaccacatctgtcctctagacgaaaaccctgtgagcacagctcctcaccatggactggacctggtaggatcctcctttcttggtggcagcacgctacaagtcgcccacctcccgaggtgacagctggtgcgagtccgtgggctggaggtgaagacgccgtggggcctcgaggtcgaacggtctccgtgacgaggtcttaccgtggtacttcgtaccgttttaccgtccgttaatacgttactacgaaaccgttgggtcgccggtccgaacgggccgtccggtcggaacaaccgtaccgttggacggttggtacggtcggggacgtacgggaaccaacccgtaaacgcggttaggtcgtacggactggttacgtccttacccacctaccgtacccggtcggacgtaacgtaccctacgtcgttaccgaactacccggtaaacctccctaaccgaataaccaccgtaccgttacaacgttacgggaggtacgttaggaaccggtcgtactgaaccgtattcgacgtacgccgaacccggggtttaccgttaccgttacgtcgtccggtactaacggtcccgttacccgaacggttccggttacccgggtcgtaacccgggggtccaaccgggtaccgtacggggttccccggtttaccgttacccggngttttaaccccgggggccggg

SEQ ID NO: 207819 - DNA, 734 bp, Homo sapiens
  misc_feature: GYAE6OF01CQKUI.17.25.C03.1.454.CMB.1.raw
  modified_base (186)..(186): a, c, t, g, unknown or other
  misc_feature (186)..(186): n is a, c, g, or t
  modified_base (241)..(241): a, c, t, g, unknown or other
  misc_feature (241)..(241): n is a, c, g, or t
  modified_base (251)..(251): a, c, t, g, unknown or other
  misc_feature (251)..(251): n is a, c, g, or t
  modified_base (268)..(268): a, c, t, g, unknown or other
  misc_feature (268)..(268): n is a, c, g, or t
tcagcgtagactagcacgaccggtgctcgatttagtagtgtagatttgggtttggggactcaacaaccacatctgtcctctagagaaaaccctgtgagcacagctcctcaccatcgactcggacctggaggatcctcttcgttggtggcagcagctacagtcgcccactcccgaggtgcagctggngcgtagtcgtgggctggaggtgaacgacgccggtgggcctgagtagacgtctcgngcagtcttgngtattcgtacgtttacnctatagtatacgacggtggacgcgccgaggtccgcgtacggaacctacgaccgtaggtaggtacggaggtggggtactccggggaacccctaaaccctaacggtacggtggtacgtaccgtaacgttagttccgtacccgttacccgaacccgtacgttcccgggtaacccggactaaacgttacccgttaaccacggtaccgaacccgtaaccgttaaccctacccttaacgaaaccgttaaaccgacgtaaccgtactaacgtaggttacggtagttaggacggtcgtactagactacggttacgacggtaccggtaaccggtaccggtccgttttaaacgtcgttaccggtggtaaccggtccgtaaaccggtccgtacccggtaacggtccgggtacggtacgtacccggaccgtacgggcgtaccggttccgtttacgttccggtcggtcgggtaccgggg

SEQ ID NO: 207820 - DNA, 785 bp, Homo sapiens
  misc_feature: GYAE6OF01BA413.17.25.C03.1.454.CMB.1.raw
  modified_base (222)..(222): a, c, t, g, unknown or other
  misc_feature (222)..(222): n is a, c, g, or t
  modified_base (305)..(305): a, c, t, g, unknown or other
  misc_feature (305)..(305): n is a, c, g, or t
tcagcgtagactagcacgaccggtgctcgatttagtagtgtagatttgggtttgggactcaacaaccacatctgtcctctagagaaaaccctgtgagcacagctcctcaccatggactggacctggaggatcctcttcttggtggcagcagctacaagtcgccccactcccaggtgcagctgggtgcagtcgtggggcgtgaggtgaagaagccgtgggccncagtgagtctcctgcaggcttcgtaggattcgtaccgtttacctcctatagtactacaacgtggtgccgccgacggccgtcgnggacaacgccgtaggagtggtagtgggacgtcgggaccgtaaacccgtaacacgttcggcgtacacgtagtcgtccttaccaacccgtacgttcccgaccggacaccgtaccgttaaccgacgttaccggaaccctaaccggtaacctacccgtaaccaaactaaacaccctaactacccgtaatacggttacggtaaggttacggaacggtaccgtacccgtacggaaccttagtccgttaccgggaaccggtaacccgacccgggttacccttaacgtttaacgtttaccgtacgggttaccgaccgggtaaaccgggttaaaccccgtaccccgaaacccgggttaccggtttaccccggggtaaccgggtaacccgtaaccccccggggtagggttaaaccccggcggggtttacccccggttttacccgttttacccgggttaacggggttttccccggggtaacccgggggggg

SEQ ID NO: 207821 - DNA, 669 bp, Homo sapiens
  misc_feature: GYAE6OF01E2BJC.17.25.C03.1.454.CMB.1.raw
  modified_base (251)..(251): a, c, t, g, unknown or other
  misc_feature (251)..(251): n is a, c, g, or t
  modified_base (495)..(495): a, c, t, g, unknown or other
  misc_feature (495)..(495): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctggaggtgaagagccgtgggcctcgagtgaacggtctcctgacgaggtcttacgnggtacttacgaccgttttacctccgttaatagttactaccgaagtgggtcgccgtaccgacggtccccgcgtacggacaaccgaccgtggacgtggagtagggactcgggaacctaaacccgtactacggttacggtcgactacgtagttcgtccttaccgaaccctaccgtcccgtaccggactacgtacctacagtaccgaacctacgtaaccctcctaactaacgtaaccacgtacactanagtggaacgttaggacgacgctgactgttacgacgaccgacgtcccgtcgttacttagttaccgtggtacgtacggaaccgtaccgtacccgacggtacttcccggggaagacccgtaccggaacggaccgtccgggttccgttaccgtttggtcccgttcgggtaacccgggg

SEQ ID NO: 207822 - DNA, 730 bp, Homo sapiens
  misc_feature: GYAE6OF01A65V2.17.25.C03.1.454.CMB.1.raw
  modified_base (185)..(185): a, c, t, g, unknown or other
  misc_feature (185)..(185): n is a, c, g, or t
  modified_base (250)..(250): a, c, t, g, unknown or other
  misc_feature (250)..(250): n is a, c, g, or t
  modified_base (290)..(290): a, c, t, g, unknown or other
  misc_feature (290)..(290): n is a, c, g, or t
  modified_base (303)..(303): a, c, t, g, unknown or other
  misc_feature (303)..(303): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggagatcctcttcgttggtgcagcagctacaagtcgcccactcccaggtgcagctggtcncagtcgtggggctggagtggaagacgcgtggggcctcgagtgaaggtctcctgacaaggtcttgngtacttactcgtttacctcctatgtatcgaacgtgggacnccgacgcggccgngtaggaccaaccgtcgtaggaggtgggtacgtaggggacgtcggggaacctaaaccccgttaacaggttacggtgtaaccgaccgtagttccgttaccttcccaaacccgtacgttccccggtaacggggtaaccacggtttaaacccctaaccgttaacacccggtaacccgtaacctaacccgttaaccccttaactaaaacctaaaccgtaacccgaacgtaccctaaacgtaccggtggtaacgttcggaacgtaaccgtctaacggactacgtacgtcgaacgtacccgacggttaccttacgtaagttaccgtggtaccggacgtaaccggtccgtacccaaaggtcccggtccgggtacaacccggtcgaacccgaggtaccggtccggtttactccgggttcccgttgggggtacccgg

SEQ ID NO: 207823 - DNA, 705 bp, Homo sapiens
  misc_feature: GYAE6OF01BKX42.17.25.C03.1.454.CMB.1.raw
  modified_base (297)..(297): a, c, t, g, unknown or other
  misc_feature (297)..(297): n is a, c, g, or t
  modified_base (534)..(534): a, c, t, g, unknown or other
  misc_feature (534)..(534): n is a, c, g, or t
  modified_base (613)..(613): a, c, t, g, unknown or other
  misc_feature (613)..(613): n is a, c, g, or t
  modified_base (651)..(651): a, c, t, g, unknown or other
  misc_feature (651)..(651): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagcctggtcgcacgtcgtgggctgaggtgaagacgccgtggggcctgagtgaacggtctacctgacgaaggcttcgtggtattccgaccgttttccgcctatacgtatacaacgtgggtcnccgccgtaggcccgacgtacggaaccaaccggtaccgtggtaggttcggagttggggaacgttcggggacccgtaaaaccccgtaacgaaccgttgggtacgtacgtaacgtacggttacgttacccttaccgaacccgtacgttcccggtaacccgggactaacggtacccttacgactacggaaccctacgtaaccttcccaccgtaaactaaccacgtaaccgcccttaaacgngttacgggtagttacggaacggtccgtaccgttacgactagtacgtaccgaaccgtacgacccggtcgtacttacgtancggtacgagtacgtccgtacccgacgtcggtacccggngcggtaccgtaccggactacgggtccccttcgtttacgcgtttaccgggccggg

SEQ ID NO: 207824 - DNA, 818 bp, Homo sapiens
  misc_feature: GYAE6OF01B0BDP.17.25.C03.1.454.CMB.1.raw
  modified_base (811)..(811): a, c, t, g, unknown or other
  misc_feature (811)..(811): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatcgaccctagtcctacctacttccctcccttgtcctcgtccgttcgtgggtcgggggtacaggtacgtaccaacctattaccgtacgttcggacccggtaacgtaacggtccgaaacggttaaccgtttaaaaaccttaagttttaaagttggtaactacaacgtaccgtaaacgtaaaaccgtaaggaaacccgtccccaacgtaccccttaccgttagtaccttccgttcggttacggtacgtacctacttacccgtaacgttccgtacgggtaccggtaacgggttccggtacccgtaccctaggttaccgggtacggtttacggtagggtcggaccgttaggtaggtaccgttacgggtacgggaacttacgtttaaccgtttactaaccgtttaccgacctaacccgttaaccttaccccgtaacccttacgtttaccgaaccgtaaccctaaacggggtgtaaccgggtttaatttcgggaactaacgtaaccgtttacctaacgtacgttacgaaacctaagtcccggttaaacttcccgtacccgtttacccacgttcgttaccgttacggaccggttaaggacctaaggtcacgttaacgaaccgtacgttacgggctacgtacctcgtaacacgttctttacncgttccc

SEQ ID NO: 207825 - DNA, 811 bp, Homo sapiens
  misc_feature: GYAE6OF01CY3FK.17.25.C03.1.454.CMB.1.raw
  modified_base (192)..(192): a, c, t, g, unknown or other
  misc_feature (192)..(192): n is a, c, g, or t
tcagcgtagactagcacgaccggtgctcgatttagtagtgtagatttgggtttggggactcaacaaccacatctgtcctctagagaaaccctgtgagcacagctcctcaccatggactggacctggagtactcttcttcgttgggtgcagcagcctacagtcgcccacgtcccaggtcgctagcgttcggtngtacgttcggtggggctaggtagggagaaggacgccggtggggtccctgaggtgtaacggtccttcctggaccgtacggtcttccgttaggactttacctaccgtttacctcgttaatacgtatactacggtggtaccgcgccgacggccgtcgtaacggaaccgaccgtacgtggacggtggtaggtcggggtacgtcggggtaaacccctaacccgtaagtcggttgggtttaccacgtaccgttacgtcggtttaccctaccgacccttacggtcccggtaaccggggacttacgtaacccttacgtaaactccgaaccctaaccggttaaccccttccctaaccgtaaactaaacctacccggcctaaacccgtagtcggtacggtacgggttacggacgtaccgtcgggtaaactctaaccgttcgggttaacccggaccttaacccggtaccggggtacctttcgtttaacttcgggacggttacgtaccggtaacggaaccccttcccgggtaaacgtacccggttacgggtacggtaccccggttaccgggtaccggacgtcccgggtacggtttcccgtttacgtcccggggtccgggtaaccccggggg

SEQ ID NO: 207826 - DNA, 861 bp, Homo sapiens
  misc_feature: GYAE6OF01B88CT.17.25.C03.1.454.CMB.1.raw
  modified_base (180)..(180): a, c, t, g, unknown or other
  misc_feature (180)..(180): n is a, c, g, or t
tcagcgtagactagcacgaccggtgctcgatttagtagtgtagatttgggtttggggacgtcaacaaccacatctgtcctctagagaaaaccctgtgagcacagctcctcaccatggactggacctggaggactcctcttcttggtgcagcagctacaagtcgcccactcccaggtcgcncgctggtgcaggtcgtggggctggaggtgaagaacgccgtggggcctcgagtgaaggtcctaccgtggctaaggtcttcgtaggtattccgtacgttttacctcgtaagtagtaacgttccaaccggttggtaccgaccgtccgtaacgggtcccgaggtacggaaccgtaaccgtaaccgtaggaacggttacggggacgttacggggactacggggacccgtaaaacccctacgtaaccggttcggttacgtacctacgtacgtttccggtaccttaccctacccgtacgttacccgtaccggggaacctaaccgggtacctttaacccgaactaccggtaaccctaacgggtaacccttccctaacccgtaaataaacccgtaacgtaaaccgtacccgtaaacgttaggtaccggtaacggtttaacggtaaaccgggtacgtacccggttaagtaaccgtaacgttaccgttacggaacccggttaaccgaacccgggggttacccttaaccgttaaaacgtttcccggtacggttaacggtccggtaaaacgtccgggtaccccaacgggtaccggttaacccgggtacggtacccggtacccgttaaccgggtacctaaccggggttacccggttaccctttacgggtaaccccggtttggggtaccccggggg

SEQ ID NO: 207827 - DNA, 673 bp, Homo sapiens
  misc_feature: GYAE6OF01A8ETN.17.25.C03.1.454.CMB.1.raw
  modified_base (296)..(296): a, c, t, g, unknown or other
  misc_feature (296)..(296): n is a, c, g, or t
  modified_base (310)..(310): a, c, t, g, unknown or other
  misc_feature (310)..(310): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagttctggtgcagtcgtggggctggaggtgaagaagccgtggggcctgagtagaaggtctccgtgacgaggtcttcgtggattcgtacgtttacctcctatagtactcaacgttgggtnccgccgaggcccgngtacggaccaacgaccgtggacgtggagtgggacgtcgggaccgtaaaccccgttaacacggtggtacgtacaccgtaggttgttccttaccgaccctacgtcccgtacgggacacgtactaccagtacgacctacgtacctaccctacaactaaaccacacgacctatagtggtagttcggaagtacgacgtagactacgtacgtacgaaccgacgtaccgggttacttacgttaacgtttacggtcgtcggacggtaacggtacccgtacccgaagtaccggttaccgggtaggtacccgtacccgtaccgggtacctacgggtcccgttaccgtttacgtcccggtttcgggaccggggg

SEQ ID NO: 207828 - DNA, 916 bp, Homo sapiens
  misc_feature: GYAE6OF01EY8D4.17.25.C03.1.454.CMB.1.raw
  modified_base (149)..(149): a, c, t, g, unknown or other
  misc_feature (149)..(149): n is a, c, g, or t
  modified_base (162)..(162): a, c, t, g, unknown or other
  misc_feature (162)..(162): n is a, c, g, or t
tcagcgtagactagcacgaccggtgctcgatttagtagtgtagatttgggtttgggactcaacaaccacatctgtcctctagagaaaaccctgtgagcacagctcctcaccatggacctggacctggaggatcctcttcttggtggcancagctacaagtcncccactcccaggtgcagtctggtgctagtcgtgggctggaggtagaagaacgcgtcggggcctcgaggtacggaaggttcctccgttgacgaacggtctttcgtaggtactttccgtaaccgttttaccctaccttaattacgtaacttaccgtaaccggtggggtaccgccggtaccgaccggggtcccgtccggtaacgggaacccctaaccggtacccgttaggtaacgggttcgggtaaggtacgggggttacgttaccgggggaacccgtaaacccccgttaaacggtaccgttacggggttacctacccggtaaccgttgggtttacccggttacccttacccgtaccccccgttacccgggtccccgttaccccggggtaaacttaacccggtttaaccctttaaaccccgtacggtaaacccgtaaccccggttaaccgtaaacccccttttaacccccgtaaccttaaaacccgtaaaccgttaaaccccgaaccgttaccccgttaacgtaaacgggttacggggttaccggttaaaggaaccggtacgtacccggttaccgaacgttatccgtaaccgaacccggtacgtaccgggtaccgtttactaacgtttaccgcgggttaccgaggttaccggtacccgtccccgggtaataccggggtacccggtggtaacccgacccggtacgccggtaccggttacccggttccgtttacggttcccggtcgggtaacccggggg

SEQ ID NO: 207829 - DNA, 702 bp, Homo sapiens
  misc_feature: GYAE6OF01AS7FS.17.25.C03.1.454.CMB.1.raw
  modified_base (358)..(358): a, c, t, g, unknown or other
  misc_feature (358)..(358): n is a, c, g, or t
tcagcgtagactagcacgaccggtgctcgatttagtagtgtagatttgggtttgggactcaacaaccacatctgtcctctagagaaaaccctgtgagcacagctcctcaccatggactggacctggaggatcctcttcttggtggcagcagctacaagtcgcccactcccaggtgcagctggtgcgagtcgtggggctggaggtgaagaagccgtggggcctcgagtgaacggtctccgtgcgaaggtcttcgtaggtacttcgtaccgtttaccctcttatagtacttacaacgttgggtacgccgtccgaggtcccgcgtacgggaacaacggtaccgtaggagtgggagtagggngtacgggaccgtaaccctaacgtacgtcggtgtacacgtagtctccgtccacctacgtcccgtaccggactacggtacctacacgtacgacccgtaactaccgtaccctacaacttaaaccaccaactacccgtaacgtacgtacgggtacgttaggacggtacgtaccgtcgaactacgtccgtacggaaccgaaccgtaccgggtccgttaacttacgttacgttcggacggtaccgtaggtacccgtccggtaacggcgttaccggggtacgtaacggtccccgtacgggacccggtaccggtaccggttacccgtttacggtccgttccggggtaccggg

SEQ ID NO: 207830 - DNA, 930 bp, Homo sapiens
  misc_feature: GYAE6OF01DEX69.17.25.C03.1.454.CMB.1.raw
  modified_base (813)..(813): a, c, t, g, unknown or other
  misc_feature (813)..(813): n is a, c, g, or t
tcagcgtagactagcacgaccggtgctcgatttagtagtgtagatttgggtttgggactcaaacaaccacatctgtcctctagagaaaaccctgtgagcacagctcctcaccagtggactggaccgtggaggtctccttcttcgttggtggcagcacgctacaacggtcgacccactcccgaggtcgcgacggtcgtcgggtgacgtacggttcgggtgggggtcgtagggtaggggtaacggaaaacggaacggtcccggttcggggacccgttacgtagggtacgggtacggttcccgtccggtacggacggtaaggtccgtttcggtacgggttaactttacccgttaccggttttaacctaccggttaattaacgtaactaccgttaacgggtggggggtccgacccggcgtaacggggtcccgtacgggtaacggtaacccgaaacgtccggttagggacggttagggtacggtaacggggtcgtaacccgggggtaaccccctaaaacccgttaaggccggttaggtacgttaaccggtaacgttacgggtttcccttacccttacccgtaaaccccgtcggttaaccccgggtccgggaaacttaccggtaaaccccttaccgaaggtaacccggaacccctaaacccgttaacccgttaccctaaccgtaaaactaaacgtaacccgtaaccgacgttaaacggtaggtacgggttaagtaccgggtaacgcgttaacccgtaggaacctacggttacgtaaccgggacccgacggttacccggtaccttacgtttacgttacgnggtccggaacgtccggacctaacccgggtacgtaccggtccggtaacgggacccgtcgggtaaccgtcgggtaccgggttacgttcctttacgggttacggcccgggggtaaccggg

SEQ ID NO: 207831 - DNA, 923 bp, Homo sapiens
  misc_feature: GYAE6OF01AQUGG.17.25.C03.1.454.CMB.1.raw
  modified_base (277)..(277): a, c, t, g, unknown or other
  misc_feature (277)..(277): n is a, c, g, or t
  modified_base (582)..(582): a, c, t, g, unknown or other
  misc_feature (582)..(582): n is a, c, g, or t
tcagcgtagactagcacgaccggtgctcgatttagtagtgtagatttggggtttggggactcaacaaccacatctgtcctctagagaaaaccctgtgagcacagctcctcaccatggactggaccgtggaggatcctctttcttgggtggcagcagctaacaagtcgccccacctcccgaggtgcagccgtggtgctaggtcgtggggcgtaggaggtagaaagacggtccgtcggggcctgagtggtaacgtcctccgtcggcgtaggtccttcgnggttacttccgttacccgtttaccttacctagttaacgttacgtacgtaacggttgggtccgaccggccggacggtcccgtcggtacggaaccgaaccggtaccgtaggtaggtggggtagtcggggtaacggtcgggtaaccccgaaacccgttaacgtacggttcggttactacgtacggtacgttcttaccgtaccctaaccccgttcgtccccggtaccgggaaacctacgtttacccgtaaccgtacgtacccgtaacccaaccgttaacccgttacccctaaaccaacccgttaaaacncccgtaaaccggtacccttaaccgtaagggttacggggttaaggttacgggtaacggtacccgttacccgttaacgaccgtaccgttaccgtaacgggaacccgtacccggtaccgttaaccccggttttaacgtttaacccctttagggtaccgggttaaccgggacccggtttaaaccgggaacccccggtttacccggtaaaaccggggttcccgtcgggggttaaacccgggttacggaccccccggtttaacccgggaaccccggggtcccggggttaacccggttttaccccggtttacgggggttaccccccgggtttggggggaccccggggg

SEQ ID NO: 207832 - DNA, 887 bp, Homo sapiens
  misc_feature: GYAE6OF01BZRBJ.17.25.C03.1.454.CMB.1.raw
  modified_base (176)..(176): a, c, t, g, unknown or other
  misc_feature (176)..(176): n is a, c, g, or t
  modified_base (189)..(189): a, c, t, g, unknown or other
  misc_feature (189)..(189): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggagactccgtcttctggtggcagcagctacagtcgcccactccgaggtcncgagtcgtggtcncgtagtccggtggggtccttagggaaggtggaaacgtaccggtcccggtcggggtcctagaggtacggtaacggttcctccgtagccgtaaggttcgttcgaggtacttccgttaccgtttacctacgttatagtactacgtaacgtggtcgccgtaccgacggcccgtagtaccggaacaaccgtccgtagtagggtaggcgttagggacgttaccggggaaccctaaacccgtagtaccgttagggttaccgtacgtacgtaacgtttccgttacccgttacccgtaccccggtacggtttaccccggaccgggtaaacctacccggttaaacctttacccgaacggtttaacccggaacccttaaacccggttacccttaaccccgttaacccgtaaaaccttaaacccgaacccgttaacccgtttaaccgtaaaccgttaccgggtttaacgttaaccggtttacgggaaccgtaccggtaccccggttaacgtaaccgttacccgttacgtaacccgggtaacccggaacccggttacccggtacccgttttaacgttaccgttacgtacggtaccgtaccggtaacgtacccgttaccggtacggtaccccggtacggttacgcccggtaaccggtcggcccggtaaaccggtccggttacggttacccgtgggttacccgggtacccggg

SEQ ID NO: 207833 - DNA, 812 bp, Homo sapiens
  misc_feature: GYAE6OF01COR1B.17.25.C03.1.454.CMB.1.raw
  modified_base (167)..(167): a, c, t, g, unknown or other
  misc_feature (167)..(167): n is a, c, g, or t
  modified_base (471)..(471): a, c, t, g, unknown or other
  misc_feature (471)..(471): n is a, c, g, or t
  modified_base (599)..(599): a, c, t, g, unknown or other
  misc_feature (599)..(599): n is a, c, g, or t
tcagcgtagactagcacgaccggtgctcgatttagtagtgtagatttgggtttgggggactcaacaaccacatctgtcctctagagaaaccctgtgagcacagctcctcaccagtggactggaccgtggaggactccttcttcgttggtgcagcagctaacgagtcncccacgtccgtaggtgcagtcgtcggtagccgtggtcggtcggggtcagggtaggtacggaaacggacggtccggtccggggacctaggtaggtacgggtacggtcctccgtagacggtacgtccgttgacggtatttacccgttaccgtttacctcgttaagtacgttacgtaacgtacggggttggtaccggaccccgaccggtaccggggtcccggtacgtaccggaaaccgtacccgtaaccggtaggtgggtaacgggtaaggtgggtacccggtacggggaaccttaaaccccggtanaacggttggtacgtacgacgttagtaccttacctacccggacccgttacgtaccggtaccgggaataacccgttacctacgtaacgacccgtaaccaacctacctaaccctaaccgtaaactaaaccncccgtaacaaccgtaacggtaggtacgggttaacggtggtacgacgtacgtactaacgctaacggtcgaccgaacggtccgtacgttacgttacgttacggtacgtaccgggaacgaccggtaccgtacccgaaacggtcggttacgacgggtccgtaccgggtaccgcgggtaccgttacggtttccgtaccgtcgggtccgggtaacgggg

SEQ ID NO: 207834 - DNA, 888 bp, Homo sapiens
  misc_feature: GYAE6OF01BIB1I.17.25.C03.1.454.CMB.1.raw
  modified_base (190)..(190): a, c, t, g, unknown or other
  misc_feature (190)..(190): n is a, c, g, or t
  modified_base (194)..(194): a, c, t, g, unknown or other
  misc_feature (194)..(194): n is a, c, g, or t
tcagcgtagactagcacgaccggtgctcgattttagtagtgtagatttgggtttggggactcaacaaccacatctgtcctctagagaaaaccctgtgagcacagctcctcaccatggactggacctggaggactcctcttcgttggtcggcagcagctacaagtcgcccacctcccgaggtgcagctggngcgngtcgtgggctggaggtagaagacgcgtcggggcctcgagtgacggtcctccgtgacgaggtcttcgtaggtacttcgtaccgtttcctacttaagtagtactacaacggttcgggtacgccggaccggacggtcccgcgtacggaacctaaccggtccgtaggaggtggaggtcggggacgtaccggggaacccgaaacccttacgacggttcggtcgtaccgaagttacgggttcgtacccttacccacccgttaaccggtccccggtaacccggggactaaacccgttaacccgtttaaccgacgtttaacccggaaccctaaacccgtaacccttaccccgtaacctaaaccttaaaacccgacccgtaaacccgttacccgtaaacgtaacgggttacgggttaacggttaccggggtaacgggtacccgttaacccggttaacggtaacctttaccggtacgttaaacccgggaacccgtaaccccggggtaccccgggttaacctttaacccggtttaacgttaccgggttacggagggtaacccgggtaacggtaaacccggtaccccggtaacccggttaccgggttaccgggaacccgggtcccgacccgggttaaccggaccgggttcccggttacccgggttttacgtttaacccgggtccgggttaccggggtacccggggg

SEQ ID NO: 207835 - DNA, 952 bp, Homo sapiens
  misc_feature: GYAE6OF01AROQU.17.25.C03.1.454.CMB.1.raw
tcagcgtagactagcacgaccggtgctcgatttagtagtgtagatttgggtttgggactcaacaaccacatctgtcctctagagaaaaccctgtgagcacagctcctcaccatggactggaccgtggaggactccttcgtttcttggtcggcacgcagactaacgaagtcgcccactcccgaggtgcgacgcgtggtgccgtaggtcggtcggggtacgtgggaagggtacggaaaggaaccggtccggttcggggaccttacggaggttacggaacggtttcctccgtaggacgtaacggttccgtttacgtaggttactttacccgttaaccggttttacccttaccttaattacgttacgtaacgtacggttggggtaccgccggtaccggacgggtcccgtacggtacggaaaccgaaccgtaccggttagggtacggtagggtacgggtagggtacggtaccggggaaaccgtaaacccgttaacgtcggtacggttacggtaccgtacggtacgtttccgttacccttaccgaaccccgttaacgtccccggtaaccgggtacctaagttaccccgtttaacgaaccgtacccgaaacccgtaaccgttaacccttaccctaaccgtaaaaccgtaaccgtaaaccctaccgttaaccctaaacgtaacgggtttacggtaacgggttacggaaccggtaacccgtcggttaacccgttaacgtaaccgttccgggtaacgtaacccccggtaacggttacccgggtaaccgtttaaccgtttaacgtttacccggtacggtaccgggtaaccggtaccggttaaacccgtacccggtaaccggtacccggttacgggaccggttacccgggtacccgtaccggaccggttacccgggtcgttttaccccggtttacggttaccccgggtcggggttaacccgggg

SEQ ID NO: 207836 - DNA, 813 bp, Homo sapiens
  misc_feature: GYAE6OF01ADRK4.17.25.C03.1.454.CMB.1.raw
  modified_base (179)..(179): a, c, t, g, unknown or other
  misc_feature (179)..(179): n is a, c, g, or t
  modified_base (693)..(693): a, c, t, g, unknown or other
  misc_feature (693)..(693): n is a, c, g, or t
tcagcgtagactagcacgaccggtgctcgatttagtagtgtagatttgggtttgggactcaacaaccacatctgtcctctagagaaaaccctgtgagcacagctcctcaccatggactggacctggaggactcctcttcttggtggcagcagctacaagtcgcccacctcccgaggtcncgagcgtggtgctaggtcgtggggctaggaggtagaaacggacggtccggtacggggcctacgtaggtaggtaacggtcctacccgtgacgtacggttccgtttcgtggttacgtttaccgttaaccgttttacccttccgttaattaacggttacttaaccgtaaccggttggggtccgaccgtaccggtacggcccgtacgtacggaaaccgaccggtaccgtgtaaggttacgggagtcggggtacggtaccggaacccgtaaacccgtacgtccgtagggttccgacgtaacgtcgggttctacccgttaccgaacccctcgttacccggtaccgaactacgttaacctaccgtactacgaacccgacgtaccccttaccgtaacgaaacctaaccacgaaccgtccttaaagcggttagggttacgtaggacccgtacgtacgtactacgtagtcccgttacggaaaccggtccctacccggggttactttacggtaacgtttccgggntaccgggagaaccgttcccgaaacccgttacggtcgggttaccggaccggtaccgtcccgggacggtacgtaccgggttcccgtttaaccggttcgttccggggttccggtaacccgggg

SEQ ID NO: 207837 - DNA, 710 bp, Homo sapiens
  misc_feature: GYAE6OF01CODCT.17.25.C03.1.454.CMB.1.raw
tcagcgtagactagcacgaccggtgctcgatttagtagtgtagatttgggtttggggactcaaacaaccacatctgtcctctagagaaaaccctgtgagcacagctcctcaccatggactggacctggaggatcctcttcttggtggcagcagctaacaagtcgcccactcccaggtgcagctggtgcagtcgtggggctgaggtgaagaagccgtggggcctcgagtgaaggtctccgtgcaggcttcgtggtacttctacgtttacctcctatagtatcaacgtgggtgccgccacggcgcgtcggacaaccgctggacgtggagtgggagtggggaccaaccctaacgacgtggtcgtcactaggtcgttacctaccaccctcgtcccgtaccgggactacgtaccttaccgataccgaaccaacgtaacccttccctaacctaactaaaccaccgacgtaccctaaacgtagtacggtaggttacggaacgggtacgtccgtaacgaactaccgttacgtaacgaaccggaacccggtaacccgggtccgttaaccgtttacgttaccgttggtaccggaccggtacggtacccggtacccgaaccggtaccggtacccgggtacgggtacccggtacccggtaccggaccgtaccgggttcccggttaccgttttacggtacccgtttcggggtaccccgggggg

SEQ ID NO: 207838 - DNA, 869 bp, Homo sapiens
  misc_feature: GYAE6OF01BMD35.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacgaacgtaccccactcccgtaggtgcagtcgtggtgctagtcgtagggctggaaggtgaaggacgccggtcggggccttacgagggtagaacggttcctaccgtacgtacgaacggttcgtttacgtacggactttacccggtaacccgttttaaccctccgttaagttaacgttactacccgtaacggtttcgggggtacgtcccggaccggtaccgggtaccccggtcggtaaccggggaaccctaaaccgggtccggttaggaacgggttaccgggtaaggttcgggggtaacgttacccggggaaccccgtaaaccgttaaaccggtcggtacggtttacgactaccggtagttcttaccccgtactaaccccggtagttccccgtacggaactaccgtaccgttaacctacggaactaaccccggaaccgtactaacccgaacctaaactaaccgaccgtaaccggtaacctacgtaggttaaccggtagtaggaccggcggtacttcgaaccgtgttaccgtaacgaaccgttacgggtacccggtacctttagtacgtttacggcggttacggaccgtaagggtaccccgttacggaaccggttacggtccgggttaaccggaccgggttacccgggtacggccggttacccgggttaccggttttccgtaacgggtttcccgggtcggggtttaccgggggcccgg

SEQ ID NO: 207839 - DNA, 824 bp, Homo sapiens
  misc_feature: GYAE6OF01DZ39I.17.25.C03.1.454.CMB.1.raw
  modified_base (784)..(784): a, c, t, g, unknown or other
  misc_feature (784)..(784): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactccgtcttcttgggtgcagtcgagctacaagtcgaccccactcccgaggtcgcacgtcgtggtgcgtagtcggtgggctggaggtagaagacgtccgtggggcctacgagtacggaaggtcctaccgtgacggtaacggtcttacgtggtactttacctaccgttttacccacgttaataacggtactacgtaacggttgggtccgccggtaccgacgggtaccctcggtaacgggaacctaaccggtaccggtggaagggtacggtaaggtacggggtaacgtacggggtaaacccctaaaccccgttaagtaccggtttacggaccggtaaccgtaacgtacggttacgtttacccctaacccgaacccttaccgggtccccgtaacggggaccttaaacggtaacccttaccgaacggttaccgaaaccccgtaacgttaaccctaccctaaaccgtaaacgttaaacccgaacgtaaccgtaacccgttaacgtacggttaagggtaacggttacggacgtacgtaccgtaacgtacgtacacggttacggaaccgtaaccggtccggtacctacgttacttaacggtgtaaccggtacggacgtacccgtaaccgacggttccgtacggacgtacgttacccggacnccggtacgtacttaccggttacgccggttccgggacgggg

SEQ ID NO: 207840 - DNA, 820 bp, Homo sapiens
  misc_feature: GYAE6OF01BNOZ5.17.25.C03.1.454.CMB.1.raw
  modified_base (155)..(155): a, c, t, g, unknown or other
  misc_feature (155)..(155): n is a, c, g, or t
tcagcgtagactagcacgaccggtgctcgatttagtagtgtagatttgggtttggggactcaacaaccacatctgtcctctagagaaaaccctgtgagcacgagctcctcaccagtcggactggacctggaggatcctcttcttgggtggcagcngtctacaacgtcgaccctacctcccaggtcgcgacgcgtggtgactaggttcgtggggctggtacgggtagaacgaaggccgtcggggcctcgaggttaggtaacggttcctccgtaggaccgtaaggtccgtttcgtaggtacttaccgttaccgttttacctaccttattaacgtactaccgtaacggttacgggtcgccggaccgcggtacccggtctaaccgggaaccgaaccggaccgttgggaacgggtggtaacggtcggggtacgtaccgggaacccgtaaacccgttacgacggttcggtacgtacacggtacgttcgttacccttccgaaccccgttacgtaccccgggttaaccggaaccgtaccgttaacccgtaccgtaacggtaacccaaccggtaacctaccgttaacccaacctaaacgtaccaaccgtacgtaacctacgggtatagggtacgtaagggacgtaccgtacgtacgtaccctaggttaccgacgaaaccggtcccgtaccgggttaccttacgtaccgttaaggtcgtaacccggtcggtaaccgttccgaaccgacccggtacggttccggacgtaccgaccccgggtgtacccgggtacgtcccgtttaaccgtcggttaccgggtcgggtcccggg

SEQ ID NO: 207841 - DNA, 635 bp, Homo sapiens
  misc_feature: GYAE6OF01AKG94.17.25.C03.1.454.CMB.1.raw
  modified_base (179)..(179): a, c, t, g, unknown or other
  misc_feature (179)..(179): n is a, c, g, or t
  modified_base (193)..(193): a, c, t, g, unknown or other
  misc_feature (193)..(193): n is a, c, g, or t
  modified_base (220)..(220): a, c, t, g, unknown or other
  misc_feature (220)..(220): n is a, c, g, or t
  modified_base (225)..(225): a, c, t, g, unknown or other
  misc_feature (225)..(225): n is a, c, g, or t
  modified_base (486)..(486): a, c, t, g, unknown or other
  misc_feature (486)..(486): n is a, c, g, or t
  modified_base (527)..(527): a, c, t, g, unknown or other
  misc_feature (527)..(527): n is a, c, g, or t
  modified_base (534)..(534): a, c, t, g, unknown or other
  misc_feature (534)..(534): n is a, c, g, or t
  modified_base (543)..(543): a, c, t, g, unknown or other
  misc_feature (543)..(543): n is a, c, g, or t
  modified_base (564)..(564): a, c, t, g, unknown or other
  misc_feature (564)..(564): n is a, c, g, or t
  modified_base (570)..(570): a, c, t, g, unknown or other
  misc_feature (570)..(570): n is a, c, g, or t
  modified_base (601)..(601): a, c, t, g, unknown or other
  misc_feature (601)..(601): n is a, c, g, or t
  modified_base (626)..(626): a, c, t, g, unknown or other
  misc_feature (626)..(626): n is a, c, g, or t
tcagcgtagactagcacgaccggtgctcgatttagtagtgtagatttgggtttggggactcaacaaccacatctgtcctctagacgaaacctgtgagcacagctcctcaccagtcggacttcggacctgggacggacttccttctttcgtttggtggacagcagctacgaagtcgcccnccgtccgagtgacngtcgtggtcgctagtcgtagggtctgnggtanaagacggccgtggggacccttagaggttagaacgggtcctacgcgacacggtcgttcgtaggtactcgtacctttaacctgtacttagtacgtacgtagttcggtcgacgtcgacggccgtactcggacgtacgtacctggtcggagtggtacgggtcgaagggtaccctacgaacctggtcgtacgtcgtacgtacgtcgtactccgactacgttcccgtacgacgtacgtactacggcacgtacactacctcaacgtanacacagctacgtggacgttagacgggctaacgctaaacgcngttaacngtaacccgngtaccgtacgtactattacgngttacngacctagaacccgcgtagtacgcggttaacncggaagtcgacgttcaccgtgttancggtacggg

SEQ ID NO: 207842 - DNA, 934 bp, Homo sapiens
  misc_feature: GYAE6OF01A70U7.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaacgacggccgtggggcctgtagtgacggtctccgtgcaaggtccttgtggtacttcgtaccgtttacctacgttattaagtactacgtaacggtgggtacgacccggtaccgaagggcccgtacgtacgggaacctaaaccggacccttgggaacggttgggtaacggtggggacgttaaccgggggaccctaaaaccccgttaacggtaacgttccgggttacgaaccgtaaccgttagggttacccgttacccgttaacccgtaaccccttaccgggtacccccggttaacccggggtaaacctaacgggtttaaaccccttaaacccgttacgaaccccggtaaccccgtaacccggttaaacccgttcccctaaccctaaacttaaaaaccccaaccgtaacccggttaaccccttaaacgtaacggtaacggggttaaacggtttcgggtaaaccgggcggttaacccggtacggtaacctaaccggtttaaccgacccggtaaaaccgggtacccgtaaccgggggtttaccccttaacggtttaacccgtttacgttacgggtaaaccggtaacccggggtaaaccttaccgggtaacccccggtaaggtaccgggttacccggtaccgggttaaccgaaccccggtttacgggacccggtaccgggtttacccccgggtacgttttaccggtcccggggttacccgggttaaccgggggg

SEQ ID NO: 207843 - DNA, 661 bp, Homo sapiens
  misc_feature: GYAE6OF01ECRYY.17.25.C03.1.454.CMB.1.raw
  modified_base (180)..(180): a, c, t, g, unknown or other
  misc_feature (180)..(180): n is a, c, g, or t
  modified_base (241)..(241): a, c, t, g, unknown or other
  misc_feature (241)..(241): n is a, c, g, or t
  modified_base (271)..(271): a, c, t, g, unknown or other
  misc_feature (271)..(271): n is a, c, g, or t
  modified_base (289)..(289): a, c, t, g, unknown or other
  misc_feature (289)..(289): n is a, c, g, or t
tcagcgtagactagcacgaccggtgctcgatttagtagtgtagatttgggtttggggactcaacaaccacatctgtcctctagagaaaccctgtgagcacagctcctcaccatggactggacctggagactccttcttcttgggtggcagcagactacaagtcgccctactcccaggtcncagcgtggtgccgagtcgtgggctggaggtgaagtacgcgtgggcctcgagtgacgtctcngcagtctagtgtcttcgtacgttcctactntagtatcagtggtcgacncgcgtcgctagacacgatgagtaggtgaggtcgacgggacctaaccctagtacgtgtacgtactacggtacgtcgttactaccgtaccctacgttcccggaacgggaacctaccgggttaacttaacccgacgttaccgaacccgtaacccgtacctacccgtactaaacctaaacgtaacaaccgtacctaacgtaggttacgtaggttacggaaccggtactaccggtagtaaccgtacgtcggtaacgaaccggtacgaccggtccgttacttacgtcgtacgtacaccggtagtacccgacgtccggtacggtcggtagtaccgaccgaccgtacgtacggtcccgtagttccgttgtccggtacggg

SEQ ID NO: 207844 - DNA, 800 bp, Homo sapiens
  misc_feature: GYAE6OF01A6HQT.17.25.C03.1.454.CMB.1.raw
  modified_base (190)..(190): a, c, t, g, unknown or other
  misc_feature (190)..(190): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcnggggctggaggtgaagaagccgtggggcctcgaggtggaaggtcctccgtgcaaggtcttcgtgggactttacctaccgttttaccctcctttaagtacggttaactcctaaacgttgggggttacgccggtccgagggccccgcgttacgggaaccgaaaccgaccgttggacggttgggaagttgggggaacgtcgggggaacccgtaaaacccccttaaacgtaaccggttggtacgtaccctaaggtacggtttcggttaccctttaccaacccccggtacttccccgggttaccggggaaacctacggtaaacctttacccgaagttaccgaaccgtaaccgtaaccttccccgtaccctaaaggtaaacccacgtaaccgtaccctaacgtaacggtcgggtaaggttaccggacgggtactccgtaacggactaccgttcgttacggaacccgtccggtaaccgggtcccgtttaagttacctttacggtgtcgaccgtaacggtccgtaaccccgtacggtacgtacccgggtacaaccgggtccctaagggccgtaacggtcccggtttacctttacgtccccgggttggtacccgggggg

SEQ ID NO: 207845 - DNA, 865 bp, Homo sapiens
  misc_feature: GYAE6OF01A59E7.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggactcctcttcgttggtggcagcagctacaagtcgcccactcccgaggtgcgagcgtgggtcgcgtacggtcggtggggcgtaggacgggtaggaaacggaacggccggtcggggtccttacgaaggttaggaacggtcctcccgtggacgacgggtccttcggtagtactttcgttaaccgtttacctccttaagtacgttactaccgtaacgttggggaccgcgacccggacggccggtcgtacggaaccaaccggtaccgtggtaggtaggtaggttcgggacggtacgggtaacccggtaaaccctaagtaaccgtgggtaccttaacgacggtaacggttcgtacccgtacccgaacccgtaccgtacccggtaccggggtaacctaccgtaacccgttaacgaccggttaccgaacccgtaacccggtaaccttacccctaactaaacccgtaaacaacgaacctaccgtaacgacggttacgggtaggttaggacggtactccggtaactacgtagtaccgaacgaccggtaaccggacccgttcccgttaacgtttaccttaacgggtcgggtaacgtaacccgggtacggtaccccgtacccgggaacgggttcccggttacggggaaccgggcccgttaaccccgggtacgggtaacccgggttcccgggttacccgggttacccgttttacggggtaccccgtttcccgggggttaacccggggg

SEQ ID NO: 207846 - DNA, 850 bp, Homo sapiens
  misc_feature: GYAE6OF01EJZX4.17.25.C03.1.454.CMB.1.raw
  modified_base (258)..(258): a, c, t, g, unknown or other
  misc_feature (258)..(258): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgctagtcgtgggctggaggtgaagacgccgtggggcctacgagtgacggtcctccgtgacgtaacgtctttcgnggtactttctaccgtttaccctccttagtacgtatacctaacggtgggtacgccggccgacggtcccgtacggtcggaaccgtaaccgaccgttggaggtaggagttaggggagtaccgggaccgtaaaccctacgtacggtcgggtctacaacgtacgttcgttaccttacccgaacccctcgttaccccggtaccgggtaaacctacgtaacccgtttaaccgacgttacccgaaacccgtaaccgtaacccctttacccctaacccgtaaaacttaaaacccaaacccgtacgttaccccgttaaacggtaacggttaccggggttacgggtttaagggaaccgggtaaccgttcccggtaaccgtaaccgtaccgtttacggtacccgggaacgaacccggtacccgggttaaccttaccgtttacgttaccgtacggtacgtaccggtaaccggtacccgtaccccggtacggttacccggttaccgggtaccggtaccggttaaccccggtacgggtaccccgggttacggttacccgggtttaccccttttaacggggacccgttttaccgggggacccgggggg

SEQ ID NO: 207847 - DNA, 813 bp, Homo sapiens
  misc_feature: GYAE6OF01BD6LN.17.25.C03.1.454.CMB.1.raw
tcagcgtagactagcacgaccggtgctcgatttagtagtgtagatttgggtttgggactcaacaaccacatctgtcctctagagaaaaccctgtgagcacagctcctcaccatggactggaccgtggagactcctcttcgttggtggcagcagctaacaagtccgccctacctcccgaggtcgacgagtcgtgggtcgcgtaggtcggtcgggctagggaaggtaggaaacggacggccggtcggggacctaggaggtacggtaacggttcctaccgtacggaccgtaacgggttccttacggttacgggttacctttaccgtttaacccggttttaacccttaccgttaaggttacgttaccgttaacgtacgggttcggggtcgacccggtaccgaccggggtcccgtaccggtaaccgggaaccgtaaacccgggtaccgtagggtacgggtacggggacggttaggggtaccgtaccgggtaaaccccgtaacccgttaacggtacggttcggtacgtaacccgaacgttacggttcccttaccttacccgacccgtacgtcccggtacgaactaaccgtacctacgacgtccgaaccctacgtacccgtaccaacgtaaccaactacgaccgtacaagtacggtacgtaggacgtacgacgtacctaggaactcgtcgaacggtaccgtaccggtaccgttcctaagttacgttacggcgtacgaccgtcgtacccgacgtaccggtacgggtcgtacggacgacccgtggacggtcggtacctgttaaccggtcggacgggtccggg

SEQ ID NO: 207848 - DNA, 656 bp, Homo sapiens
  misc_feature: GYAE6OF01A4C4C.17.25.C03.1.454.CMB.1.raw
  modified_base (279)..(279): a, c, t, g, unknown or other
  misc_feature (279)..(279): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagccgtggggcctcagtgaaggtctcctgcaggcttctggattctacgtttacctctatagtatcaacgtggngccgccaggccgctggacacgacctgagtggagtgggagtgggaccgaaccctaacacgtggtcgtcacgtagtgtcctccacccagtcccgtacccgggacacggtacctaccactacgaaccgaaccgtaacctcccgtaaccaactaaaaccaccgtaacgaccctaacgagtacgggtagttaggaacgggacgtacctgaaccgtacgttcgtacggtaaccgaaccggaccggtacccgttacttaacgttccgtggtacggcgaaggtacccgtaccccggaacgttaccggtccgggtagtaccggtacccgtaccgggacgtaccggtccggtttacctttacggtcccggttcgggtaccccggggg

SEQ ID NO: 207849 - DNA, 744 bp, Homo sapiens
  misc_feature: GYAE6OF01A9GRC.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttctggtggcagcagctacagtcgcccactcccgaggtgcagctggtgcagtgtgggctgaggtagaagaagcctggggcctgagtgagtctcctgcaggcttctggacttctacgtttcctacctatagtatacgaacgtgggtcgaccgcctaacgggcccgtacgtcgggaacctaaccggtaccgtaggaggtagggaaccgttgggggtaacgtccggggaacccgttaaccctaacgtagtcggttcgtacgacgtagtcttaccgttacacccgtaagtcccgtaccgggactacgtacgtaaccctagttaccgacctaaccggtaacctacccgtaccaaacgtaaacccacgtaaccggtacctaaacggtccgttagggtaacggttaccgggaagtacccggtaacccttacggaccgtacttacggttacggaaccgtaaccggtccggtacccgtttaccctaatttaccggtagttaccgacggaacggttacccgtaccgacggttaccgtaccgggttagaaaccggtcccgttaacggaccgccggttaccggtaccctttttcggtaacccggttccgggtaccggggg

SEQ ID NO: 207850 - DNA, 695 bp, Homo sapiens
  misc_feature: GYAE6OF01BG3NG.17.25.C03.1.454.CMB.1.raw
  modified_base (188)..(188): a, c, t, g, unknown or other
  misc_feature (188)..(188): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccgaggtgcagctggtgacngtcgtgggctgaggtgaagacgccgtgggcctcgagtcgtaacggtcctcgtgacgtacggtcttgtaggtacttcgtaaccgtttacctacctatacgttataccgtaaggtggtcgacgcgacggtccgaggtacggaaccgtaaccgtccggtagtagggtagacggtgggtacgcgggtaaaccaaccgtaagtacgtggtcgactaggtatcgttacctaccgaacctcgtcccggtaacggaacaacgttacccgtacagtaccgaaccgacctaacctcctaacgaaactaaccaacgtacgtacctaagtacgtaggtacgttaggaacggtcgtactaacgacgtacgttacgaccgtaaccgtaccgaccgggtaccttacgtttacgttaacgtcggtacgacggtaccggtacgtaccccgtaagtcggtacggtacggaccgtaccggtaccggacgtacggcccggtttagtaccgtccggttcgggaccggg

SEQ ID NO: 207851 - DNA, 776 bp, Homo sapiens
  misc_feature: GYAE6OF01DMTSF.17.25.C03.1.454.CMB.1.raw
  modified_base (191)..(191): a, c, t, g, unknown or other
  misc_feature (191)..(191): n is a, c, g, or t
  modified_base (308)..(308): a, c, t, g, unknown or other
  misc_feature (308)..(308): n is a, c, g, or t
tcagcgtagactagcacgaccggtgctcgatttagtagtgtagatttgggtttggggactcaacaaccacatctgtcctctagagaaaaccctgtgagcacagctcctcaccagtggactggacctggaggactcttcttcgttggtggcagcagctacagtcgcccactccgaggtcgcagcgtggtgcngtcggtgggctggaggtagaagacgtccggtggggcctagaggtgaacggtcctctgacgtaggtcttgtgtccttacgtaccgtttacctacgtagtagtactacgtggttgggcnccgcggacggtccgacgtacgaaccgtaacgtccgtaggttacggaggtacggttaggggaccggttaccggggaaccctaaaacccgttaacggtccgggttacggtttaacgaccgtaacggtttacgggtttccgttaccccgtttacccaaccccgttaccggtacccgggttaacccgggaaacttacggttaaaccccttacacggttacccggaaaccttaacccgtaaccctttacccgaaacctaaacgttaaccaacccggtaaccttacctaacgtagggttacggtaacggttacgggaacgtacgtaccgtactaacgtcgtaaccgcggtaaaccgccgtaccggttacttactttacgttccgaggtaccaggttaccgacccgtaaccgcggtttacggcggtagcccgtaccgacggtcgacgggtcttaacgtgtacccgtgggtacggg

SEQ ID NO: 207852 - DNA, 874 bp, Homo sapiens
  misc_feature: GYAE6OF01B8G5V.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctaacaagtcgcccactccaggtgcagctggtgctagtcgtggggctggaggtagaagagccgtggggcctacgaggtgaacggttcctcgtgacgaaggtcttcgtggtacttcctaccgttttaccctaccttaattaacgttactacgaaccgttggggtcaccgccggaacgggcccgtcgtagggaacctaacggaccgtagggtacggtggtaacggttggggaacgttaccggggaacccgtaaaaccccgttaaacgtccggttaggtacgtacgaacgtagtttcgttacccttaaccgacccgtaccgtacccgggtaccgggtaaacctaaccgtttacccttaaaccgaacgttacccgaaaccccgtaaccgttaaacccgttacccctaacctaaaccctaaaaaccgtaccccgtaaaccgtaccccgttaaacgtacgggttaacgggttaagggttaacgggaaccggtaacgtacccgttacgtaacccttacgtaaccgtacggtaaacccgggtaaccctaccggggtttaccccgtttaacgtttaacgttaccgggtttaggaaccggtaccgggtaaacggttacccgaccccggtaaaccggttccggtacccgggtaggtaacccggtaccggtacccgggtacgtaccggggtccgtttaggtttcccgtaacgggttccgggttaacccggggg

SEQ ID NO: 207853 - DNA, 776 bp, Homo sapiens
  misc_feature: GYAE6OF01CPI7W.17.25.C03.1.454.CMB.1.raw
tcagcgtagactagcacgaccggtgctcgatttagtagtgtagatttgggtttggggactcaacaaccacatctgtcctctagaagaaaaccctgtgagcacagctcctcaccatggactggacctggaggatcctcttcgttggtggcagcagctacaagtgcccactcccaggtgcagtctggtgcgagtcgtggggctggaggtagaaagaaggccgtggggcctcgagtgaaggtcctcgtgacaaggtcttcgtggattccgttaaccgtttacctctaagtagtatacgacgttgggtcgcgtccgaggccgcgtacggaacaacggtacctaggacggtaggagtacggggtagtacggggacctaaaccctacgacgttggtacgtacgtaacgtaacgttcgtaccctttaccaaccccgttacctacccgggttaaccgggaccgtaacgttaacccgtttaaccgaccgtaccgaacccgtaaccgtaaacccttcccctaaaccgtaaacgtaaaaccaaccctaacgtaaccccgtaacgaacgggttagggtaacggttcggaaacgggaccgtaccgtagaacctacgtcggtaacggaacccggtaccgtaaccgggtccttaacgttattaccggtgacggtacggtaccgccggtacccctaagggtccgttaccggggactaccgggtacccgtaccggtaccggtccgggttacccggtttcgtttaaccggaccgggttttccgggaccgggggg

SEQ ID NO: 207854 - DNA, 798 bp, Homo sapiens
  misc_feature: GYAE6OF01BWIBP.17.25.C03.1.454.CMB.1.raw
  modified_base (173)..(173): a, c, t, g, unknown or other
  misc_feature (173)..(173): n is a, c, g, or t
  modified_base (199)..(199): a, c, t, g, unknown or other
  misc_feature (199)..(199): n is a, c, g, or t
  modified_base (366)..(366): a, c, t, g, unknown or other
  misc_feature (366)..(366): n is a, c, g, or t
  modified_base (527)..(527): a, c, t, g, unknown or other
  misc_feature (527)..(527): n is a, c, g, or t
tcagcgtagactagcacgaccggtgctcgatttagtagtgtagatttgggtttgggactcaacaaccacatctgtcctctagagaaaaccctgtgagcacagctcctcaccatggactggacctaggaggactccgtcttcgttggtggcagccagctacagtcgaccctacnccaggtcacaggtcgtgggtgaccgnggttccgtgggggtactggacgggttaagaacggaggtccggtcggggaccttagaggttacggaacggttcctcccgaggtctaacggttccttacgtacgggttaatttaccgtacccgttttacctaccgtagtaaacgtgttaaccgaacggttcggggtacnccgaccggtacggcccggacgtacggtaccgaaacgtcctaggacggttaggacgtacggggtcaccggggaaccctaaaccgtacggacgtggttaccgcgtaacgtggttacctacgttcccaaccgtaccttcggacgtacaacgtactaccggtacnctaacccgtacgtacctacctaccaaacaaacgtacctaacgtaccgtaacgtacggtacgtaacggtagtacggaccgtaaccggtacgaacttaccgtacgtaccgtaccggtaaccggtacccggttacccgttagttaccccccccccgttagtaccggtagtaaccggtacggtaccgtaacggtaccgtaccggtaccggtacggtaccggacccggtacgtacggtcggtaccggttaccgtttcggtccggtcggtaccgggg

SEQ ID NO: 207855 - DNA, 843 bp, Homo sapiens
  misc_feature: GYAE6OF01BFD8K.17.25.C03.1.454.CMB.1.raw
  modified_base (246)..(246): a, c, t, g, unknown or other
  misc_feature (246)..(246): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtgcagcagctacaagtcgcccactccgaggtgcagcgtggtgctagtcgtcgggctggaggtagaagacggccggtagggcctgaggtgtaacggtctccgngacgtaaggtcttacgtggtacttctaaccgtttacctacgtaagttacgtacttaccgacggttcgggtcgaccgtaccggacggccgtcgtaacggaccctaacggtacgtcggacggtcggagtcggggtacgtccgggaaccccttaaaccgtaacgtcggtttaccggacggtaccaacggtagggttccctaccgtttacccgacccgttacggtcccgggacccggtaactacgttacccgtaaccgtaacgtaccggaacccgtaacgtacccctaccgtaaacctaacctaaacctaacccgaccggttaacctaacgggttaacggtacgggtaacgggtttacggaaaccgggtccttaacggtacgtaacgttaaccggtccgaacggtaacccggtaacccggtaccgggtttacccgttaacgttaaccgggtttaacgtggtaaccggtacccgggtaacgtaaccccgtccggttaagggcccgttacccggtacgggtaccccggtaccgggttacccgaccggttacggggtaccccgttaccgtttaaccgggttcccgggtaacccgggtaccgggg

SEQ ID NO: 207856 - DNA, 889 bp, Homo sapiens
  misc_feature: GYAE6OF01BF401.17.25.C03.1.454.CMB.1.raw
tcagcgtagactagcacgaccggtgctcgatttagtagtgtagatttgggtttggggactcaacaaccacatctgtcctctagaagaaaaccctgtgagcacagctcctcaccatggactggacctggaggactcctcttcgttggtggcagcagctacaagtcgcccactcccaggtgcagcgtgggtgctagtcgtggggctggacggtagaagacgccgtgggcctcgagtgaacggtctccgtggcgtaaggtcttcgaggtacttacctaccgtttacctaccgttataacgttactaccgtaacgttcggggcgccggaccgtaccgggccccgtacgtaccgggaacctaaccggtaccgtagggtacgggtagggtaacggtaccggggggaacgttacgggggaacccccggtaaaacccctaaacgtaccggttacggggtacgtaccgtaacggttacggttccggttacccgttacccgaacccgttacccgttcccggtaccccggggtaactaccggttaaaccttacccggaacgttaccgaacccgtaacccgtaacccttcccctaaccgtaaactaaaccacccgtaaccggttacctaaacggttagttaacggggtaacgttcgggaaaccgtacggttacccgagtaacctagtccggtaaccggtaaccggaccccgtaacggggttcccttaaacgtttaccgttaccggtagggtacccgggtaaacgttaccgggaacccgttaccccgggttaaatcccggggtttaaccgggtacggaccccggttaacccgggccggttaccggacccggggtttccgtttacccgggttttaacgcccgggtttccgggggaaccggggg

SEQ ID NO: 207857 - DNA, 801 bp, Homo sapiens
  misc_feature: GYAE6OF01CTJPO.17.25.C03.1.454.CMB.1.raw
  modified_base (188)..(188): a, c, t, g, unknown or other
  misc_feature (188)..(188): n is a, c, g, or t
  modified_base (278)..(278): a, c, t, g, unknown or other
  misc_feature (278)..(278): n is a, c, g, or t
  modified_base (609)..(609): a, c, t, g, unknown or other
  misc_feature (609)..(609): n is a, c, g, or t
  modified_base (782)..(782): a, c, t, g, unknown or other
  misc_feature (782)..(782): n is a, c, g, or t
tcagcgtagactagcacgaccggtgctcgatttagtagtgtagatttgggtttggggactcaacaaccacatctgtcctctagagaaaaccctgtgagcacagctcctcaccatgactggacctggaggatcctcttcgttggtggcagcagctacaagtcgcccacctcccaggtgcagtctgggtncgtacgtcggtggggctggaggtagaaacgaacggtccgtcggggtcctacgaggtagtacggtcctcctcgacgaggtccttgtaggtnttacctaccgtttacctccttaatagtactacgtacggtcgggcgtccgccgacggtccgtccgtacggaaccaccgtaccgtggacggtagggtaggtacgggtaggtaccgggaacccaacccgtacgtacggttagtaccgtcgaacgttcggttacgtaccttaccccaccgtcggttaccccgaccggtaacgtacgtaaccttaccacgtaccgtaacccgaaccctaaccttccccgaaacctaaaccgttaacccgaacccgtacgtaacccgttaaacgtagggttcgggtaacggttacggaacggtaccggtacccgtanacgttacgttacgaaccggacgtaacccggtcccgttcccttaagtttactaccgtgttaacggacccggtaacgttccccggtaacccggaaccgttcggggtacccgttcgggaaccccgtttacccgggacgtacccggtcccgggttacccgttccggtttaacccggngttcccggggggtacccgg

SEQ ID NO: 207858 - DNA, 841 bp, Homo sapiens
  misc_feature: GYAE6OF01CMM9E.17.25.C03.1.454.CMB.1.raw
  modified_base (101)..(101): a, c, t, g, unknown or other
  misc_feature (101)..(101): n is a, c, g, or t
  modified_base (340)..(340): a, c, t, g, unknown or other
  misc_feature (340)..(340): n is a, c, g, or t
tcagcgtagactagcacgaccggtgctcgatttagtagtgtagatttgggtttgggggagtcagtctcagtcaggacacagcatggacatgagggtccccnctcagctccgtgggctcctgctactctggctccgagctgccagatgtgactagtccagactcgacccagtcctccacttccctcccgtgtcctcgcctcgtgggtgggggtcaaggtcgtaccaccgtatacctcgttcggaccggaacaaggtaccgaaccgggttaaacctttaaacctttaagttttaacttgggttacttcgaaggacctaaacggaaacccgtaagggaaaccnccccaggtaccctccgtagtacttccgtagttcggctaccgacctaccctacttccgacggtacgtagggtccggtaccgtaccgtacgtcggttaaggttcgtaacgggtcgggtacgttaagggttaccggagtttccgggtaacggggtaactttacggttatttttaacccggaacctttcccgtaacccaaccttacctaccgtaaccctttccgtacgtaacccgtaaccggtaacctttaggggaacgtttagttacggtaagttacctaaccgttactttaaccgtacgttaacgtaacctaacgtaaggttaaccgtttcccgttacccgttcccgttaagttcccgttttaacggttccggaacccgggtaacgggttaaccgaaacggttaaggtaaaccgtaaccggaaccggttaaaccgtccgggtttacggacgtacccgggttaccacccgggttaacctaacgggtttccccttcgtttacccg

SEQ ID NO: 207859 - DNA, 690 bp, Homo sapiens
  misc_feature: GYAE6OF01ETGAH.17.25.C03.1.454.CMB.1.raw
  modified_base (334)..(334): a, c, t, g, unknown or other
  misc_feature (334)..(334): n is a, c, g, or t
  modified_base (622)..(622): a, c, t, g, unknown or other
  misc_feature (622)..(622): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtgggcctcagtgaaggtctccgtgcaggcttcgtggtattcgtacgtttcctccttatagtatcaagtgggtgccgtccgaggccgcgtaggaaccacggcctggacggtggacgtgggancggggaccaaacccgtaagtacgtggtcgtcacgtaggttcgtacctccgaacccgtcgtcccgacgggtacacggtacctaccagtacaacccgacgtaacccttcccgtactaaactaaaccaccgacgtaccctaagtacggttcgggtaagtaggaaacggtccgtactaacggactacgttcgacgtaacccggaaccgtaccgggtccttaccgtttaaacgttccgtacgggtcgtacgaaccgggttccgaaaccccgtagggtcccgttacccggggtnaaccggttccccggtaggcccgtacgggtacccggttccgtttaccggacgtttccggggacccgggg

SEQ ID NO: 207860 - DNA, 777 bp, Homo sapiens
  misc_feature: GYAE6OF01D0EHR.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagcgtggtgcagtcgtgggctgaggtagaagaacgccgtgggcctcgagtgaaggtcctccgtgacgaaggtcttgtggtacttcgtaccgtttacctcctatacgttactacgtaacgtggtcgtaccgccgacggcccgcgtacggaaccgaaccgtaccgtggacggtaggtagtaggggtaggtaccgggaaccgtaaacccgtaaccgaccggttggttacggtcacgtacgttcgtacccgttccaaccccgtcgtcccggtacccggggactaaccggttacccttaaccgaacgtaacccgtaacccgtaacccgtaaccctcccctaacctaaacgtaaaaccctaacccgtaaccgtaccctaaacgaggttacgggtacggttaggaggtaccgtccgtaacgaacttagtaccgtacgaaccggacccgtaccggttacccgttacgtttacgttacgttggaccggtacggacggtacccgtaccgaaccggtaccggttaccggtacggacccgtacccgggtacgacccggtaccggttcccggttaccccggttttacgttcccggttccgggtaacccggggg

SEQ ID NO: 207861 - DNA, 720 bp, Homo sapiens
  misc_feature: GYAE6OF01E2EM0.17.25.C03.1.454.CMB.1.raw
  modified_base (180)..(180): a, c, t, g, unknown or other
  misc_feature (180)..(180): n is a, c, g, or t
  modified_base (571)..(571): a, c, t, g, unknown or other
  misc_feature (571)..(571): n is a, c, g, or t
  modified_base (660)..(660): a, c, t, g, unknown or other
  misc_feature (660)..(660): n is a, c, g, or t
tcagcgtagactagcacgaccggtgctcgatttagtagtgtagatttgggtttggggactcaacaaccacatctgtcctctagagaaaaccctgtgagcacagctcctcaccatggactggaccgtggaggactcctcttcttgggtggcagcagctaacaagtcgcccactcccaggtncagcgtggtgctagtcgtgggctggaggtagaaggacgccgttggggcctacgaggtaggaacgtcctccgtagacgtaaggtctttcgtaggtactttaccgtaccgtttacctcttaagtagtactcgaacggtggtacgccgaccgacggtccgtgtacggaccaacggtccgtaggagtggagtgggagtcgggaccaacctagcggtgtacgtacacgtagttcgtaccttccgaccctacgtcccggtaaccgggacctacgtaaccgttaccagtacccgaaccgtaacccgtaccttccccgtaaccaaagtaaaccaccgtaaccgaacctacgtagtacggtacggttacgaacggtacctaccgtacgataccgttacgngtaaccggtacgtacccgggtcctttaccgttagttacgtcggcgtaacggaacgttccgggaaccctaccgggtacgtcccgggtaancccggtaccggtacgcccgtacggttacccgtagtttaccggaccggttgggaacccggg

SEQ ID NO: 207862 - DNA, 771 bp, Homo sapiens
  misc_feature: GYAE6OF01CK4R0.17.25.C03.1.454.CMB.1.raw
  modified_base (688)..(688): a, c, t, g, unknown or other
  misc_feature (688)..(688): n is a, c, g, or t
tcagcgtagactagcacgaccggtgctcgatttagtagtgtagatttgggtttggggactcaacaaccacatctgtcctctagagaaaaccctgtgagcacagctcctcaccagtggactcggaccgtggaggattcctcttcgttggtgcagcaggctacaagtcgcccaccttccaggtcgcacgtcgtaggtgcaggtcggtcggggtactgggaaggtaggaaagaaccggtccgtcgggggtacccttggtaacggtcggtaaccggttcctccgtaggaccggtacgggtccttaccgtgggttaccttaccgtttaccggtttaccctccgttaagtacggttactaccgttacggtcgggcgtaccggccgtacgggcccgtacggtacgaaccgtaacgaccggtaggaggtacggagtcgggacgtcgggaacccgtaaccgtaacgtacggtacggtcgtaccgacgtacggtttcgtacccttccgaacccgttacggtcccggtaaccggtactaaccggtaacctccttaacgtaccgaccgtaaccgaccttacccgtaacctaaaccgtaacaccgtacgtaaccacgtacgtacggtagttacggacgtaccgccgtaactacgtacgtcgtacgaccggccggtaaccgtccgttaattcgttacgacgngcgacgtcgtaccgtacgtacggtggtaccgcggccggtaccgcggtccggtcgttacgttaccgtcggtccggggtaccggg

SEQ ID NO: 207863 - DNA, 868 bp, Homo sapiens
  misc_feature: GYAE6OF01E09HV.17.25.C03.1.454.CMB.1.raw
  modified_base (763)..(763): a, c, t, g, unknown or other
  misc_feature (763)..(763): n is a, c, g, or t
tcagcgtagactagcacgaccggtgctcgatttagtagtgtagatttgggtttggggactcaacaaccacatctgtcctctagagaaaaccctgtagagcacagcctcctcaccatggactgacctggaggatcctcttcttggtggcacgcagtactacgaagtcgcccactccaggtgcagctggtgcagtcgtgggctggaggtagaacggaacgccgtggggcctcgagtaggaacgtcctccgtagacgtaaggtctttacgtggtacttccgtaaccgttttaaccctaccgttaagttaacgttaacttaccggtaaacgttcgggggtcgtacccggccggaacggtccccggtaggtaccggaacccgtaaccggtaccgtagggtaacgggtcggtaggtacgggggtaagtacccggggtaacccgtaaaacccgtaacggttaccgttagggttcggtaacccgtaacggttaacgttcggtttaaacccttacccggaacccccgttaacgtttacccccggaaccggggttaaaccctaacgttaaacctaaaccgtaacgttacccggaaaccctaacccgtaacccttaccccgtaacgaaaacctaaaccgtacgtaacccgtaccttaaaccggtagtaacgggttagttacgacggtaccctaacgtacgtaccttacgtacgaaccccggtaaccgacccgtaaccggttaccggttacttaaccggttacgtcggtaaccgngtaaaccgggttccaaacccgttaacggtcccggttaccgacggtaccctacccggggaccgacggttacccgggcttttaccgccggttcggtacggggcccgg

SEQ ID NO: 207864 - DNA, 757 bp, Homo sapiens
  misc_feature: GYAE6OF01E2XFE.17.25.C03.1.454.CMB.1.raw
tcagcgtagactagcacgaccggtgctcgatttagtagtgtagatttggggtttggggactcaacaaccacatctgtcctctagagaaaaccctgtgagcacagctcctcaccatggactggacctgggaggatcctcttcttggtggcagcagctacaagtcgcccactcccaggtcgcagctggtgcagtcgtggggctaggagggtagaagaacggccgtgggggcctacgaggtagaagtcctcgtcgcgaacggtcttcgtggtacttactaccgttttacctcctattagtactctaacgtgggtgaccgccacggccgcgtaggaaccacggacctggaaggtcgggagtggggacgtcgggaacccgtaaccctaacgacgttggactaccgactcggttcgttccttccaaccctcgtcccgtaccgggacctacccgtactaaccacgttacgaaccccacgaccctaccccactaactaaacgactaccaccgtacctaggtacgggtagttaacggacgtaaccgtctaacgactaccgttacgacggtaacccggtaacccgacccgggtacccgttatttaaccttaccgggtcgttaccgggacggtaccggttacccggtaaccccgtaaccgggtaccggttacccgggaccggttacccgggtacccgggaacccgttcgggtaaccgggtttccccggtaacggttttcccgtcggtttcccggggtaaccccggggg

SEQ ID NO: 207865 - DNA, 689 bp, Homo sapiens
  misc_feature: GYAE6OF01AZHSZ.17.25.C03.1.454.CMB.1.raw
  modified_base (462)..(462): a, c, t, g, unknown or other
  misc_feature (462)..(462): n is a, c, g, or t
tcagcgtagactagcacgaccggtgctcgatttagtagtgtagatttgggtttgggactcaacaaccacatctgtcctctagagaaaaccctgtgagcacagctccctcaccagtcggacttcggaccgtggaggattccttctttcgttggtcggcgagcagctaacaacgtcgcccactcccgaggtgcagtcgtggtcgcgtgtcgtgggcgtggaggtaggaagacgtcggtgggcctcgagtagtacgtctcgcgacgagtcgtacgtggtacttccgttaaccgttacccgttctaagtacgtatacgtagtcggtcgcgcgacggtccgacgtacggacacgtactggagtggagcggtacgcggaaccgtaaccgagtacgtgtacgactacgtacggtctaccgtacctacccgtacgttcccggaaccgtacgtaaccgtaccggtaaaccngtaacccgtaccgtaacctacccgttacctaaccgtaactaccgaaccttaccgaaccgtacgtacggtacggtacgtagacggctccgactaataccgtagaaccgaccgtacggccctacgttactacgtctagcgtaaggcgtaccgacccgtacggccgttaggaccgtaggtacccgtaggcccgtaacggtcccgtacgttcggttccgtacggggtccgg

SEQ ID NO: 207866 - DNA, 760 bp, Homo sapiens
  misc_feature: GYAE6OF01AJJ7Z.17.25.C03.1.454.CMB.1.raw
tcagcgtagactagcacgaccggtgctcgatttagtagtgtagatttgggtttggggacgtcaacaaccacatctgtcctctagagaaaccctgtgagcacagctcctcaccatcggactggacctggaggatcctcttcttggtgtcagcagctacaagtgcccactcccgagtgcagcgtggtgcagtcgtgggcctggaggtgaagagccgtcgggcctcgaggtgaacggtcctccgtacgcgaacggtccttcgtgggtacttccgtaccggtttaccctaccgttatacgtactactaacgtgggtcgccgccgaggcccgtcgtacggaaccaccggtactggagtaggatcggggatcgggaccgtaaccctacgacgttcgggtctaccacgtacggttcgttcccttacccgaccccgtaacgttcccggtacccgggacctaaccgtacctttaaccgacgttacccgaaccctaacccgtaacccttacccgtaaccctaaacgtaaacccgaaccgacccgttaccgtaacccgtacggttacggttaaggttcggaacggtccgtacgtacggtaccaacgttccgtaccggaccgtaaccgggtacccgtaccggttacgttacttacggtcggacgtacggacgtacccgacccgtccggtacgtccccgggtacggtcccgtacccggttccggaaccggtcccgttcggtttaccttcggtaccggttcggggtacccgggg

SEQ ID NO: 207867 - DNA, 868 bp, Homo sapiens
  misc_feature: GYAE6OF01CTJGJ.17.25.C03.1.454.CMB.1.raw
tcagcgtagactagcacgaccggtgctcgatttagtagtgtagatttgggtttggggactcaaacaaccacatctgtcctctagagaaaaccctgtgagcacagctcctcaccatggactggacctggaggatcctcttcttggtggcagcagactacaagtcgcccacctcccaggtgcagcgtggtgcagtccgtggggctggtaggagaagaacgccgtggggcctacgagtaggaaggtcctccgtgacgacggtccttcgtggtattaccgtaaccgttttacctaccgtaattaacgttatactaacgttgggacgtccggaccgacgggcccgtcgtacgggaacgaaccggtaccgtaggagggtacgggtaagtgggggtaaggtccgggggaaccccgaaaccccgttaacctacggtagggttaccggtaccgtaacggtcgtttacccggttccttaaccccaccccttacccggttcccggtaacccgggtaaccgaacgtttaaccccttaacgaccttacccggaaccctaacccggttaccctaaccccgtacccctaaacctaaaccctaacccgtaccgtaaccccgttaaacgtacggttagggtaacggtttaacgggaaccgggtaccgtaccgtacgtaacccttacgtccggtaaccgacccggtaaccgtaccccgggttcccgtttaattaacccgtttacgggtggtaccgggaaccgtaccggtaacccggtaccccgtaacgggtcccgttaccgggacggtacccgggacccgttaccggggccgtaccggtacccggggtttactttaccgggtacggttttcggggtaccccggggg

SEQ ID NO: 207868 - DNA, 840 bp, Homo sapiens
  misc_feature: GYAE6OF01CNHCQ.17.25.C03.1.454.CMB.1.raw
tcagcgtagactagcacgaccggtgctcgatttagtagtgtagatttgggtttggggactcaacaaccacatctgtcctctagagaaaaccctggtgagcacagctcctcaccatggactggacctggaggatcctctcttggtggcagtcagcctacaagtcgacccactcccaggtgcagctggtgcgtagtcgtggggctaggaggtagaaagaacggtcccggtggggcctacgaaggtcgaacggtcctccgtagacgtaggcttcgtcggtattctaaccggttttaccctacttagtaacggttataccgtaaggttcggggtccgaccgtcccggacggggcccttacggtaccggaaactaacccgggtaaccgttgggacgggttaagggacgggtacggggtaacggttcccggggaaaacccgaaaccccgttaaaaggccggtttacgggtttacgttaacgtaggtttacggttcccgtttaacccgaaccctaccgggttccccgtaacccgggaacccgtaaaggtaacccctttaacccgacgtacccgggtaaccctaaccgggtaacccctttaccccgtaaccgtaaaaccgtaaaccgtaacccgtaacgtacccgtaaactaacgggtacggtaacgtttacggggaacgtacgtacccgttacggaactacgttaaccgtacggaaccgtaccgtaacccggtccgtacgtacgttacgtggtacggtacgacgtcgtacccgtaggtacgtcccgggtagccggtaccgtcggaccgtcggtacccgtacgttggtaccgtgggtacgggtaccgg

SEQ ID NO: 207869 - DNA, 795 bp, Homo sapiens
  misc_feature: GYAE6OF01DLY9E.17.25.C03.1.454.CMB.1.raw
  modified_base (228)..(228): a, c, t, g, unknown or other
  misc_feature (228)..(228): n is a, c, g, or t
  modified_base (285)..(285): a, c, t, g, unknown or other
  misc_feature (285)..(285): n is a, c, g, or t
  modified_base (361)..(361): a, c, t, g, unknown or other
  misc_feature (361)..(361): n is a, c, g, or t
  modified_base (671)..(671): a, c, t, g, unknown or other
  misc_feature (671)..(671): n is a, c, g, or t
tcagcgtagactagcacgaccggtgctcgatttagtagtgtagatttgggtttggggactcaaacaaccacatctgtcctctagacgaaaaccctgtgagcacagctcctcacatggactcggacctggaggtactcctcttcgttgggtgacaggcagcctaacgaacggtcgcccctacctcccgagggtcgcctagtcggtgggtacgacgtggtccggtggggngtggaagggtaggaaggacggtccggtacgggcctagtaggtaggtacggtcctcgngacgagtctacgtgtacttccgtacctttcctactagtacgtactacgtacggtgggtacgccgaccggccggacncgtacggacctaacgtcgaggtaggacggtaggagggtacggtaccgggaaccctaaccctaggtaccggtggactactaacgtacgtttccgtccctaccaaccctcggtacccggacgtacgtaaccggttaaccttacgacgacccgtaacctaacccgtaaccctaccgtaacctaaacgaacctaccaaacctaaccgtacgtaaggttacggtaacggttacgggaaccgtacggtaccgtaacggtactacgtacgtaccggaacggtacccggttacgtaccgttacgtttacgtaacggtnacggtaaccggaccgtaccggtaccggtaacggtccggtaccgggacgggtccgtacccgggccggacgggtacccggttaccggttaccggtttccggtaccgggtttccgggaacccggggg

SEQ ID NO: 207870 - DNA, 835 bp, Homo sapiens
  misc_feature: GYAE6OF01AFVM8.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctgggaggactccttcttcgttgggtggcagcagctacaagtcgccccactcccgaggtgccgaggccgtgggtcgcgtggtccggtgggggctagggaagggtaggaaacggaacggtcccggtgggggtaccctggaaggttcggaacggtcctccgtagccgtaacggtctttcgtaggtacttccgttaaccgtttaccctctacgtattactacgtaacggtggtccgccgcggacggccgcgttacgggaccaacggtacctaggtgggtacggaggtacgggacgtccggggaaccctaacccgtaagtccggtaagggtccgtaacgaccggtacgttcgttcccctacccacccgtaccgttaccccggtaccggggtaaccgtaacgttaaccccttccgaacggttaaccccggtaaaccacccggttaaccctaccctaaaccctaaacgaaaccctacccaacccggttacctaaccgtagttacggggtaaccgttagggacgacccggtacgtacggaacttcgtaaccggtacggaaacccgtccgggtacccggttccttaaacgttcttaacggtcggtaggaccgtaccggtaccgacccgttaccggaccgttccggggaccgtcggaccccggttaacggtcgacccgggttccgttaaccgggttcgttcccgggttacggggcccgggg

SEQ ID NO: 207871 - DNA, 1009 bp, Homo sapiens
  misc_feature: GYAE6OF01BEHKZ.17.25.C03.1.454.CMB.1.raw
  modified_base (189)..(189): a, c, t, g, unknown or other
  misc_feature (189)..(189): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactctcttcgttggtggcagcagctacaagtgcccactcccaggtcgcagcgtgggtcncgacgttcggtcgggggtctagggtaggtaggaaacggaaccggtccggtgggggtaccctcggaggttaggaacggttccgtccgtacggacgaacgggttcttacgtaggtacttaccgttaaccggttttaccctacgttaacgtacttacgtaccgtaacggttcgggtacgcccggacccggaggtccccgaaggttacgggaacccgtaaaccgtccggttaggtaaccgggttacggtaacgggttcggggtaaccggtttacccgggggaacccctaaaccccggttaaacgacgggttttacgggtaccggttaaccgtaacccggtttacggttacccgggttacccttaacccgtaaccccggtacctttaccccggggtacccggggtaaaaccgtaccgtttaaaccgttaacccgaaccggttaacgtaaccccgttaacccgtaaacccttccccgttaaaccaaacccgtaaaacctcccgggtaaacctacccgtaaacggttaccggggttacgtaaagggtttaccttaaggggtacccgtacccggtacccgttaaacgtaccccggttagttaaccccggttaacggtaacccggtaccccggtacccgggttttaccgttaaaccctttacgggtttaccacccggggttcgggtaacccgttacgggttaaccccgttaccccggaaccggttaccccggttacccgggtcgtaaacccggggttcccccggtaagggtaccccggtacccggttaccggttttacccgggttcccggttacccgggtacccggggg

SEQ ID NO: 207872 - DNA, 777 bp, Homo sapiens
  misc_feature: GYAE6OF01AT22S.17.25.C03.1.454.CMB.1.raw
tcagcgtagactagcacgaccggtgctcgatttagtagtgtagatttgggtttggggactcaacaaccacatctgtcctctagagaaaccctgtgagcacagctcctcaccatggactggacctggaggtactcccttcttcttgggtggcagcagctacaacgtcgcccactccgaggtgcagctggtgcaggtcgtgggctggaggtgaacgacgcgtcggggcctcgaggtagtaacgggtctaccgtagactaacggtcctttacgtagggtacctttacggtaaccgtttttaccctacgttaacgttacggttactaccgtaacgttcggggttacgcccggtaccgaacgggtccccgtggttaaccggaaccgtaaccggtacccgttagggaccggttagggtacggttagggtacgggtacgggtaccccgtaaaaccctaaccggtcggttacgggtactaacccggagttaacgtttcccgggtacctttaccgaccccggtaacgttcccgggtaccggaactaccggttaaccttacgaacgtaccgaccgtaactaccgttacccaacgaaacgttaaccacgtacgtactacgacgttggaagttacggagcgtacacggaactaccgtgaaccgaaccgtcgtaccggtccttacgtacttacgcgtaggaccggacgccgtacgaaccggttgaccggttacgaccttacccggatccgggaacgttcccggttacgcggttcccgttcgggacccggg

SEQ ID NO: 207873 - DNA, 836 bp, Homo sapiens
  misc_feature: GYAE6OF01CSDRR.17.25.C03.1.454.CMB.1.raw
  modified_base (184)..(184): a, c, t, g, unknown or other
  misc_feature (184)..(184): n is a, c, g, or t
  modified_base (196)..(196): a, c, t, g, unknown or other
  misc_feature (196)..(196): n is a, c, g, or t
tcagcgtagactagcacgaccggtgctcgatttagtagtgtagatttgggtttggggactcaacaaccacatctgtcctctagagaaaaccctgtgagcacagctcctcaccagtggactggacctggaggtactccttcttcgttggtggcaggcagctaacgaagtcgcccactcccaggtncagtctggtgcngtcgtgggctaggaggtagaacgagccggtgggccttgaggtagaacggttcctaccgtgaccgtaggtcttcgtaggtacttaccgttacgttttacctctaagttacgtacttaccgtaacggtgggtaccgccgtaccggacggtcccggtacgtaccggaaaccgtaccggtaccgttaggacggttaggaggttcgggacgttaccggggaacctaaaccccgtagtaccggttcgggtacgacgtacgtaggttcttccgtaccaaccccgttacgtcccgtaacgggtacctacgtaaccctttacgacgtaccgtaaccgaaccgtaacctaccctaactaactaaccacgtacgtacctaaccgtaggttacgggtacgttacggacggtacgttacccgtcgtaaccgtacgttccgaaacggaaccccggtaccgggtaaccggtccccgtttaacgttacggtttaaccgtcggggttaaccggtacgggtaaacccggtacccggtaacccggttaacgtaccgggttacccgggtaaccggtaacccgggtaccccggtaccgggtcggtaacccgggtttcccgtttaccggtttaccgggtaccggttccggggtaacccgggg

SEQ ID NO: 207874 - DNA, 664 bp, Homo sapiens
  misc_feature: GYAE6OF01EW5WR.17.25.C03.1.454.CMB.1.raw
  modified_base (273)..(273): a, c, t, g, unknown or other
  misc_feature (273)..(273): n is a, c, g, or t
  modified_base (300)..(300): a, c, t, g, unknown or other
  misc_feature (300)..(300): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagccgtgggcctcagtgaaggtctccgtgacaaggtcttctggtattcacgtttacctctatacgtancctaacgtgggtcgccgaccaggccgngtcggacaacgacctggtacgtggagtagggagtcgggaccaaacccgtaacgcgtggtcgtacgacgtagttcgtaccttaccgaacctacgtcccgtacggactaacggtactaccgacgtcgaaccgtaccgtaacctcccgtaccaaacgtaaaccaacgaccgacctactaaggtagggtagttacggaaggtccgtacccgtagaacctatcgtaacggaccgaccggtaccgggtaccgttacttacgttacagggttcgacggtaacgtccgacccgtaaggtccgtacgggtcggtaccggtcccgtaacggccgtaccggtccggttacctttcggaccgttcgggtaccgggg

SEQ ID NO: 207875 - DNA, 730 bp, Homo sapiens
  misc_feature: GYAE6OF01CAFKN.17.25.C03.1.454.CMB.1.raw
  modified_base (560)..(560): a, c, t, g, unknown or other
  misc_feature (560)..(560): n is a, c, g, or t
  modified_base (587)..(587): a, c, t, g, unknown or other
  misc_feature (587)..(587): n is a, c, g, or t
  modified_base (686)..(686): a, c, t, g, unknown or other
  misc_feature (686)..(686): n is a, c, g, or t
tcagcgtagactagcacgaccggtgctcgatttagtagtgtagatttgggtttggggactcaacaaccacatctgtcctctagagaaaaccctgtgagcacagctccctcaccagtggtactggacctgggaggactccttctttcgttggtggcagcgagctacgaagtcgcccacctccgaggtcgcagtctggtgctagtcgtggggctaggaggtagaaggaacgtccggtgggtcctaggacggtaaggacgttcctccgtacgtacgtaccggtccgtttcggtaggttactttaccgttacctttacccgtattaacgtattacttaaccgaggttcgggtcgccgaccggtacgcccggtagtaccggaaccgtacgacggtgaggtaggaggtcgggaaggtcccggtaaacccaaacccgttacgacggtttcggtacgtaaccgtcggtacgttccgtccttaacccgaccccgtacggtccccgtaacggactaacgtaccgtacaacgtccaacccgaacctaccaccctacaactaacacactacnctagtagtagtacgagtcgacgactanaccttgccgaccgtaccgtccgtacgttaccttagtcgtacggtcgaccggtactacccgggtaccgacgggtaccgtacggtaccgtcggtacccggnggttacccggcgttccggttcttcgggtccgtgggtacccgggg

SEQ ID NO: 207876 - DNA, 815 bp, Homo sapiens
  misc_feature: GYAE6OF01E5ZKS.17.25.C03.1.454.CMB.1.raw
  modified_base (263)..(263): a, c, t, g, unknown or other
  misc_feature (263)..(263): n is a, c, g, or t
tcagcgtagactagcacgaccggtgctcgatttagtagtgtagatttgggtttggggactcaacaaccacatctgtcctctagagaaaaccctgtgagcacagctcctcaccatcggactcggacctggaggacttccctctttcgttgggtggcagcagtctaacaacgtcgacccactcccgaggtcgcagtcgtggtcgctagtcggtgggtctggaggtaggaacgacggccggtcgggcctgtagtacggacgttccncgtagacgtacggtcttcgtagttacttaccgttaaccgtttacctacttagttactacgtacgtacggttcgggaccgaccggaccggaccggtccgtaccggtaacgaaccgtaaccgtacggtagggtagggtaggtacggtacgggtaccggtacccgggtaacccttaaacccggtacgttaccggtacggtaccgtaaccgtacgtacggtttacccgttacccgtacccgtacccggttacggttacccggtaaccggaacttaaccgttaaccctacgtaacgaccgtaacccttaccgaacccttacctaaccaaactaacccgacgttaacctacgtaacgtaggtacggtagtaccggaaccgtacgtacgtaacgtactacgtacgccggtaaccggtacccgtacgtacctttacgttacgtcgtacggccggtaacgtcggtacccgtacgtaccggtaccggtaccgaaccggtcgacccggtcggtacccggtaccggttacccggtttacgttacgggtcccggtacgggaccgg

SEQ ID NO: 207877 - DNA, 763 bp, Homo sapiens
  misc_feature: GYAE6OF01EMMTJ.17.25.C03.1.454.CMB.1.raw
  modified_base (165)..(165): a, c, t, g, unknown or other
  misc_feature (165)..(165): n is a, c, g, or t
  modified_base (185)..(185): a, c, t, g, unknown or other
  misc_feature (185)..(185): n is a, c, g, or t
  modified_base (203)..(203): a, c, t, g, unknown or other
  misc_feature (203)..(203): n is a, c, g, or t
  modified_base (282)..(282): a, c, t, g, unknown or other
  misc_feature (282)..(282): n is a, c, g, or t
tcagcgtagactagcacgaccggtgctcgatttagtagtgtagattttgggtttgggagtcagtctcagtcaggacacagcatggacatgagggtccccgctcagctcctggggctcctgctactctggctcgagctgccagatgtgacatccagatcgaacccngtcctcactcctcctgtctncctcgtggtggggtcagntacactatcacttgaccgacaacgtctacggtacgtttaaaaactattttaaactgtatcagcaagaacctaggaaacncccgaagtaccctccgtagtacttccgtcgtaggtcgcgtacttccgaccgttcctacgggaacgtacgggtacggttccccgaccttaacggttacgttacgggttacgtaagggtcggtacggtaagggttacgtacgttacggtacgggtaaaccgttaagttactttaacgtaacctttacccgtaacccgtaccttaaccctacccgtaacccgtaaccctacgttaccgtaacccctaaacgggttaggtacggttaacggttcgttacggaaccttaacgtacccttaacgttacgttaacggtaacaaacgttacgttaacgttaccgttacccgttaccctaccgttacgttaaccgttccgggaaccgtacgggtaaaccttacgggtaactaaccggtacgtaaaccggtaaacggtaccgtcggtacggttccgtacgtaccctacgttacttcgttaaccgtttaccg

SEQ ID NO: 207878 - DNA, 818 bp, Homo sapiens
  misc_feature: GYAE6OF01D3A5I.17.25.C03.1.454.CMB.1.raw
  modified_base (181)..(181): a, c, t, g, unknown or other
  misc_feature (181)..(181): n is a, c, g, or t
tcagcgtagactagcacgaccggtgctcgatttagtagtgtagatttgggtttggggactcaacaaccacatctgtcctctagagaaaaccctgtgagcacagtctcctcaccatggactggacctggaggactcctcttcgttggtggcagcagctaacaagtcgcccactcccgaggtncagtctggtagctaggtcgtgggctaggaggtaggaacgtacggccggtcgggcctagaggtgtacgtcctcgtgacgagtcttgtgtactttcctaccgtttacctactaatacgttactacgtaacggttgggcgaccggtccgaccgggtaccgtacggtaaccggacctaaaaccggtccgtggaacggtgggtacggttcgggaaggtaccgggaacccctaaaaccgttaaccggtggttcggggtactaccgtaccggttagttacccggttccctacccggtaccctaccggttaccccggtaacggacgtaaccgtacccttacgacgtacccaccgaaccctacctacctaaccaataacccacgtaccgtacttaaggacggttaggtaggtaacgggcgtacccgtacgttacgaacctacgttacaccgggtaacgtacccggtacccgtacgtttacgtttaacgtcccggaggttccggaaccggtaacgtacccgggtaccgtaaccgggtccggtttaaccggggcgttaaaccccggcccgggttaaccggtacccgggtaccggtttaaccgttcccgggtttttaaccgggtcccggtttccggggaacccgggggg

SEQ ID NO: 207879 - DNA, 682 bp, Homo sapiens
  misc_feature: GYAE6OF01DYDGN.17.25.C03.1.454.CMB.1.raw
  modified_base (309)..(309): a, c, t, g, unknown or other
  misc_feature (309)..(309): n is a, c, g, or t
  modified_base (547)..(547): a, c, t, g, unknown or other
  misc_feature (547)..(547): n is a, c, g, or t
  modified_base (602)..(602): a, c, t, g, unknown or other
  misc_feature (602)..(602): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggagatcctcttcttggtgcagcagctacaagtcgcccactcccgaggtgcagctggtgcagtcgtgggctggaggtgaagacgccgtgggcctgagtgacgtctccgtgacgtaagtcttcgtaggtactttccgtaccgttttacctaccgttaagttacgtacttacgaacggtgggtacnccgacgacggtccgtgtacggaaccgaaccgtacgtaggtaggtcggaaggtcgggtaacgtaccgggaaccctaaacccgtacgtaccgtgggtactaccgaacgttcgttacgttaccttacccacccgtacgtcccgtacgggactacgtaaccttaaccagtacgaacctaactaccctacctaacgaaactaacactacgactaacaaggtcgtaagtagacgcgctagactntcgacgaaccgcgtaccgtctattacgtcgttgtacgacgtacgtaccgtacccncggttaccggacgtaggtacccgtaccggtaccgaacggccggtttacccggttattaccggtcgttcccggggaacggg

SEQ ID NO: 207880 - DNA, 831 bp, Homo sapiens
  misc_feature: GYAE6OF01CRSY1.17.25.C03.1.454.CMB.1.raw
  modified_base (155)..(155): a, c, t, g, unknown or other
  misc_feature (155)..(155): n is a, c, g, or t
  modified_base (729)..(729): a, c, t, g, unknown or other
  misc_feature (729)..(729): n is a, c, g, or t
tcagcgtagactagcacgaccggtgctcgatttagtagtgtagatttgggtttggggactcaaacaaccacatctgtcctctagagaaaaccctgtgagcacagctcctcaccatggactggacctgggaggatccttcttcgttgggtcggacnggcagtacctaacaagtcgcccctaacctcccgaagggtcgcgagcgtcggtgccgtaggtcggtgggctgggaggtaggaacggaacgtccggtcggggacccttcggaaggtcgggtaaggttcctcccgttagggaccgtaacggtccgtttacggttaggtacttttacccgtaacccgttttaccgtaaccttaagttaaggtaaccttaccgaaccggttggggccggtacccggcccggaaccgggccggtacggaccggggaaacctaacccgggtaaccggttaggtacgggtagggtacggttgggggtaacggttacggggaaaccctaaccgtaaaccgtcggtacggtacctacgtaacgttacgttccgtaccttccaacccgtcgtacccggtaccgggaactaccgtaacccgttaaccgtcgtaccgtaaccccgtaaccgtaacccttacccgtaaccgtaaccaaacctaccgaccgtacctaaccgtagtacggtaggttacgacgggtcgaccgtacgactacgtcgacgtaccgaccggtacgtcctacgtntaccggtagcggacgtacgtaccgtacgaccggtacggttcggtacgaccggttacggacgacgtccggtaccggttccttacggtccgtcggggtaccggg

SEQ ID NO: 207881 - DNA, 852 bp, Homo sapiens
  misc_feature: GYAE6OF01AY6NG.17.25.C03.1.454.CMB.1.raw
  modified_base (185)..(185): a, c, t, g, unknown or other
  misc_feature (185)..(185): n is a, c, g, or t
tcagcgtagactagcacgaccggtgctcgatttagtagtgtagatttgggtttgggactcaacaaccacatctgtcctcgtagacgaaaacccgtgtgagcacagctcctcaccagtggactggacctgggaggactcctctttcgttggtggcagcagctacgaagtcgcccactccgaggtcncgagcgtggtgacgtaggtcggtcgggctggaggtagaaggacgtccggtgggtcctcgaggtaggaacgttcctcgtgacgtacggtcgtttacgtggtacttccgttaccgtttaccttacgttagtacgttactaccgtaacggtcgggtaccgccggaccgtacggtccgaccgtacgggaaccgtaaccgtaccgtacggtaggtacgggacggtaggggacggtaaccgggtacccgtaaaaccgtaaccgtccggttacggtacgtacccgtaggttaccgttcgttaccctacccgtaaccccggttccgtacccggtaaccggggtaactaccgggttaaccctttaccgaacggtaaccaaacccgtaacccgtaaccccgttacccctaaacctaaaccgaaacccgtaaccgaccgttaaccccgtaagttacgggttacgggtaccgggtacggtacggtcccgtacgtacgtactaaccgttacgaaccgaccggtaccggtacgtaccgttacttacgttacgtacgggaactcgggaaccgtccggtaacccgtacggtcccgggttacggtaccgggacccgtaccgggtcccgggtacgtaccgggttacccgtttaccggttacggttccgggtccggggtaccgggg

SEQ ID NO: 207882 - DNA, 823 bp, Homo sapiens
  misc_feature: GYAE6OF01BG5WA.17.25.C03.1.454.CMB.1.raw
  modified_base (195)..(195): a, c, t, g, unknown or other
  misc_feature (195)..(195): n is a, c, g, or t
  modified_base (460)..(460): a, c, t, g, unknown or other
  misc_feature (460)..(460): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggagacttcctctttcgttgggtggcagcagctaacaagtcgcccactcccgaggtagccagtcgtggtnctagtcgtgggacttggaggtagaaaggacgtcccggtacggggcctacgaggtggaacgttcctccgtaggacggaagtcgtttacgtagtactttaccgtaaccgttttccctacgttaacttaggttactacgtaacgttgggacgccgacgcggtaccgtgaacgggaccaaacgtccgtagggtcgagggtaacgttggggaacggttaccgggaacgtaaaacccccttaaggcggttacgggtaaccgtcgtaaacgnggtttacccgttacctacccaccccgttacgtacccggtaaccggggaccaaacgttttacccctacgacgtaccgtaaacccgtaacctaacctcccgttaaaccaaactaaaccgaaccctaccggttaacctaacggtaacgtaggtaacggttgaacgggttaactcccgaaggtaaccgtacttaacggacggacccgtaacccgtacggggttcccttaagtttaaccttcgaacgggtcgtaccgaacgggtaccacccggtcggtaaacgtcccggggtatacccgggtcccggttaaggcccgttaagggtcccccggtttttaagtcccgtttcgggccggggtaacccgggg

SEQ ID NO: 207883 - DNA, 805 bp, Homo sapiens
  misc_feature: GYAE6OF01DRO70.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggagatcctcttcttggtggcagcagctacaagtcgacccactcccgaggtgcagcgtggtgcagtcgtgggctgagggtaggaagacgccgtaggggcccttgaggtagaacggttcctccgtgacgtaaggcttcgtggtattcctaccgtttacctccttatagtactacgaagttgggcgcgaccgacgggtccgtccggtacggaaaccgaaccgtaccggtaggtaggtacggagttacggggacgttacggggaacccgtaaaaccccgtaacgtacgggttcggtacgtaccgtaacgtacggttccgtacttacccgacccttaccgtacccggtaccggggaactaaccgtaaccttaccgacgtaccgtaaccgtaacccgtaaccctacccttaaacccaaacgttaaacccgaacgtaccggaacccttaaaggtacggttaacgggttacgtacggaacgggtaccgtaccggtacgtactacgttacgaccggtaccgtaacccggtaccggttccctacgtttacgttaacgtggtaccgtaacgggtacgtacccggtacccgtaacgggtaccggtacccggggttagtacccggttacccggacggtaccggtccggtacccggtttaccgttcggttaaccgttcgggggtaacccgggg

SEQ ID NO: 207884 - DNA, 765 bp, Homo sapiens
  misc_feature: GYAE6OF01EYMMA.17.25.C03.1.454.CMB.1.raw
  modified_base (172)..(172): a, c, t, g, unknown or other
  misc_feature (172)..(172): n is a, c, g, or t
tcagcgtagactagcacgaccggtgctcgatttagtagtgtagatttgggtttgggggagtcagtctcagtcaggacacagcatggacatgagggtcccccgctcagctccgtggggctcctgctactctggctccgagctgccaggtatgtgactactccagatcgacccngttacctccacttcccttccctcgttcctcgtccgtcgttagggtcgggggcagtacgtcctactactctacgttacggaccggtacgaacgtaccggaaccgggttaacctttaaaacctttaagttttaaacgttggtaacgttaccaacggaaccgttaaacggaaaaccggttaaggaaaacccgccccgtaacgtaccccgttaccttaggtaccgttccgtaccggttcgggttaccaccgtacttcccggtaacctacgggtaccgtacggtacggtacgggtccctaccgtaggtaccggtcggttacgaggtcggtacgacggttcggtacgttacggacggtaaacgttcgtaacgtttaacctactacccgtactaacccgtactaacctaaccctacgtacctacgaacgtaccgtagtacgttacgtctctaactacgttactacctacgtactacaacgtaacgtacctaccgtccgtaccgtaccgttacgtcgtaccggaacggtacggtaacgtagtaacgaagtacgtaaagtaacgtcgtacgacgcgtacgtctaaccgttgtactcggtacc

SEQ ID NO: 207885 - DNA, 648 bp, Homo sapiens
  misc_feature: GYAE6OF01CPA5P.17.25.C03.1.454.CMB.1.raw
  modified_base (222)..(222): a, c, t, g, unknown or other
  misc_feature (222)..(222): n is a, c, g, or t
  modified_base (438)..(438): a, c, t, g, unknown or other
  misc_feature (438)..(438): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctcgcctctggtgggggtcagagtcaccatcacttgccgganaagtcacggactaaaactattaaatgtatcagcaagaaacgtaggaaaacgcccaagaccctcctgactctcgtggtcgcatcccatcctgacgtaagtcggcctccaagtcgtacggtttgacgtggtacgaggttggaatccgtagggaacagtatttacaacttctaccacctaacgtcaacctactactcgaccctaaacgttgaacgggtntttacgcgtactaaacttccttaaacttcgtacgtaacctaacgaagttaaccgttaacgtacccgttaccccgtcgacgtttacccgtttacgggacccgtaaacgggtaaccctaaaggttcgaaacgttaacgaacccgtaaaaacgttaccgtacgggttagacccgttacggtaacctaacccttacgtttcgtagttttacccc

SEQ ID NO: 207886 - DNA, 766 bp, Homo sapiens
  misc_feature: GYAE6OF01EAGGE.17.25.C03.1.454.CMB.1.raw
  modified_base (189)..(189): a, c, t, g, unknown or other
  misc_feature (189)..(189): n is a, c, g, or t
  modified_base (203)..(203): a, c, t, g, unknown or other
  misc_feature (203)..(203): n is a, c, g, or t
  modified_base (217)..(217): a, c, t, g, unknown or other
  misc_feature (217)..(217): n is a, c, g, or t
  modified_base (277)..(277): a, c, t, g, unknown or other
  misc_feature (277)..(277): n is a, c, g, or t
  modified_base (322)..(322): a, c, t, g, unknown or other
  misc_feature (322)..(322): n is a, c, g, or t
  modified_base (518)..(518): a, c, t, g, unknown or other
  misc_feature (518)..(518): n is a, c, g, or t
  modified_base (558)..(558): a, c, t, g, unknown or other
  misc_feature (558)..(558): n is a, c, g, or t
tcagcgtagactagcacgaccggtgctcgatttagtagtgtagatttgggtttggggactcaacaaccacatctgtcctctagagaaaaccctgtgagcacagctcctcaccagtggactggacctggaggactccgtctttcgttgggtggctagcagactaacgaagtcgcccacctcccgaggtcncgaggtcgtggtgntaggtcgtcggggntggaggtaggaacgaggtccgtggggccagagtagaggtcctcgagacgaggtcttacgngtacttccgtacgttacctctaatagtaactacgacgttgggacnccgtacgccggacgctacggaaccgaacggtctaggtaggtaggtacggaggtacggacggaacccgtaaaccgtaaacgtcgtacggtcgtaactacggtagttccgttactaccgtaccccgacgttacccggacgggtaccacgtaccgttaacgctacggaacccacgtaaccgtcctaactaactaaaccncgacgaccaagaccgtagtagtaggcgtactacgtacganacgttcgacgtaaccacggtaacccgttaccgtttaacgtaacgtttacccggtagggtccgtaacgggtaccggttaccccgaacccgggttaagttaaaccccgggtggtttaaacccccgggaacggttaaccccggtaaccgtcccgtaacgggttcccgtttaaccccggtttagggtcccgggttacccggggtaaccgggg

SEQ ID NO: 207887 - DNA, 786 bp, Homo sapiens
  misc_feature: GYAE6OF01CX8DF.17.25.C03.1.454.CMB.1.raw
  modified_base (369)..(369): a, c, t, g, unknown or other
  misc_feature (369)..(369): n is a, c, g, or t
  modified_base (386)..(386): a, c, t, g, unknown or other
  misc_feature (386)..(386): n is a, c, g, or t
  modified_base (708)..(708): a, c, t, g, unknown or other
  misc_feature (708)..(708): n is a, c, g, or t
  modified_base (739)..(739): a, c, t, g, unknown or other
  misc_feature (739)..(739): n is a, c, g, or t
tcagcgtagactagcacgaccggtgctcgatttagtagtgtagatttgggtttgggagtcagtctcagtcaggacacagcatggacatgaggtcccgctcagctccgtgggctcctgctactctggctccggagctgccagtatggtgacagtaccgagtactcgacctgtcctaccactccctcctgtcctcgtcctacggtcgggtggggtacaggtacgtccgaacctactaccgtagtccggaccggaacgtaacggtaccggtacggttaaaccgtttaaacctttaagtttaaacggtttaggttactacggaacgtaccgaacgtaaaaccggtaggaaaaccgtcccaacgtacctcgtanctacgtcgtggactacncgtacacgtactacgggtacgacgggttaccgccgtacctacggtacggttacggtgacgggtacgtacgtaggtacggtacgtcggtacggtaacgtaacgtttaacgtactaacgtccgtaaccctaacgtaccctaacggtaccccttcgtaccgtacggtaaccccctaagggtacggtaacggtcgtttacgggaacctacggttaacctacctacgttacccggttataaaccgtacgtaacggttaccttaaccgtacccgtttaccgctacccggtttaacggtccgggaacggtacggtaaccctagggtaanaccggttaacgaacccgttaaaccgggtttncggttaaccgacgtacccggactacgtttaacgtcgttacttacccg

SEQ ID NO: 207888 - DNA, 758 bp, Homo sapiens
  misc_feature: GYAE6OF01ANYU7.17.25.C03.1.454.CMB.1.raw
  modified_base (531)..(531): a, c, t, g, unknown or other
  misc_feature (531)..(531): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctgggaggatcctcttcttggtggcagcagctacaagtcgcccactcccaggtgccagcgtggtgctaggtcgtggggctggaggtagaagagccgtcgggcctcgagtgacggtctccgtgacgacggtcgttcgtggtactttcctacccgttttaccctcgtaattacgttactaccgtaacggttggggtccgtcccggaccgacgggtccccgtggtaccgggaaccctaaccggaccgttaggacggtacggggaggtaggggtaccgtacggggtaacccctaaacccgacgtacggttcgggtctaccgtacgtacggttctccttaccaccccgtacggtcccgtaccggacacgttacctaccagtaccgaaccactacctacccgactaacgtaacnctacgactacgagtggagttaggacgtacgtacctacgatacgtcgtacgacggaccgtaccggtaccgttcttacgttaacgtcgtcggaaccgtacgggtaccctcccggtacggtacccggttcccggtaacccggcggtacccccggttaacgggacccgggtaccggggtttaccccgtttccggtttaaaccgggtccggtttcccggggtacccgggggg

SEQ ID NO: 207889 - DNA, 715 bp, Homo sapiens
  misc_feature: GYAE6OF01A0MBF.17.25.C03.1.454.CMB.1.raw
  modified_base (668)..(668): a, c, t, g, unknown or other
  misc_feature (668)..(668): n is a, c, g, or t
tcagcgtagactagcacgaccggtgctcgatttagtagtgtagatttgggtttggggactcaacaaccacatctgtcctctagagaaaaccctgtgagcacagctcctcaccagtggactggacctggaggactcctcttcttggtggcagcagcctaacaagtcgcccactcccgaggtgcagcgtggtgcagtcgtggggctggaggtagaaagaggccgtggggcctcgagtaggaacggtctcctgacgaaggtccttgtggtacttctaccgtttactcctagtagtatacaagtggtcgtccggcgacggccgcgtcggaaccaaccgccgtaggacggtggagttgggaagtccggggaacgtaaaccccgtaacgtcgtagggttcgtacgaacgtagttcttacctacctaaccccgtacctccccggtaccgggaacacgttaacccttaaccgacgtaacccgaaccgtaccgtaaccctcccgttaacccaaagttaaacccacgtaaccgtaccttaaacgaacgttagggtaacggttacggacgtaacggccctgaaccttacgtcgtaaccggacgaacccgtaccgggtccgttacttaacgttaccgtgtacgaccggtacgtaaccgtacccgacgtacgtccgggtanaccgtaccgacgtcgcgtacccggttcttacgccgttggtaccgggg

SEQ ID NO: 207890 - DNA, 899 bp, Homo sapiens
  misc_feature: GYAE6OF01D80SG.17.25.C03.1.454.CMB.1.raw
  modified_base (104)..(104): a, c, t, g, unknown or other
  misc_feature (104)..(104): n is a, c, g, or t
  modified_base (230)..(230): a, c, t, g, unknown or other
  misc_feature (230)..(230): n is a, c, g, or t
tcagcgtagactagcacgaccggtgctcgatttagtagtgtagatttggggtttgggggagtcagtctcagtcaggacacagcatggacatggagggtcccccntcagcctccgtggggccttcctgcctactctggcctccgagctggacctagattgtgacatccagtatcgaccctagtcctaccaccttccctccgtcgtctcgttccgtggtacggggtcggacncgtactaccacctactcgtacgtacggaccgtaaccgtacggtaccggtaaaccgttaaaaccttttaaacgtttaagtttaaacgttcgtaactacggacgtaaaccgtaaaaccggtaaccggaaaccggtaaaccccacccgtaaccttaccgtacgtacttccgtcgtcggttagtacgtaccttaccgtacctttcggtagacggtacgttacggaccccggttactaccgttagttacgggtagttacggtacggtcggaagtttcgggtagttccggttaacgggaacgttacttttaaacggtacctttaaccgaacctttacccgaacccttaccgttaaccgtaaccccgtttacccgttaacccgtaccgttaacccggttaaaccgttaaccgggtaacgggtttacgtttacgggtttaacgttaccgttaaacttacccgtttaaaccgttacgttaacccgttacgtaaccgtaacgttaactttacccggttaaccgtttaccccgtttaccgtaccgttacgtttaaccgggtcccggtaaaggtaccggttaaagtaagtaccggtaacgttaaacgtaaaccgttaacgggtacgtacggtaccggacgttacccgtaacttaccggtttacttccgtttccgttacccg

SEQ ID NO: 207891 - DNA, 730 bp, Homo sapiens
  misc_feature: GYAE6OF01EV6QI.17.25.C03.1.454.CMB.1.raw
  modified_base (177)..(177): a, c, t, g, unknown or other
  misc_feature (177)..(177): n is a, c, g, or t
  modified_base (230)..(230): a, c, t, g, unknown or other
  misc_feature (230)..(230): n is a, c, g, or t
  modified_base (693)..(693): a, c, t, g, unknown or other
  misc_feature (693)..(693): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtcgcccactccgaggtncagctggtgctaggtcgtggggctaggaggtggaaagacgtccggtgggcctnaggtcgaaggttcctccgtagacgaacggtctttcggtaggtactttaccgtaaccgttttacctccttaagtagttactacgtaacgttggggtgcccggacgacgggtcccgtcgtagggaacctaaccggtaccgtggtaaggtggaggttagggaacgtcggggaaccctaaaccgtacgcggttcgggtacctacggtaaacgtggttaccgtacccttacgaaccccgttacggtccggttaaccccggggaataccggttaaccctttaacgacgtacccggtaaccgtaaacccgttaccttaacccgactaaactaacaacgtaccgaccttaagacggttgggtagttacgggacggtatccggactactacgtgaaccggaacgtaccggtaccggttaccttacttagctacgggccgtagaaccgttccacccgagtcggtcgacgtacncgtcgactacggttcctagtcgtacgtccgtacgggg

SEQ ID NO: 207892 - DNA, 682 bp, Homo sapiens
  misc_feature: GYAE6OF01A5UJI.17.25.C03.1.454.CMB.1.raw
  modified_base (327)..(327): a, c, t, g, unknown or other
  misc_feature (327)..(327): n is a, c, g, or t
  modified_base (548)..(548): a, c, t, g, unknown or other
  misc_feature (548)..(548): n is a, c, g, or t
tcagcgtagactagcacgaccggtgctcgatttagtagtgtagatttgggtttggggactcaacaaccacatctgtcctctagagaaaaccctgtgagacacagctcctcaccatggactggacctggaggatcctcttcttggtggcagcagctacaagtcgacccactcccaggtgcaggcgtgggtacgctggttccgtggggctaggaggtagaagacggccgtcggggccttgacggtacggaacggtctcctggcgtaaggtcttcgtggtacttacctaccgtttacctacgttatacgtataccgtaacgtggggtacnccgaccgtaggcccgtacgtcggaaccaaccggtaccgttggagtgggtacgtagggtacgtacggggaccctaacccgtaacgtcggtacggttgaccgtagtcgttcgtccgttacacccgtacgtcccgtaccgggactacgtacttaccgataccgaaccacgtacctccacaactaacactactactacatacggtacgtacggacgtactccganacgtactcgaccgaacaccgtaccgtcgttacttacgtacgtacggcgacgtacgtacctaccggtacgccggtcggacgtcccgaacgtcggaccgtacgtcggttacccttcggtaccgtcgggtacccggg

SEQ ID NO: 207893 - DNA, 650 bp, Homo sapiens
  misc_feature: GYAE6OF01BICXM.17.25.C03.1.454.CMB.1.raw
  modified_base (315)..(315): a, c, t, g, unknown or other
  misc_feature (315)..(315): n is a, c, g, or t
  modified_base (382)..(382): a, c, t, g, unknown or other
  misc_feature (382)..(382): n is a, c, g, or t
  modified_base (419)..(419): a, c, t, g, unknown or other
  misc_feature (419)..(419): n is a, c, g, or t
  modified_base (510)..(510): a, c, t, g, unknown or other
  misc_feature (510)..(510): n is a, c, g, or t
  modified_base (553)..(553): a, c, t, g, unknown or other
  misc_feature (553)..(553): n is a, c, g, or t
tcagcgtagactagcacgaccggtgctcgatttagtagtgtagatttgggtttggggactcaacaaccacatctgtcctctagagaaaaccctgtgagcacagctcctcaccatgactggacctggaggactcctcttcgtggtgcagcagctacagtcgcccacgtcccaggtcgcgagcgtggtcacgaggtcgtgggctggaggtagaaggacgtccgtcggggccttcgaggtagacggtcctcgtagacgtacggtcttcgtagtacttccgtaccgtttacctacgtataagtactcgaacggttggcnccgacgacggtccgatacggactaaccgcgtggacggtggaggtacggagtcgggaaccaaccgtanaccggttgacgtacacgtcgtcgtctaccaacccgtntcccggtacggactaccgtactacgacgaccgaacctacgtactccctaacgaacaacctcacgtactacgatacgggtgtacgagtaccncgtaagactagtccgaactacggacgaccggtctaaccgttanaccggtgacgtcggaactcccgttaccggagtcgccggtaacgcctcccgggagtccggtaccggttccggttacttacggtcgttcgggacccggg

SEQ ID NO: 207894 - DNA, 821 bp, Homo sapiens
  misc_feature: GYAE6OF01BZOAD.17.25.C03.1.454.CMB.1.raw
  modified_base (184)..(184): a, c, t, g, unknown or other
  misc_feature (184)..(184): n is a, c, g, or t
  modified_base (268)..(268): a, c, t, g, unknown or other
  misc_feature (268)..(268): n is a, c, g, or t
tcagcgtagactagcacgaccggtgctcgatttagtagtgtagatttgggtttgggacctcaacaaccacatctgtcctctagagaaaaccctgtgagcacagctcctcaccatcggactggacctggaggactcctcttcttggtcggacagcagctacaagtcgcccactcccaggtcgacngctgggtcactagtcgtgggctggaggtagaacgtacgccggtgggcctcgaggtgaacgtcctcacggtacgtaggtctttgnggtactttccgtaccgtttacctactaatagtacttaccgtaacggtgggtcgcccggtaccgtagggccctggtaacggaaccacggtaccgtggtacggttggaggtaggtacgtaccgggacctaacccgtactcggttgtcgtacacgtcgtacgtccctacaccctcgtcccgaccggtactacgtaccgtaactacgacccgtaacctaaccggtacccttaccgaaccgtaaactaacccgacgtaccgaccctaacggtacgtacgggtaacgttacggaaccggacgtacctaacgaaccttgaacccggttaaccggacccgggttaaacccccgtccgggtttaacccgttttaaacctacgggttttaccgtacggggttaaccgaaccggggttaaccttaacccccgggttaccggtaacccgggttacgggttaccccgggtaacggtaaccccggtaccccggttacgggaccccgttaccggggtacccccggtttaccgtttaacggtaccccgggttcccgggggtaacccggg

SEQ ID NO: 207895 - DNA, 631 bp, Homo sapiens
  misc_feature: GYAE6OF01AMS7J.17.25.C03.1.454.CMB.1.raw
  modified_base (496)..(496): a, c, t, g, unknown or other
  misc_feature (496)..(496): n is a, c, g, or t
  modified_base (500)..(500): a, c, t, g, unknown or other
  misc_feature (500)..(500): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaacgccgtggggcctcgagtgaaggtctccgtgacgaggtcttcgtggtacttctaccgtttacctcctatacgtatacgaacgtgggtcgcgccgaggcccgcgtcggaaccaaccgccgtaggagtggtagtcgggagtcgggaccgtaaaccctaacgacgtcggtcgtacacgtacgtcgtccttaccacccgtacgtcccgtaccggggactacgttaacctaccagtaccgaaccctacacctacctaccaactaaaccactacactacagtgagtagagacncgtnacgtctcgtacgacgtacgtacgtcgttacttactcgtaggtcgacgtacgaccgtaccgacgtcgtccgggtacgccggaccgtacggaccgtacggtccggttaccgttcgtccggttcgggaccgggg

SEQ ID NO: 207896 - DNA, 967 bp, Homo sapiens
  misc_feature: GYAE6OF01DB9RL.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtgcagcagctacaagtcgcccacctcccagtgcagcgttggtgcctagtccgtggggctagggaggtagaacgacggccgtggggccctcgtaggtacgtaacggtcctccgtgaccgtaaggtcttacgtggtacttacctacggtttacccttcctaagttaacgttacttacgaacggttcgggtcgccgtacccggacggtcccgacgtacggaaccaaccggtaccgtaggtacggtaggtaggtcggggacgttacggggtaacccggtaaaacccctaacgttaccggttaggtaccgttacgtaaccggttacgtttacccggttacccgtttacccccaaccccgtttaacccgttacccccggggttaaccccgggaaaccgttaccggttaacccccgttttaaaccggtaaacccggtacccggttaaccccgtaaaacccccggtttaaacccgttccccccttaaaaaccccgttaaaccttaaaaaccccgaacccgtaaacccggtaaccccttaaaacccgggttgttaacggggtttaacggttacggggaaccggtaccggttacccgtaggtaaccctaaggttttaccgaacgtaacccgggaacccggttaccgggttcctttaacgttacgttaaccgttcgggtacggtaaccgtacggtccccggttaacccggtaaccgggtttaccggtaccggggtaacccggttaaccccgggccggggttaaacccgtccgggtaacccgggtcccggttttaacccggtttacggtacccgggtttcccgggggaacccgggg

SEQ ID NO: 207897 - DNA, 698 bp, Homo sapiens
  misc_feature: GYAE6OF01EUDSN.17.25.C03.1.454.CMB.1.raw
  modified_base (163)..(163): a, c, t, g, unknown or other
  misc_feature (163)..(163): n is a, c, g, or t
  modified_base (186)..(186): a, c, t, g, unknown or other
  misc_feature (186)..(186): n is a, c, g, or t
  modified_base (242)..(242): a, c, t, g, unknown or other
  misc_feature (242)..(242): n is a, c, g, or t
  modified_base (281)..(281): a, c, t, g, unknown or other
  misc_feature (281)..(281): n is a, c, g, or t
  modified_base (391)..(391): a, c, t, g, unknown or other
  misc_feature (391)..(391): n is a, c, g, or t
tcagcgtagactagcacgaccggtgctcgatttagtagtgtagatttgggtttgggactcaacaaccacatctgtcctctagagaaaaccctgtgagcacagctccctcaccatggactggacctggaggactcctcttcttggtggcagcagctacaagtcncccactcccaggtgcagctggtncagtcgtgggctgaggtgaagagccgtagggccctagagtggaacggtcctaccgnggacagtcttcgtaggacttccgtacgtttccacgttanacgtactacgaaggttggtcgaccgcacggtccagttacgaccacggcctggagtggaagtggagtccgggacctaaccctagtccgtggtccgtacaacgttacggttnttaccctaccgaccttacggtccgacggtaaccaacgttcctaaccgagttaaccgaacccgacctacccgtaccctaaccgaacttaaacaacccgtaccgaccgtttaacgaacggtcggtaaggttcggaacggtactccgtaacgtacctagtaccgtacggaccgtacggtaccgtcgttaactacgttacgtacggtactacggaccgttacccgaccgtacggtacggtacccggtacgtccggtacccgtacgaccggtacggttccgttaacgtccggttaacggtcgggtaaccggg

SEQ ID NO: 207898 - DNA, 1010 bp, Homo sapiens
  misc_feature: GYAE6OF01DQGKP.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatcggactggacctggaggtatcctcttcgttggtggcagcagctaacgaagtcgcccacgtcccaggtcgcagcgtggtgcgtaggtcgtggggctaggagggtaggaagacgtccggtcggggaccctgaggtacggtacgtcctaccgtagacgtacggtcgttacgtcgggtactttaccgttaacccgttttaccaccgtttagtaacgttaacgttacccgtaagggttcggggaccgacccgggtaccccggtaccggggtacccggtaaccggtaccgggaaaacccgttaaacccggtaacccgggttagggttaaggggttacggggaagggtttacggggggtacggtaacccggggtaaccccgtaaaaccccgtaaggtccgggttagggtaccggttaccgtaacggtaagggtttcccttaacccgtttaccccgaaacccgttcccggttaaccccgggtacccggggtaaacttaacccggttaaacccttaacccggtaaccgtaacccgtaaaccccgggaacccttaaaccccgttaaccctaaaacccccgttaaaacgtaaaacccctaccggaacctttaacccgtaaacgttaacgggtttaacgggtaacgggttaaaggaaacccggggttacgtacccgtagtaacccgttaacttccgggtaaccggaccgtaacccgggtacccgttaccgtttaaacttaccggttaacggccgggtacgtacgggtaaaccggtccccgttaaaccgtaacgggtaccccgggttacgggaaccggtaaacccggttcccggtaacggttaaccccggggacgtttaccggggtttacccctaacggggttcccgttaacgggggtacccccggggg

SEQ ID NO: 207899 - DNA, 741 bp, Homo sapiens
  misc_feature: GYAE6OF01A9ZJL.17.25.C03.1.454.CMB.1.raw
  modified_base (545)..(545): a, c, t, g, unknown or other
  misc_feature (545)..(545): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtagaagaaggcccgtggggccctcgagtaggaacggtcctcctgaccgtaaggtcctttcgtaggtactttaccgtaaccgttttacccttaccttaattagttaactacctaaaccggttgggggtcgccggtccgacgggtcccgtacgtacgggaccaaaccgaccgtgggaggtgggtagtgggtagtcggggaccgtaaaaccccgtaacgaccgtggtacgtacgaacgtacggttcgttccttacccacccctagtcccgtaccgggaacacgtaacccttacactacgaccctacgtaaccctcccgtaaccaactaaacaccgactacccgtanacgttaggaagttaggacggactccgaggaactacgttcgaacggacgaaccggtccggtacccttagttaacttacgtggtacgaaccggtagtacccgtacccgacgttaccggaccgggttacggaccgtaccccgtacggaccgtaccgggttacccgttaccgtttcgggtacccggttcggggtccgggg

SEQ ID NO: 207900 - DNA, 775 bp, Homo sapiens
  misc_feature: GYAE6OF01BL412.17.25.C03.1.454.CMB.1.raw
  modified_base (306)..(306): a, c, t, g, unknown or other
  misc_feature (306)..(306): n is a, c, g, or t
  modified_base (645)..(645): a, c, t, g, unknown or other
  misc_feature (645)..(645): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggacttccgtcttcgttgggtggcagcagctaacaagtcgcccactcccgaggtcgcacgtcgtggtcgcgtacggtcggtggggctggaggtaggaaggacgcggtcggggacctgaggtacggtaacggtcctcgtgacgacggtcttgtacggtactttccgtaccgttttaccncgttaacgttagtaacttaccgaacgggttgggtccgccggtaccggacggtcccggacgtacggaacccgtaaccggtcgtagggtacggttaggacggtcggggtaaccggtaccgggaaacccccgtaaaccgtaccggtacggttagggtaccgtacgtacggttacggtttcgtaccccgtttacccgaaccccgttacggttaccccggtaccggggtaaactaacccgtttaccctaaccgaccgtaaccgaaccctaaccgttaaccccgttacctaaccaaaccgtaaccaaccgcttaaccgtaacgttggacgggtagtacgaaccgngtaccctagacctgacgtacgacctacggtaccgtccgttaatactcgtcgaggcgtacgtaccgtaccgacggtaccagggtcgacggtcgaaccgcgtaccgtccgttagtcggtcgtcgggaaccgg

SEQ ID NO: 207901 - DNA, 867 bp, Homo sapiens
  misc_feature: GYAE6OF01AQ0GY.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagccgtggggcctcgagtgaaggtctccgtgacaaggtcttcgtggtattcctaaccggttttaccctaccttaagtagttattaccgtaacgtggggtacgccgccgacgggtcccggtcgtacgggaaccaaccggtaccgtggtacggttagggaagttggggagtcggggaaccgtaaaccccgtaacgtacgttaggtcgtaccgacgtaggtcgttaccttaccgaaccctacgtaccccgtcccggggtaactaaccgttaaccgttaaaccaacggttaccgaacccgtaaacccggttaacccttccccgtaaacccctaaagttaaaaaccccaccggtaaaccgtacccgttaaacctacgggtttacgggtaaacggttttaacgggaccggggtaacgtaaccccggtttaagaacccgttaagttaccggtaacggaaccggaacccggttacccggggtacccgttttaacccttaagttttacccgggtacggtacggggtacccgtaagggttacccctaacccccgggtaaacggttccgggttaccccgggggttagacccgggttacccggttaacccgggcgtaaacccgggtcccgggtttacccgttttacggaccggttttaccggggacccgggggg

SEQ ID NO: 207902 - DNA, 786 bp, Homo sapiens
  misc_feature: GYAE6OF01CTP38.17.25.C03.1.454.CMB.1.raw
  modified_base (627)..(627): a, c, t, g, unknown or other
  misc_feature (627)..(627): n is a, c, g, or t
tcagcgtagactagcacgaccggtgctcgatttagtagtgtagatttgggtttggggactcaacaaccacatctgtcctctagagaaaaccctgtgagcacagctcctcaccatggactcggacctggaggatcctcttcgttgggtggcaggcagtcctacaagtcgaccccacctcccgaggtgcagcgttggtgcgtacggtcggttcggggcgtaggagggtaggaaaggaaccggtcccggtacgggggccctacgtaggtggtaacggttcctccgtcggacgtacggtcttcgtggtactttccgttaacccgttttacctaccgttaatacgttaacttaccgtaacggttggggtaccgccgaccggccggcccgtcgtacggaaccgaaccggtccgtagggacgtgggagtcgggtaggtccgggaacccctaaaccgtaaccgtggtggtcgtaccgacgttacgtcgttaccctcccgaaccgtccgtacccggtacgacgttaccgtaccttaaccgacgtaccgtaaccctaaccgttaccctacccgttaaccaacctaaaccgaccgtacgtaaccctacgagtaggtacgtaggacgtacgtcccgtanacctcgtacgaccgtacggacccgtaccggtcttacttacgtacgtcgtacgaccggtacgtacccgtacccgtacggtccggtacggacgtacccggtaccggtacccggtacgtcccggtacgttcgtttaccgggtcggtttcccgggaaccgggg

SEQ ID NO: 207903 - DNA, 895 bp, Homo sapiens
  misc_feature: GYAE6OF01DPVCZ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggactggagatcctcttcttggtggcagcagctacaagtcgcccacctcccaggtgcagctggtcgcagtcggtgggctggaggtagaaggaacgccgtcggggccctacgaggtacgaacggtcctccgtaggacgtaacggtccttacgtagggtactttaccgttacccggttttaacccttaccgttaagttaacgttaaccttaccgtaaaccggttcggggtccgaccggtcccgacggggtcccgtacggtacggaaaccaacccggtaccgtagggtaaggtcggggtaaggtggggtaacggtcgggaaccccgtaaacccctaacgtacggttcggtacgtaccgtaacgtcggtttacgttccttaccgacccctacggttacccggtacccgggactaacgtaaccttaaccgacgtaccgaacctaaccggtaaccctccgtaaccaaattaaacccacgaccgttaccgtaaagcggtacgggttaacgttacgggaacggtccgtaaccgtagtaaccgtacgtcggttaaacccgaccggttaaaccccggtccgggttaacccgttacgttttaaacgttaacccggttgggtaacgtaaacccggggttactaaaccccggggttccccctaaaccggggttaccggtttaccccgggggacgtacccgggtaccccggtttaaggacccggtccccggggtttaccctttaccgggttttaacccgggttcccgtttcccggggggaacccgggggg

SEQ ID NO: 207904 - DNA, 711 bp, Homo sapiens
  misc_feature: GYAE6OF01EUOVK.17.25.C03.1.454.CMB.1.raw
  modified_base (318)..(318): a, c, t, g, unknown or other
  misc_feature (318)..(318): n is a, c, g, or t
tcagcgtagactagcacgaccggtgctcgatttagtagtgtagatttgggtttggggactcaacaaccacatctgtcctctagagaaaaccctgtgagcacagctcctcaccatgactggacctggaggactcctcttcgttggtggcagcagctacgaagtcgcccacctcccgaggtgcagcgtggtcgctagtcgtgggctggaggtgaaagacgtccgtggggcctacgtaggtagaacggtcctaccgtgacgtacggtcttcgtggtacttccgtaccgtttacctcctagtagtactacgtacgtgggtcnccgcgacggccgcgtacggaacgtaaccgaccgtggaacgtggtaggtgggtacgtacggggacctaaaccccgtaagtacggtcggtacctacgtacgtagtcgttacctaccacccgaccgttacccggtaccgggacctacggtaacctacgactaccgaccaaccgtacccgtaccctactaaactaaacgtaccgtaaccgtaaccgtaacgttacggtagggtaacgttaggaaccggtacgtccgtaacgtaaccgtactcggaaccgtaaccggacgaccggttaccgttattacgttacggtggtacgcgtacgtacccgacccgtagtccgttacggcgtaccgccggtacgcggtacgccgtaacttcggagttcggacggg

SEQ ID NO: 207905 - DNA, 771 bp, Homo sapiens
  misc_feature: GYAE6OF01EDN84.17.25.C03.1.454.CMB.1.raw
tcagcgtagactagcacgaccggtgctcgatttagtagtgtagatttgggtttgggactcaacaaccacatctgtcctctagagaaaccctgtgagcacagctcctacaccagtggactggaccgtggaggatcctcttcttaggtggcagcagcttacaagtcgccacctcccaggtgcgaagtcgtggtacgctagtcggtgggctggtaaggtagaacgaaggtcccgtggggaccctcgaaggtcgaacggttcctccgtaggaccgtaagtctttcgtaggtacttaccgttaacgtttaccctacgttagtaagtacttacggtaacgtggtccgccgaccgtaccggtccgtcggtaacggaaccgtaaccggtacggtggtaaggtagggtaacggtggggtaacgtaccgggtaaacccctaaaccgttaaccgcgttacgggtctacgaaccgtcgttcgttctacccctaaccgtaaccgtcccggtacgggtaacctacgttaaccttaccgaagtaccgaaacccaacgtaacccgtaaccctaactaaacgtaaacctacgaaccgtaactaacgtcggttaagtaggttaccggaggtacctaccggtagacctagtacgtaccgacgtaaccgtcgtccgttacttagtaccggtgtacgtaccgtacgtaccgtacccgtacgtccggttacggacgcggtacccgtaccggtacgtccggtaccgtttaccgtctaccggtgggtaacccggg

SEQ ID NO: 207906 - DNA, 649 bp, Homo sapiens
  misc_feature: GYAE6OF01CF2DF.17.25.C03.1.454.CMB.1.raw
  modified_base (221)..(221): a, c, t, g, unknown or other
  misc_feature (221)..(221): n is a, c, g, or t
  modified_base (572)..(572): a, c, t, g, unknown or other
  misc_feature (572)..(572): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctggaggtagaagagcgtggggcctnagtgagtctctgcagcttgtgtattctaccgttacctctatacgtactacgagtcggtcgccgccgacggccgcgtcggaccgaccgtaccgtggacggtggacggtcgggagtacgggacccgtaaccctacgacgtggtacgtaccacgtacgttcgtccgttcccaacccgtccgtcccggtacccgggactacgtaacccttaccacgtaccgaacccgtaacctaaccctccctaacgaaactaaacccgtacaccgtaccctaagtacggtacggtaggttacggaacgtccgtcctacgacttacgcgttacgacccgtacggaccgtccttacttacgttagngtccgagtaccgtaccgtaccgagtcggtccggagccggtaccgtacggctcgggtccttgttcgtcgtcggacggg

SEQ ID NO: 207907 - DNA, 715 bp, Homo sapiens
  misc_feature: GYAE6OF01BIINC.17.25.C03.1.454.CMB.1.raw
  modified_base (285)..(285): a, c, t, g, unknown or other
  misc_feature (285)..(285): n is a, c, g, or t
  modified_base (502)..(502): a, c, t, g, unknown or other
  misc_feature (502)..(502): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttgggtggcagcagctacaagtcgcccactcccaggtgcagcgtggtgctaggtcgtgggggctggaggtagaagaacgccgtggggcctcgaggtgaacggtcctccgtgacgaggtcttcgtggtacttcgtaccgtttaccnctatagtatcgaacgtgggtcgccgccgacggcccgtcgtacgggaacctaacggccgtaggacggtggacgtggggagtccggggaaccctaaacccgtacgtacgttgggtactaccgaagtgttcgtccttaccacccgtacgtcccggtaccgggacctacggtacctaaccagtaccgaacctaccgtaccctccgtaccaaacgtaaaccncacgtacctaacgtaggtggtacgttacggacggtctacgtacgtactacgtaccgaaggaccgaaccggtaccggtccgttaacttaacgttcgtacggtacgacggtaacgtacccgttacccgaacggtccggttaccgggaggaccggtaccccggtacgggcctacgggtcccggtttaccttcggtacccgttcgggggacccgggg

SEQ ID NO: 207908 - DNA, 773 bp, Homo sapiens
  misc_feature: GYAE6OF01CSHOA.17.25.C03.1.454.CMB.1.raw
  modified_base (147)..(147): a, c, t, g, unknown or other
  misc_feature (147)..(147): n is a, c, g, or t
  modified_base (463)..(463): a, c, t, g, unknown or other
  misc_feature (463)..(463): n is a, c, g, or t
  modified_base (472)..(472): a, c, t, g, unknown or other
  misc_feature (472)..(472): n is a, c, g, or t
  modified_base (521)..(521): a, c, t, g, unknown or other
  misc_feature (521)..(521): n is a, c, g, or t
  modified_base (530)..(530): a, c, t, g, unknown or other
  misc_feature (530)..(530): n is a, c, g, or t
tcagcgtagactagcacgaccggtgctcgatttagtagtgtagatttgggtttggggactcaacaaccacatctgtcctctagagaaaaccctgtgagcacagctccgtcaccatggactggacctggaggatcctcttcgttgggnggcagtcagctacgaagtcgcccacctccgaggtcgcagctggtgctaggtcgtggggctaggagggtagaaacggaacgtcccggtacgggggtcctacgtaaggttcggaaacgggttcctacccggttgaaccgtaacgggtcttacgtaggtacttacgtaccgtttaccgtacctaagtacggtactaccgaacgttgggccgacgccggtacggaccggcgtaggaaaccgtacggtcctggacggtagtagtggaacgtcgggaacaacccgtagaccgtgacgtctacgagttccgtactcacgtacncgtacgganacgtaccttacacgtaccgacctaacgtaccctacgaactaacaaaccncgtaacccnctaacgtagttacggtaggtacgacgtactccggttaacaccgtagtcgtaaaccggaacgtacccggacccggtttaccttaagttaccgttacgtagggtccggaaaccttaccgggtacccgtaacccggttcggttaaccgggtccgggtaccggtaaacccgtcccgggtacggttacccgggtccgtaacccgggttttaccttaacccggtccgggttcgggtaaaccccgggggg

SEQ ID NO: 207909 - DNA, 783 bp, Homo sapiens
  misc_feature: GYAE6OF01BGOXP.17.25.C03.1.454.CMB.1.raw
  modified_base (186)..(186): a, c, t, g, unknown or other
  misc_feature (186)..(186): n is a, c, g, or t
  modified_base (197)..(197): a, c, t, g, unknown or other
  misc_feature (197)..(197): n is a, c, g, or t
  modified_base (201)..(201): a, c, t, g, unknown or other
  misc_feature (201)..(201): n is a, c, g, or t
  modified_base (207)..(207): a, c, t, g, unknown or other
  misc_feature (207)..(207): n is a, c, g, or t
tcagcgtagactagcacgaccggtgctcgatttagtagtgtagatttgggtttgggactcaacaaccacatctgtcctctagagaaaaccctgtgagcacagctccctcaccagtggactggacctggagacttccttcttgttggcggacagcagtactacgagtccgacccacctcccgaggtnacagtcgtggnacgnggtcgngggctggaggagaagaccggccggtggcctagaggtagacgtcctcgacgacgtagtccgttaggtcgttacttaccgttaccgtttacctacgttaacgtagttcgtaaccgtagggtccggcgaccgaccgggtacgacccgtagacgaaccgacgtacgtggaaggtccgaggtcgggaacgaccgtaacccgaaccgttagcgtacggtagacccttagcgttaccgttcccaccgtaccgttacccgtaccggtaaccgacgtaaccttaacgtaccgagtaaacccccgtactaacccgttaccctactaacccgtaaacgtacccttaaccgaccttaacgtaacgtaggtttacccggtaggtaaccggtacggtaacctacggtaacgtaaccgtttacgacgggtaacccgaaccggtacccgttcccggtaagtttacgttacgttacgtacggacggttacctacggacccgtaccggtaacgtcccgggtacgtaccggtacgacccgggttaccgacggttaccggttcccgttagttcggtaacccgggtcggacccgggg

SEQ ID NO: 207910 - DNA, 660 bp, Homo sapiens
  misc_feature: GYAE6OF01B0Q17.17.25.C03.1.454.CMB.1.raw
  modified_base (308)..(308): a, c, t, g, unknown or other
  misc_feature (308)..(308): n is a, c, g, or t
  modified_base (447)..(447): a, c, t, g, unknown or other
  misc_feature (447)..(447): n is a, c, g, or t
  modified_base (553)..(553): a, c, t, g, unknown or other
  misc_feature (553)..(553): n is a, c, g, or t
tcagcgtagactagcacgaccggtgctcgatttagtagtgtagattttgggtttgggagtcagtctcagtcaggacacagcatggacatgagggtccccgctcagctccgtggggctcctgctactctggctccgagctgccagatgtgacatccagatgacccagtctccactcctccctgtctcgcctctggtggggtcagtagtccaccatctacttcgaccggaacaagtaccgaacggtaacgtttaaaaaccttaattttaaagttggtactacaagaccaaagtaaaacctaggaaaaccnccccaagtaccctcctagactcgttcgttggtacgacactccaacgtctacggacgtaagggtccgacccgtcccgtagtcggtaggttccaggtggacgtaggtcggacttggacggaatacggtatttacaattccncgaaccactacccacctactcacgtaaccacgtaggaacgtattcgtacgtacaacgttacttactacctagtacaaacctaaggtaccttacgcccgtttacccngttaccgttaacgtttccggaaccggttaacgggaacgtaaagttagaacgtataaccgaaaggtaccgtgtacggacgttcacttaaccgtacttcttcgttaccc

SEQ ID NO: 207911 - DNA, 714 bp, Homo sapiens
  misc_feature: GYAE6OF01AJNPZ.17.25.C03.1.454.CMB.1.raw
  modified_base (180)..(180): a, c, t, g, unknown or other
  misc_feature (180)..(180): n is a, c, g, or t
  modified_base (198)..(198): a, c, t, g, unknown or other
  misc_feature (198)..(198): n is a, c, g, or t
  modified_base (311)..(311): a, c, t, g, unknown or other
  misc_feature (311)..(311): n is a, c, g, or t
  modified_base (576)..(576): a, c, t, g, unknown or other
  misc_feature (576)..(576): n is a, c, g, or t
tcagcgtagactagcacgaccggtgctcgatttagtagtgtagatttgggtttggggacgtcaacaaccacatctgtcctctagagaaaaccctgtgagcacagctcctcaccatcggactggacctggacggatcctcttcttggtgcagcagtctacaagtcgcccactcccaggtcncacgctggtgcgagtcgngggctggaggtagaacgacgccgtgggccttgacggtgaacggtcctaccgtgacaaggttcctcggtagtacttccgtacgttcctcgtaactagtacacgaacgttgggcnccgacgtaccggtccgacgttacggaaccaaaccggtacctaggtacggtagggtaacgtaggggcgttaacgggacccctaaaacgtacccgtaggttaggtacgtactaagacgttcgttcctaacccacccgtaacgtcccgacgggactacccggtaaccgttaacacgtaccgtaaccaccgtaactaccctacgtaactaaaccacgaccgtactaaaccggtagtcggtaacggttaggaccgtaacgttcccgtaanactagttacgacggaaccctacggaccgtactacgttacgttacggacgtcggaacgtcggtacccgtaacggtaacgtacgtccggagtacccggaccagggtccacggtacgtaccttcggtacgtcgggaacggg

SEQ ID NO: 207912 - DNA, 804 bp, Homo sapiens
  misc_feature: GYAE6OF01AX4E0.17.25.C03.1.454.CMB.1.raw
  modified_base (187)..(187): a, c, t, g, unknown or other
  misc_feature (187)..(187): n is a, c, g, or t
tcagcgtagactagcacgaccggtgctcgatttagtagtgtagatttgggttggggactcaacaaccacatctgtcctctagagaaaaccctgtgagcacagctcctcaccatggactggaccgtggaggatcctcgttcttggtggcagcagctacagtcgcccactccgaggtgcgagctaggtnacgagtcgtggggactggacggtagaaacggacgtccgtcggggtccttagaaggtacggtaacggtcctaccgtgacgtaacggtcttcgacggtacttctaccgttacctcgtataacgtactacgtaacggtggtacgcgaccgacggtcccgtacggtacggaaccctaacggtaaccgtcgggacggtaggtacggtacgggtagaccgggtaacccgaaacccgttaacgtacgggttcggtacgttacgaacgttcggtcgttacccttaccgaacccttcggtacccgtacggtaccacgttaacctaactcgaaccgacctaacccgtacctaccctaaacgaaacctaacgtaaccgtactaaccgttaaggacggttacggttaaggttcggaaacccggttacgtcccgttaggaaccttaacgttaccggaacccggtaacccgtaccgggtacccgtcggtttaacgttacggtaaccgtcggggtaccctaaagggtacccgaacctccggtaaaccgtgggttacccgtacggacccgttccgtaggacccgttaccgggttcctttaaccggtcgttaaaccggggtggtaccccggggg

SEQ ID NO: 207913 - DNA, 947 bp, Homo sapiens
  misc_feature: GYAE6OF01CU7F3.17.25.C03.1.454.CMB.1.raw
  modified_base (190)..(190): a, c, t, g, unknown or other
  misc_feature (190)..(190): n is a, c, g, or t
tcagcgtagactagcacgaccggtgctcgatttagtagtgtagatttgggtttggggactcaaacaaccacatctgtcctctagagaaaaccctgtgacgcacagctcctcaccatggactggacctggaggatcctcttcttggtggcagcagctaacaagtcgcccactcccaggtgcagctggtgcngtcgtcgggggactggacgggtagaaaggacggtccgtagggggccctcgaggttagaacggttcctccgtgaccaagggtccttgtggtacttcctaaccggtttacctccctagttaaacggtacttcctaacgtggggtcgaccggcccgtagggccctcgacgggaacctaaaccgtacccgtaggaaggttgggaagtggggaacgttcggggaaccctaaacccgtaaaccgtacgttgggtacctcgaaccggtaagtttccggtaccttacccgtaaacccctacggttacccccggtttaaccccgggggaacctttaaacgggtaacccccttttaaaccccgaaacggtacccgggtaaacccccgtaaaccgggttaaacccccttacccctaaccccgttaaaaccttaaaaacccgaacccgtaaccgtaaccctaacccgaagtaacggggttaaggttacggaacgggtacccgtaccgtttacgtaaccgtaacttacccggttaagaaccccgggtaaacggtacccggggtacccgtttaacgttaacggtttaccgttacgggtaccgggtaaccggtaacggtaccccggtttaccccggaaaccggttaaccggttaacccccgggggtaggtaacccggttaacccccggggttaaccgtaccggggtaaaccggtccccgggttaacccgttttaccgggttaacccggttcccggggttaaccccggggggg

SEQ ID NO: 207914 - DNA, 795 bp, Homo sapiens
  misc_feature: GYAE6OF01ALB4B.17.25.C03.1.454.CMB.1.raw
  modified_base (220)..(220): a, c, t, g, unknown or other
  misc_feature (220)..(220): n is a, c, g, or t
  modified_base (764)..(764): a, c, t, g, unknown or other
  misc_feature (764)..(764): n is a, c, g, or t
  modified_base (774)..(774): a, c, t, g, unknown or other
  misc_feature (774)..(774): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggcctccgagctgccagatgtcgacatccagatcgacccagtcctccactccctcctcgtctcgcctcgtggtggggtacaggacgtaccaccntcctacgttcggaccggaacgaacggtccgaaccgggtacctttaaaaaaccttaagtttttaaaacgttggttaactcgacggaccgaaacggtaaaaccgtaacgggaaaaacctcccccgaacggtaccccttccgtacgtacttccgtacgttaggtcgacgtaacctcccgtaccttccgtacggaccgggtaggtaccgggtcccctaccgtaacgtccgggttaacggttaccggtagggtcggacggtacggttagggtactcgggtaggtaacgttacggtaactttaccgaacttaccctacctaacccgtacttaaccccaacccgtacttccgtaaccgacccgtaaccggtaaggtaaccggttagtaccggtacgtaaccttaacgttaccttaacgttaccgtacgtaaaccacggttacggttaaccgtaccgtccccgtttacctaccgtaccgtttacggttccgggaaccgggtacggtaacgtacggtacgaacgtactaacggtaaacgtgttacggacggtntacccggtanacccgtttcgcttaccgttcc

SEQ ID NO: 207915 - DNA, 1007 bp, Homo sapiens
  misc_feature: GYAE6OF01BGT2S.17.25.C03.1.454.CMB.1.raw
  modified_base (156)..(156): a, c, t, g, unknown or other
  misc_feature (156)..(156): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctanaagtcgcccactcccaggtgcagctggtgcagtcgtgggctggaggtagaagacgccgtgggcctcagtagaaggtctccgtgacgtaaggtcttcgtggtactttaccgtaccgttttaccttccgttaacgttaacgttaacttaccgtaaacggtcggggttacggtccggtaccccggaaccgggtcccggtaccgttacgggaacccgtaaacccggaacccgttagggtaacgggttaggggtaagggtacggggtaacgggtaccggggtaaaccccggtaaaaccccgttaaaccgtaaccggttcgggttaccggtaccgtaaccgttacgggttacgtttccccgttaacccgtaacccccttaaccgttccccggtaaccccgggtaaaccgtaaccggttaaccctttaacccgtaacgttacccgaaaccccgttaacccgttaaccccttaaccccctaaccctaaaaccttaaaaaccctaccccgaaacccgtaccttaaaccggtaacgttaggggttaacccgggttaggaaccgggtaccgtaacccggtgtaaacccgtccgtacccgttaacgggaaacccgtacccgggtaacccccgggtttccgtttaaccctttaagtttacccggggttacggtaccgggtaaacccggtacggggttaaacccccgttaaccccccgggttaacggtaccgggttttaaacccccggggacgggttaaccccggtaacccccgggttacccgggggaaaccgttccccggggtttcccggtttaacccggttttaccgggttaccccggtttaccggggggttaccccgggggg

SEQ ID NO: 207916 - DNA, 992 bp, Homo sapiens
  misc_feature: GYAE6OF01CK9JI.17.25.C03.1.454.CMB.1.raw
  modified_base (498)..(498): a, c, t, g, unknown or other
  misc_feature (498)..(498): n is a, c, g, or t
tcagcgtagactagcacgaccggtgctcgatttagtagtgtagatttgggtttggggactcaacaaccacatctgtcctctagagaaaaccctgtgagcacacgtcctccctaccaccaagtggaaccgttcgggacccgtggggaacggtacttcccttcgtttcgttgggtcggcagacgagtactaacgaacggtccgaccccaccgtaccgtaggtgccgagcggtcggtgcgtacggtcggtggggacgtagggaaggggttaaggaaaggtaccggtcccgggttccggggaccgttacggaagggttaacgggtaacggttccgttacgggactacgggtaacccgggttagttcggttaggttacctttacgtttaacccggttttaccttacgttaaacgttacggttacttaaccggtaacgggttcgggtccgacccggaccggtacggcccgttaaccgacggtaaccgacgaccttagggtacgnggggtacgagggtacggtaccggaaccgtaacgtacgtacgttagggacctacgtacgtagttcccgtactacccggtaacctccggtaccggaccggtaacctaacgtaccgttaaccacggtaccctaaccggaacctaacccgtaaccctaaccgtaaaaccgttaaccgtaaaaccctaccggtaaccgtaacggtacggttaaacggtaacgggtacggtaaaccgggtacgtaaccgtaaccgtaacgttaccggtaaccgtaaccggtaaccggtaaacccggttaaccggttaccttaaaccgtttaaccggttaccggtaacggttaccggaacgggttaaccctaccgggtaacccggttaccggttacccgggtaccggttaacccgtccgggttaacccggtaacccggtaaccccgggtaccggggttacccttttacccgggggtttaacctccggggttaacccggggtaaccccgggg

SEQ ID NO: 207917 - DNA, 628 bp, Homo sapiens
  misc_feature: GYAE6OF01C4YE1.17.25.C03.1.454.CMB.1.raw
  modified_base (399)..(399): a, c, t, g, unknown or other
  misc_feature (399)..(399): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctaacaagtgcccacctcccaggtgcagctggtgcagtctggggactgaggtgaagaagcctggggcctcgagtgaaggtctccgtgcaaggcttcgtggattcctacgtttaccctcctatagtatcaacgtgggtacgcgccaggccgacgtggaacaaccgacctgaggtggagtggggattgggccgtaaaccctaacacgtggtacgtcaacgtagtcgtcttccaccctatcccgccgganacgactacatcgaccaacgacctcctaccaataaaccacgtacacctaacagtacggagttgagacgtctagacattcgaagaccgtaacgacggtccgtataacgtttcgtagtgacgtaacgtaccgacccctaaggaacccgttcgggttacgaaccggtaccccggtaccggacgtaccggaccgggtttccccttttaaggcccgttttccgggaaccgggggg

SEQ ID NO: 207918 - DNA, 890 bp, Homo sapiens
  misc_feature: GYAE6OF01C6DCD.17.25.C03.1.454.CMB.1.raw
  modified_base (163)..(163): a, c, t, g, unknown or other
  misc_feature (163)..(163): n is a, c, g, or t
tcagcgtagactagcacgaccggtgctcgatttagtagtgtagatttgggtttggggactcaacaaccacatctgtcctctagacgaaaccctgtgagcacagctcctcaccatggactcggacctggaggatccgtcttctggtgcagcagctacaaggtcncccacgtcccaggtgcacgccgtggtacgcgtacggtcgtgggctggtaggagaaggacgtccgtcggggccctagacggtacgtaacggttcctaccgtgaaccgtaacggtctttacggtcggtactttaccgtaccgtttaccgtacttagtacgttactaccgaacgttcgggtacgccgaccggacggtccctacggtaccgaaccgtaccgtacgtggaagggtcgtggtacgggtactaccgggaaccgaaccgtacgacgggttgtcgtaccgtaacgtgttaacgttcctaccgaccccgtacgtacccggtaccggaacgtaccgttaacccgttacgtaccgtacccgtaacccgtaacccgtaaccccttcccgttaaacctaaaccgttaaacccaaccggttccgtaccgttaaaacggcgttaggggttaaccgtcggttacgggaccttaccgtacaaccgttcgacccgggtaccgtaaccgtacccgggtaccgggttacccgtttaactcccgttttaaggggccttaccgggggtaaacctaaccggaaccccggttttaccgaaacccggggttcccggtttaaccccggggtaacggttaacccggaaacccccggggtcggttttaaacccgggtcccggtttaacccggggtttacccttttaccccgggggtcccggttttaaacccgggggggtcccccgg

SEQ ID NO: 207919 - DNA, 783 bp, Homo sapiens
  misc_feature: GYAE6OF01ADXQE.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttggtggcagcagctacaagtcgcccactcccaggtgcagcgtggtgcagtcgtggggctggaggtagaagacgccgtggggcctgtaggtagacggtcctccgtgacgaggtcttcgtaggacttcctaccgttacctactagtagtactacgtaacgtcgggacgccgaccggaccggccggacgtaccggaaccgaaccggacctaggcggtaggaggtcgggaacggtaccgggacccgtaaaaccccggtaacgtacggtcggtacgtaccgtaacgtacggtacgttccgttaccccaccccgttaccgtacccggtacccgggaacgtaaccgtaacccgttaccgtaacgttaccgaaccccgtaaccgttaacccgttacccctaaccgtaaaaccgtaaacccctaaccgaaccgtaaccgtaaccggtaggtacgggtaggttaacggtacggtacgtcgtacgaacttccgtacgtaccggaacccgtaaccggtcccggttacgttactttaacgttcgtcggtacgtaccggaccggtcccgtaaccgcccggttacggtcccggtacggccgtaccgtccggcggtacccggtccgttacgtttacccggcgttccgggacccggggg

SEQ ID NO: 207920 - DNA, 804 bp, Homo sapiens
  misc_feature: GYAE6OF01A34PU.17.25.C03.1.454.CMB.1.raw
  modified_base (344)..(344): a, c, t, g, unknown or other
  misc_feature (344)..(344): n is a, c, g, or t
  modified_base (676)..(676): a, c, t, g, unknown or other
  misc_feature (676)..(676): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctgggaggatcctcttcttggtggcagcagctacaagtcgcccacctcccgaggtgcagcgtggtgcacgtcgtggggctggaggtagaagacggccgtggggcctcgtaggtgaacggtcctccgtggacgtaacggtccgttcgtcggtaactttacccgttaacccgttttacccctacttaaacggttagttaactaccgtaacgggttcggggtcnccgggtacccgacgggtcccgtacggtacggaaccaacgtaccgtggagtgggaggtcgggacgtaccgggaccgaaaccctacggtcgttaggttccaccgtaacgtcgttccgttaccgtaccctaaccccgccgttcccggtaacccgggaactacgtaaccttaccgagttacccaaccccgaacgttaaccctcctaaccgaaaaactacccacgtaacccgtccaaggttaaccggtagggtaccgggttagacgggttaaccgcctaaggactacgttccgtaaaggccggtaccgtacccgttacttaccgttaagtttccggnggtagacccggacgtaccccgtaaacccgggtcgtccggttcgggacgggtaaccctacccccggggtaggaccggtaccgggttcccggttttcgttaacccgggaccgggtttccggggaccgggg

SEQ ID NO: 207921 - DNA, 638 bp, Homo sapiens
  misc_feature: GYAE6OF01CB9SP.17.25.C03.1.454.CMB.1.raw
  modified_base (287)..(287): a, c, t, g, unknown or other
  misc_feature (287)..(287): n is a, c, g, or t
  modified_base (300)..(300): a, c, t, g, unknown or other
  misc_feature (300)..(300): n is a, c, g, or t
  modified_base (396)..(396): a, c, t, g, unknown or other
  misc_feature (396)..(396): n is a, c, g, or t
  modified_base (460)..(460): a, c, t, g, unknown or other
  misc_feature (460)..(460): n is a, c, g, or t
  modified_base (539)..(539): a, c, t, g, unknown or other
  misc_feature (539)..(539): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagcgtggtgcagtcgtggggctggaggtggaagaagccgtggggcctcgagtagagtcctctgacaggtcttgtggacttctacgtttcctactatagtatcgaagtggtnccgcgacggccgngtacggaccaacgaccgtggaggtaggagttcgggagtcgggaacctaacccgtaactacggttggtcgtacacgtaggttcgtacttcccaaccncgtacccgtcgggacacgtacctaccgagtcgaaccacgtactccctactaacaaccacgaacncctaacgacgtcgtaaggttcgaggacgccgtagactagtctacggacctaccgaccggtccgttacgtagtttaccgnggttcgacggacgtaccgtaccgacgtaccggtacgggtaggtaccggcctaacgggaccgtacggtaccggttccgttacgtcggttcgggtccgggg

SEQ ID NO: 207922 - DNA, 813 bp, Homo sapiens
  misc_feature: GYAE6OF01BR5NC.17.25.C03.1.454.CMB.1.raw
tcagcgtagactagcacgaccggtgctcgatttagtagtgtagatttggggtttgggactcaacaaccacatctgtcctctagagaaaaccctgtgagcacagctcctcaccatggactggacctggagatcctcttcgttggtggcagcagtacctacgaagtcgacccactcccaggtgcgagcgttggtcgcgtacggttcggtggggtctagggaggtaggaaaggaacgtcccggtaggggcccttacgtaggttagtaaccgggttcctccgtagaccgtaacggtctttcgtaggttactttccgtaacccgttttaccttccttaatacgtataccgacggtgggttcggcgaccgtacggcccgtcgtacggaacgacggtaccgttaggaggtacgggacggtaggggtacggtacgggtaaccccaaaccgtacgtaacggttggtacctacgacgttaacggttcgtaccttacccgacccttaccggttcccggaaccggaccgtaactaacccgttaccgacgtacccgtaaccgaaccgtacctaccctaacctaacctaaccgactaacgtacctaacgagtacgtaggtacggacggacgtaccgtacggtactacgtaacgaccggtaaccgtaccgtacccggttccgttaacgtttaaccggttcgtaacgtcgtaaccggtaccgtacggttaaccccgaggtacccggttaccggcggtcccggtaccggtaccggtacgggtaccggtcgttaaccccggtttcggttacccgggtcgggtacccggggg

SEQ ID NO: 207923 - DNA, 806 bp, Homo sapiens
  misc_feature: GYAE6OF01ES4AP.17.25.C03.1.454.CMB.1.raw
  modified_base (198)..(198): a, c, t, g, unknown or other
  misc_feature (198)..(198): n is a, c, g, or t
  modified_base (653)..(653): a, c, t, g, unknown or other
  misc_feature (653)..(653): n is a, c, g, or t
tcagcgtagactagcacgaccggtgctcgattttagtagtgtagatttgggtttggggactcaacaaccacatctgtcctctagagaaaaccctgtgagcacagctcctcaccatggactggacctggaggatcctcttacttgggtggcaggcagctacgaagtcgcccactcccaggtgcagctggtcgcagtcgngggctaggaggtagaacgacgtccgtaggggcctacgtaggtcggaacggtccttaccgagtacgaacgggtcctttccgtaggtaacctttaccgtaaccggttttacccttacccgttaataacggtttaattacccgtaaaacggttcgggggtaagccggaccccggaaacgggtcccggacgttacgggaaccctaaaccgggtaccgtaggtagggtagggtacgttaggggtaacggtacgggaccccgtaaaaccgtaaacgtaccgtgggtacgtacaacgtagttcggtacccttacgaacccttaacgtcccggtacgggaactacgtaaacccgttacagtacccgtaacctaacggtaccccttaccctaacgaaattaaacccgacgaaccgtacctaagacgtttacggtaaggttcgaaacggtcgtaccgtacgtacncgttacgtaaccgacgtaaccgtacgggtcctaagttacgttaccgagttcgcggaacgttaccgacgtacccgaacgttcgggaagtccccgtacgtaccgggacgtacggtaccggtttacccgtttacggccggttacggtaaccggggg

SEQ ID NO: 207924 - DNA, 804 bp, Homo sapiens
  misc_feature: GYAE6OF01CIM2T.17.25.C03.1.454.CMB.1.raw
tcagcgtagactagcacgaccggtgctcgatttagtagtgtagatttgggtttggggactcaacaaccacatctgtcctctagaagaaaaccctgtgagcacagctccctcaccatggacgtggaccgtggaggactccttctttcgttgggtcggcagcacgacctaacgaagtccgcccctacctcccgaggtcgccgacgtccgtgggtagcgtacgtcgggtacggggctagggaaggtacggaaggaacggtccgtacggggccctagtaggtaggtacgtcctccgtgagtacgtcgttcgtagtacttccgttacctttacctacgttattacgtactacgaacggttgggtccgccgccgacgggccgtacgtacggaaccacggtcgtaggtaggtaggtaggcggggtaacgaccgggtaccctaaaccgtaacgtcggtagttaccgtactaacggtggttaccctccctaccgacccgtcggtacccggtcggaactaccgtacgtactcggtacccaaccggtaaccctaccaccgtaacctaaacgtaaccactaaccgcctaaagtgggtacgtaggtacggactacgtccaagtactagtaccggacgaaccgtacccggaaccgtttacccttaattccggttaacgacggtaacgccgggtaaaccccgttccggtaaccccggtaccgtacgggttacccgggaccgtaccggtaccccgggtaagaccgggtcccggtttaaccgggtttcccgtacggtttccggggtcccgggaacccgggg

SEQ ID NO: 207925 - DNA, 873 bp, Homo sapiens
  misc_feature: GYAE6OF01EISWA.17.25.C03.1.454.CMB.1.raw
  modified_base (151)..(151): a, c, t, g, unknown or other
  misc_feature (151)..(151): n is a, c, g, or t
  modified_base (190)..(190): a, c, t, g, unknown or other
  misc_feature (190)..(190): n is a, c, g, or t
tcagcgtagactagcacgaccggtgctcgatttagtagtgtagatttgggtttggggactcaacaaccacatctgtcctctagagaaaaccctgtgacgcacacgctcccgtcaccatggacgtggacctggaggattcctcttcgttggnggctagcagcctacgaagtccgaccctactccgaggtcncagtcgtggtgacgagtccggtgggactgggtaggtacgaagtaccggtccggtacggggtcctaggtaggtacgtaacggtcctaccgtgaccgtaggtcttacgtaggttaccttacgtaccgttttacctaccgttagtacgttactactaacgggttcgggtacgacccggccgaccggtccgtcggtacggtaaccgaaccggtacgtaggtaacggtacggagggttacgggacgtaccgggtaaaccctaaacccgtaacgacggttcggtactaccgtacgtacgggttccttacccgtacccgacccggtaccggtaacccggtcccgggttaaactaaccggttacccgtaacgacgtaacccggtaacccgtaaaccgtacccttacctaaacccgaacttaaaccccgacgttaacccgaaccgttaacgaacgttacgggttaacggttacgacgtaacccggttacctacgttaaccgtacggtaccgtacggaacccgggtaccgtaaacccgggtttcccgtaactttacggttacggtaccgttccgaaggtacccggttacccgacccgtaccgggtccgtacgggtaccgtaccccggtacggttacccggcgttaccgggacccgttttcccggtaattcccgggtaccggggtaacccgggg

SEQ ID NO: 207926 - DNA, 823 bp, Homo sapiens
  misc_feature: GYAE6OF01D4GJP.17.25.C03.1.454.CMB.1.raw
  modified_base (147)..(147): a, c, t, g, unknown or other
  misc_feature (147)..(147): n is a, c, g, or t
  modified_base (182)..(182): a, c, t, g, unknown or other
  misc_feature (182)..(182): n is a, c, g, or t
tcagcgtagactagcacgaccggtgctcgatttagtagtgtagatttgggtttggggactcaacaaccacatctgtcctctagagaaaaccctgtgagcacagcctcctacaccatggactggcctggaggactcctcttcttgggnggcagcagctacaaggtcgcccactcccgaggtcncgagtcgtggtcacgtaggtcggtgggacgtggacggtagaacgacggtccgtcggggcctgtaggtacggtacggtccttccgtgacgaggtcttcgaggtcttacgtacgtttaacctactaagttacgtattacgtacggtgggtacgaccgccggacggtccgtagtaacggtaccgaaccggtacgtgggtaacgggtaggtagggttacgggtaacgggtaccgggaaaccccttaaaacccggttaacggtaccgttacggtaccgtacgtaacttcgggtacttccctaacccgtacccgtaccgttacccgggacccgtaactaaccgttacctaaccgtaacctaacgacccttaaccgtaaccttacccctaaacgtaaccggtaaaacctcgtaacctaacgtaacgtagggtagtttagggaacggtacggacctacttacggaacttccgacgaacggtaccgaaccggtaccggtacctttagtactttacgggacgtacggtaaccgggtacgtacccggtaaaccggtcgttaaccgggccggttaacggtaccggtttaacccgggacgaaccggtcggtttacccggtaccgtttaaccgttcggtacccggggtaccgggg

SEQ ID NO: 207927 - DNA, 933 bp, Homo sapiens
  misc_feature: GYAE6OF01BKNW6.17.25.C03.1.454.CMB.1.raw
tcagcgtagactagcacgaccggtgctcgatttagtagtgtagatttgggtttggggactcaacaaccacatctgtcctctagagaaaaccctgtgagcacagctccctcaccatggactggaccgtggaggactccttcttcttggtggcagcagcctaacaagtcgcccactcccgaggtcgcagctggtgcagtcgtggggctggaggtaggaagaacggtccggtcggggccttacgaggtggaacggttcctccgtgacgtaaggtcttcgtggtacttccgtaaccgtttaccctacttaagttacgtataccgaacggtgggttacgccggtaccgtacggcccttcgtaacggaaccgtaaccggaccgtaggaagggttcggaggttacggggaaccggttaccggggaaaccccgtaaaccccttaaacgtcggttacgggtacgtacccgtaagttacgggtttccttacccgttacccctaccccgttacggttacccccggtacccggggtaacctaacgttaaccccgtttaaaccaccggtaacccggtaaaccccgttaacccgtaacccccttaaccctaacccctaaaactaaaaccccgaccgtaacccgttaaccgtaaccgtaaggttaacgggttaacggtttacgggaacggtaccgtacccgtacggtaacccgttacgttacccggtaaccggtaaccggtaccccggtaacccgggtacccgttttaaccgttaccgttacccggtagggtacccgtaaccgggtaccgttaccccggtaaccccggaaccggttaccccggttaccggtaccgggtaacccggtcccggtaaccggtcccgggtaacccggttccccgggttaaccgtttccggttaaaccccgggttcggggtaacccccggggg

SEQ ID NO: 207928 - DNA, 832 bp, Homo sapiens
  misc_feature: GYAE6OF01CK860.17.25.C03.1.454.CMB.1.raw
  modified_base (384)..(384): a, c, t, g, unknown or other
  misc_feature (384)..(384): n is a, c, g, or t
  modified_base (558)..(558): a, c, t, g, unknown or other
  misc_feature (558)..(558): n is a, c, g, or t
tcagcgtagactagcacgaccggtgctcgatttagtagtgtagatttgggtttgggagtcagtctcagtcacggacacagcatggacatgacgggtccccgctcagctccgtggggctcctgctactctggctccgagctgccagatgtgacatccagatcgacccagtctccactccctccctgtctcgcctcgtggtcgggggtaccaagtacgtccaacctatcctaacgttcggaccggtaactaacggtccaaccgggttaaccgtttaaaaacttagttttaaaagttcggttaactcgagtactaaacggtaaaccgtacgggaaaaaccgccccaaacggtaccccttacgtacgtaaccgttccgtacgtggtcncctaactccctacgttcgcgacggtaggtcgaccgtacctacgtggtacgttacggaggtacgcgtaaggtacggtacgtccgggtagggaactaaggttacttacctaaactcctaccgtaaccataacccttaaccgccgtttacgacgtaccctaaccgtagggtaacgtntttacgggacgtaacttaacgttaccttaacggttaacccgtagtaaacccgtaacgttaacgtaaaccgggtttaccctaaaccccgggtttcccctaaccgggtttaacgttttaccccggggtttacggggaaaccccggttaaaaggggttaaacccgtaaacggtttaacgggaaccgttaaaccggtaaaacccggtaaacggtaccggtttacgggcccgggttaactaccggaaccctacgtttacgttccgtttccgttaacccg

SEQ ID NO: 207929 - DNA, 742 bp, Homo sapiens
  misc_feature: GYAE6OF01BC5X0.17.25.C03.1.454.CMB.1.raw
tcagcgtagactagcacgaccggtgctcgatttagtagtgtagatttgggtttggggggagtcagtctcagtcaggacacagcatggacatgagggtccccgctcacgctccgtggggctcctgctactctggcctaccggaactgccagatgtgacatccagtatcgaccagtctccatccctcctgtctgtccctgtgggtcgggtcagacgtccacactcgacgttcgccgactacgtcacggtaccttaaaactatttaaagtggtactcgagtcaaacgaaacctagggaaaaccctccacgtacctctcgtatcctcggttggtcctccgtaaccttcctaccgttaccggtaggtaccggtaacgggtcccggtccggttaacccccgttgggtacggtacgggttaccggaggtcggggacgtagggttacggtactcgggtaaacgtcgtaagtaacttaccgaacgttccctacctaccgttacctaccgtaacccaccgtccgtacgtaactaacccggtagtacggttcgtaggtaccgactaacgtacctacgtccgttaacgtagtaaccgtacgtaaccgttacgttacccgttcccgtccgttaccgttaccggttaccggaccggggtaacggtaacccggtaagtaccggtaagtaacgtaacgtaacgtaacggtccggtaacgtccgtaaccgtaccgacgttacctattccgttcgttacc

SEQ ID NO: 207930 - DNA, 825 bp, Homo sapiens
  misc_feature: GYAE6OF01CBDEJ.17.25.C03.1.454.CMB.1.raw
  modified_base (302)..(302): a, c, t, g, unknown or other
  misc_feature (302)..(302): n is a, c, g, or t
tcagcgtagactagcacgaccggtgctcgatttagtagtgtagatttgggtttggggactcgaacaaccacatctgtcctctagagtaaaaccctgtgagcacagctcctcaccatggactggacctggagatcctcgttcttggtggcagctagctacaagtgcccgactcccagttgcagctggtgcaggtcgtggggcgtgaggttgaacggtaaggcctggggcctcgagtcgaaggtcctcctgcaacggcttctgggtacttcccttactccgtatacgtactcaacgtcgggtcncgccgtacgccggcgtgggaccaacgtccgtgtacggtaggacgtggaacgtcggggtacaacccccgtaagaccgttggtgttcgtactaacggttccgtttaccttaccggaccctaacgtcccccggtacggtaccgaaacgtaacctttaacccgacgttaccggaaccccctaccggtaaaccttccctacccgtaaacctaaaacccgtacccgaacgtacccgtaaccgttaacgtaaccggggtacgtttaaccgggaacggtaacgtacccggtaccgttaaaccggctttaaacctccggggtaaaccgtacccggttaacccgggaacccggtttaccgttaaccgtttaacgttacgggtcgttaacgggttaacgtacccggtaaacccctccggggtaaaccgttaccggttcggaaccgggtaccccggttttccgggaaacccgtttcggggtacccggtaccccggttttaccgtaacccggttcgggttcccggggtaccccggg

SEQ ID NO: 207931 - DNA, 808 bp, Homo sapiens
  misc_feature: GYAE6OF01CSDKX.17.25.C03.1.454.CMB.1.raw
  modified_base (153)..(153): a, c, t, g, unknown or other
  misc_feature (153)..(153): n is a, c, g, or t
  modified_base (165)..(165): a, c, t, g, unknown or other
  misc_feature (165)..(165): n is a, c, g, or t
  modified_base (365)..(365): a, c, t, g, unknown or other
  misc_feature (365)..(365): n is a, c, g, or t
  modified_base (543)..(543): a, c, t, g, unknown or other
  misc_feature (543)..(543): n is a, c, g, or t
tcagcgtagactagcacgaccggtgctcgatttagtagtgtagatttgggtttggggactcaacaaccacatctgtcctctagagaaaccctgtgagcacagctcctcaccatggactggacctggaggacttcctcttcgttggtcgcagcngctacaaggtcnccctacgtccgaggtgcgagtcgtggtacgtcgtaggttcggtggggatgggaggtaggaaacggtcggtccggtcggggcccttaggaaggttaggtacggtcctaccgtaggacgttacgggtcttacggtacggttactttaccgttaccggttttacccttagtaagttacgttactaccgtaacgggtgggtacnccggtacgacggccgtacggacgtaaccgacgtcggtaggtgggtacgtaggtacgggtaacggtaccgggtaacccgtaaccgttaacggtggtacggttaccgttaacgacgttcggtttacgtccttaacccgacccgttacgttacccgaccggggtaacctacgtaccgttanaaccgtacgacccgtaactaccctactaacgtaacaacctacgactacgtaatagggttagtcggtacgacgggtactacgtaacgactttccggaacggttacccacggggaccctaccggttacttacgttaacgttctcgggtaaccggaccgtaaccgggtcccctaaccgggtaacggtcggttaacccggacggtaccccggttacggcggaccggtaccgttcggtttaccctaaaccgggtcgtccgggtaacgggg

SEQ ID NO: 207932 - DNA, 849 bp, Homo sapiens
  misc_feature: GYAE6OF01BYDU1.17.25.C03.1.454.CMB.1.raw
  modified_base (279)..(279): a, c, t, g, unknown or other
  misc_feature (279)..(279): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggacttccttctttcgttgggtaggcagcagcctaacaagtcgccccactcccgaggtcgcagtcgtggtcgactacggttcggtggggtctagggtaggtaggaaagacggtccggtcggggcctacgaggtaggaacggttcctccgnggacgtacgtcttaggtcgtacttccgttaaccgtttacctaccttaagtacttaacgtaccgtacggttcggggtcgtccggaccggacggcccgtacggtacggaaacccgaaccggtacgtaggaggtagggtaacggtggggtaacgtacccgggaacccgtaaacccgtaagtaccgggtaggttccgaccaaggttcgttaccgttaccctacccgaaccccgttccggtacccggaccgggaaccttaaccgttaacctaacccgtaacgtaccgaaccccgtaaccgtacccttacccctaactaaacctaaccgaacgttaaccgacgttaacgtaaggtacgggtaggttacgacggtaaccgtaccgtagaccgttacgtaccggtaccggaaccggtaccgtacccgggtacgttaacgtttaacgtacgtcgggtaacgaccggtaaccgggtaccctaacccggaggttccggtaccgggtacggaccggtacccgaccgggtaaccgtcccgggttacgttacgtttacccggtacggtccggggtaacccgggg

SEQ ID NO: 207933 - DNA, 810 bp, Homo sapiens
  misc_feature: GYAE6OF01AS14H.17.25.C03.1.454.CMB.1.raw
  modified_base (338)..(338): a, c, t, g, unknown or other
  misc_feature (338)..(338): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagcgtggtgctagtcgttggggccttaggaggttaggaaacggacgtccgttacgggggccttcgaggttcggaacggttcctccgtgaccgaagggttcctttccgtggtatttcctaccgtttacctaccttagttacgtactacctaacgtgggtacnccgcgacggccgcgtcgacacgcctgacggtagacgtgggacgtcgggacctaaccccgtagtacggtcggtactacacgtacgttcgttccgttacccacccgtacgtacccggtccggtacctaggtaacccgttacgaacgttccgaaacccgtaacccgttaacccgttaccctaaccccgtaaacgttaaacccgaacctaacccgggttacctaaaccgttaaccgggttagggttaaacccggttacgggtaacgggaacccgttaccgtaacgtaccgtaccgttaccgtacggaacccggtaccggtaacccgggtttaccctacgtttaccgttacgaccggttaccggtacggtaaccggttcccaaccggtaaccgttccgggtacgttaccggacgttaccccggacggtacggttacccggtccggttaactttcggaacccgtttcgggacccgggg

SEQ ID NO: 207934 - DNA, 814 bp, Homo sapiens
  misc_feature: GYAE6OF01EFO0P.17.25.C03.1.454.CMB.1.raw
  modified_base (187)..(187): a, c, t, g, unknown or other
  misc_feature (187)..(187): n is a, c, g, or t
  modified_base (242)..(242): a, c, t, g, unknown or other
  misc_feature (242)..(242): n is a, c, g, or t
  modified_base (311)..(311): a, c, t, g, unknown or other
  misc_feature (311)..(311): n is a, c, g, or t
tcagcgtagactagcacgaccggtgctcgatttagtagtgtagatttgggtttgggactcaacaaccacatctgtcctctagagaaaaccctgtgagcacagctcctcaccatggactggacctggaggatcctcttcttgggtggcagcagctaacgaagtcgcccactcccaggtgcagctggtnctagtcgtgggctaggaggtagaacgagtccgtgggcctgagtgacgtctaccgngcgtaaggtcttcgaggtacttaccgtacgtttaccctacttaatacgttactacgaaacgttgggtcncccgcgaccggccgtcgtacggaaccgtaaccgccgtggaacggtggtagtcgggtaagtaccgggaacccctaaacctaacgtacggtggtacgtacgacgtaggtccgttcctaccgaacccgtacggtcccgtaccggggtaaactacggtaacccttaacgtaacgtaccgaaaccctaaccgtaaccctccctaacaacgtaaaccacgacgtaccctagtacgtagggtacgttacggacggtaccgccgttacgtaaccgtacgtaccgtaacggaaccccggtaaacggtcccccggtttacgttaaccgttttaaacgttaccggtacggttacggtaacccggaaccggttaaccccggtaaccccgttacggtaccggttacccggggtaaccgtaacccgggaacccccggttaccggaacccgggttaccgttacccggggttacccggttttaaaccggtttcccggggttacggggtacccccggggg

SEQ ID NO: 207935 - DNA, 747 bp, Homo sapiens
  misc_feature: GYAE6OF01E113M.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcagtgaaggtcctccgtgacgaaggtctttcgtggtactttcacgttttaccctcctaatagtatcaacgtgggtgccgccacggcccgcgtacggaaccaaccggtaccgtggaggtggagtggggatcgggaccgaaaccctaacacgtggtcgtacaacgtagtcgttccttaccgacccctacgttccccggtaccggggaacaccgtaaccttaaccgactacggaaccctaaccgtaacccttcccctaccaaactaaaccgaacgaaccgtacctaacgtagttacgggtaaggtttacggaacgggtaccgtacctacggaacctacgttcgtaacggaacccggaccgtacccggggtaccgtttaccgttaactttaaccggcggtacggaccggtacggtacccgtacccccgtaaggtaccgttacccgggtacggtacccggtaccccgttaaccggggccgtaccgggtcccggtttaccctttacggtaccggtttcccgggtaccgggggg

SEQ ID NO: 207936 - DNA, 721 bp, Homo sapiens
  misc_feature: GYAE6OF01AM6FL.17.25.C03.1.454.CMB.1.raw
  modified_base (188)..(188): a, c, t, g, unknown or other
  misc_feature (188)..(188): n is a, c, g, or t
  modified_base (636)..(636): a, c, t, g, unknown or other
  misc_feature (636)..(636): n is a, c, g, or t
tcagcgtagactagcacgaccggtgctcgatttagtagtgtagatttgggtttggggactcaacaaccacatctgtcctctagagaaaaccctgtgagcacagctcctcaccatggactcggacctggaggactcctcttcttggtggcagcagctacgaagtcgcccactcccaggtgcagctggtncagtcgtggggctcggaggtgaaagaagccgtcggggcctcgaggtagaacggtccgtcgtgacaaggtcctttgtggtacttcctaaccgtttcctaccgtatgtactactaacggtgggtcgccgcgaggccgtcgtacggaaccaccgtacctaggagtaggtacgtagggtacgacgggtaccctaaacccgtaaccgtacgtggttccgtaccgtaacggtacgtcgttacccgtacccgtaccctacggtaccgtaccccggggactaacgttaacccttaccgaacgtaccgtaacccgtaaccgtaaccctcccgtaacccctaaacgtaaccacccgtaacggaccccttaacgtacggttacggtacggtacggtaacggtaccgtcaacggtacacgtacgtacgaaccgtacgtaccgggtcctacttattacggngtaccgtcggaacgtccgacgtaccgtacgtacggtacgccgtaccgtacgcgtaaccggtcgtacgttcgtcgtcgggtacggg

SEQ ID NO: 207937 - DNA, 647 bp, Homo sapiens
  misc_feature: GYAE6OF01EESTF.17.25.C03.1.454.CMB.1.raw
  modified_base (486)..(486): a, c, t, g, unknown or other
  misc_feature (486)..(486): n is a, c, g, or t
  modified_base (509)..(509): a, c, t, g, unknown or other
  misc_feature (509)..(509): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcgagtgaacggtctccgtgcgaaggtcttcgtggtactttcctacgttttacctacctattacgttatacctaacgtggggtacgccggccgacggcccgtcgtcgggaaccaacggtaccgtggtaggtgggagtggggacgtacggggaccgaaacccttaacgcgttgggtacgtacacgtacggttcgtaccgttccacccgtactcccggtaccggtacacgtacctacatacgaacccacgtacctacctacaataaacncacgctacagtcgagttagacgntacctgactactcgagaaccgacgacgggtccttatacgttctggtacgagtacggaccgtcccgaggtcggtccggtagacccggtaccggccgtccgaggttcccggttacgtttacgccgttcgggacccggggg

SEQ ID NO: 207938 - DNA, 807 bp, Homo sapiens
  misc_feature: GYAE6OF01AHTNM.17.25.C03.1.454.CMB.1.raw
  modified_base (446)..(446): a, c, t, g, unknown or other
  misc_feature (446)..(446): n is a, c, g, or t
  modified_base (532)..(532): a, c, t, g, unknown or other
  misc_feature (532)..(532): n is a, c, g, or t
tcagcgtagactagcacgaccggtgctcgatttagtagtgtagatttgggtttggggacgtcaacaaccacatctgtcctctagagaaaaccctgtgacgcacagctcctcaccatcggactggacctggaggactcctcttctgggtgcagcagctacagtcgcccactcccgaggtgcacgtccgtgggtcgacgtcggttcggtcgggggtctagggtacggtaggaaaacggaacggcccgggttcggggccccttggaaggtacggaaacgggttccctacccgttaggccgtaaacgggtccttttacggtacgggttactttccgtaaccgttttaccctaccgtattacggtactaccgtaacgttcggggtcacccggtccggaacggtccccgacgtcggaaccaaaccggtcctggaggtcggtagtcggggtanccgggtaccgtaacccttagccgtagggtacacgtacgtacggttcgtaccttacccgtaacccaccgttcccggacccgggtaancccggttaaccttacccgtattacccggaaaccctacggtacccctacccggtacctaaacctaacaccacgtaaccgaactagtaggtaaccgtgtaacggcgtacctcggacacgttcgtacgaaccggaccgtaccggtccgttactatttacgggacttacggaccgtaacggttacccggacccgtacgggttcccgacgggtacgtaccgacccggtacggccggttaccgtccggttaacccgtcggtccggttcgggtaccccgggg

SEQ ID NO: 207939 - DNA, 892 bp, Homo sapiens
  misc_feature: GYAE6OF01CNYRH.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtcgcagctggtgcagtcgtgggctgaggtgaagaacgccgtggggcctcgaggtacgaaggttcctccgtgacgtaaggtccttcgtacggtactttccgttaaccgttttacctaccgtattaaggtactaccgtaaacggttggggtccgaccgtccgaccggtcccgcggtacggaaccgaaccgtaccgtaggaggtagggtacgtcggggtaacggtccgggaacccgtaaaccccgtaacgtacggttacggttaccgtacgtaaccgtcggtttacgttacccgttacccgaacccgttaccgtacccggttaacccgggaactaacggttaacccttaaccgtaccgttaccgaacccgtaaccgttaacccctaccctaacctaaaacgtaacccaacccgaccgttaaccctaacggttacggtcggggtaacgttaggggtaacccggacgtacccgttaacgaacctttaccggtccggttaacccggaaacccggtacccggtaccccggggttaccgtttaccttaacgtttaccgggtacgttaaccgggaccgtaaccggttaccccgtacccggttaaacgggttcccgttaccccggggaagttacccccgggttaacccggtaaccggtaccgtacccggggggttccccgttttacgtttacccgggtaacccggtttcccggggtaaccccgggggg

SEQ ID NO: 207940 - DNA, 723 bp, Homo sapiens
  misc_feature: GYAE6OF01EM1YK.17.25.C03.1.454.CMB.1.raw
  modified_base (377)..(377): a, c, t, g, unknown or other
  misc_feature (377)..(377): n is a, c, g, or t
  modified_base (385)..(385): a, c, t, g, unknown or other
  misc_feature (385)..(385): n is a, c, g, or t
tcagcgtagactagcacgaccggtgctcgatttagtagtgtagatttggggtttgggggactcaacaaccacatctgtcctctagagaaaaccctgtgagcacagctccctcaccatggactggacctggaggatcctcttcttggtggcagcagctagaagtcgcccactcccaggtgcagctggtgcagtcgtgggtctggaggtagaagaggccgtggggcctcgaggtcgaacggtcctcgtgacgtaacggtcttcgtggtacttccgtacctttaccgtcctattagtactactacgtggtacgccgtccgacggcccgtcgtacggaccaacgaccgtgaggtggaggtggagtcggacgaacctaacgngtacggtntacgagtacgtcgttctaccgccctacgtccgtaccggacacgtacctacgacgtaccgaacccactaccctcctaaccaactaaaccacacgtaccaagtagtacgggtagttaacggagtccggtaactacggtaataccgtactacggggaaacccgtaacccggtacccggttacccgtttaacgtttaaccgtttacggtaccggtcggtaacggaccgggttaaaccccgtacccgtaccgggttccgtaaccggggtactaccggtacccgggtaccgtcggtacccggttacccggttacggtttcggtaccggtttccgggacccgggg

SEQ ID NO: 207941 - DNA, 757 bp, Homo sapiens
  misc_feature: GYAE6OF01D2O6W.17.25.C03.1.454.CMB.1.raw
  modified_base (624)..(624): a, c, t, g, unknown or other
  misc_feature (624)..(624): n is a, c, g, or t
tcagcgtagactagcacgaccggtgctcgatttagtagtgtagatttgggtttggggactcaacaaccacatctgtcctctagagaaaaccctgtgagcacagctcctcacatgactcggacctggaggatccttcttcgttggtggcaggctagacctaacgtaacggtcgacccctacgttcccgagggttcgctacgcgttgggtcgactaggtcgtggggctaggtaggtacgaacgaggtccgtcggggccttagaggtaggtacggttcctaccgtgacgtaggtccttcgtggtactttaccgtaccgttttaccaccttagttacgtacttaccggtaacggtcgggtacaccggtacgtaccggtaccgacggttacgaaacgtaaccggtcgtgggtacgggtaggtagggtcgggacgtaccggaaccgtaaccctaacggtacggtcggtacaccgtaagtacggttccttaccctaccggaacccgtcccgtttcccggacgggaccttaaccggttaccctacgtaacggtacccgaccttaacgtaccctacccgaactaacgtaaccactaccgactaacgtgaacgtttggacgtacgcgtaccgtntactgacgtacggaccgacggtcgtacttattacgtcggtacgtgaccggttaccaccggtacgtccggtcggtacgacgtcggaccgtacggacgtcggttaccgtacggtttcgtcggttcggaaccgggg

SEQ ID NO: 207942 - DNA, 675 bp, Homo sapiens
  misc_feature: GYAE6OF01CNMUO.17.25.C03.1.454.CMB.1.raw
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtgcagcagctacaagtgcccactcccgaggtgcagctggtgcgagtcgtgggctgaggtgaagagccgtggggcctgagtgaaggtctcgtgactaaggcttcgtgattctacgtttacctcctatagtatacaacgtggtgccgcgtaggccgcgtacggaacaaccgtaccgtagaggtacggtagtgggacgtcgggaccgtaaacccgtaacgacgtggtcgtacgacgtagttcgtaccgttacgaccctactccgtaccggaactacgtaacccttacgacgaccgaaccaacgtaaccctacccgtaccaaactaaaacctacgaaccgtacccgtaacgacgtttaggtaacggttaggaacggacgtaccgtacgaacgtacttaacgtacggaaccgtacggaccgttaccgtactttaacgttacgtcgtcggacgtacgacgtacccgaaggtacccgtcggtacgtacgaccgtacggtacgtacgtccggtaccgtttgtaccgttcggtaccgggg

SEQ ID NO: 207943 - DNA, 741 bp, Homo sapiens
  misc_feature: GYAE6OF01EM1H9.17.25.C03.1.454.CMB.1.raw
  modified_base (189)..(189): a, c, t, g, unknown or other
  misc_feature (189)..(189): n is a, c, g, or t
  modified_base (253)..(253): a, c, t, g, unknown or other
  misc_feature (253)..(253): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcaacagtctaacaagtcgcccactcccgaggtgcagctggtcncagtcgagggctgagtgaagacgcgtgggcctcgagtggacgtctccgtagacaggtccttcgnggtacttaccgttaccgtttacctactagttacgtacgttacgtacggtcgggtcgaccggaccgacggtccgacggtacggaaccaccggtcgtaggtacggtggtaggtcgggtacgtaccgggtaaccctaacccgtacggtcggttacggtacgtacgacgtaccggttacttaccctacccgaacccgtaccgtacccggtacggtactaacgtacctacgactaccgaacccgtaaccgtacccttacccaaacgtaaactaaccgtacgtaaccgtaaccgtagtacgggttacggtacggtacggaacgccgtacctacgtacgtccgtagaaccggaccgaccggtaccggtccgttaacgttacgttactcgggtacgacggtaccgtacccgtaccggaacgttaccgggcggtagacggtacccggacggacgttccgggttccttacgtaccggtcggttcggggccggtaacgg

SEQ ID NO: 207944 - DNA, 710 bp, Homo sapiens
  misc_feature: GYAE6OF01EA9X1.17.25.C03.1.454.CMB.1.raw
tcagcgtagactagcacgaccggtgctcgatttagtagtgtagatttgggtttgggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagaagccgtggggcctcgaggtgaaggtcctccgtgacaaggtcttcgtggtacttccgtacgttttacctaccttatagttatcgtaacgtggggtcgccggtccgacggcccgtcgtacgggaaccaacggtacccgtggtaggtggaggttggggaagttcggggaacccgtaaaacccctaacgtacgttcgggtactaccaacgtagttcgttccttaccacccgtacgtcccgtaccgggactacgtaccttaccatcgaaccgacgtaacctcctacaactaaccacacgtacctagagtacgggtagttacgacggtacgccgtagacctagtcgtacgaaccgtaccgaccgggtccgttacttacgttacgtgtcggaacgtacgtaccggtaccccgtaacggtaccggttaccgggaccgaccgggtacccgtacggacccggtcggttacccgggttacccgtttacgggtccgtttcggggtacccggggg

SEQ ID NO: 207945 - DNA, 637 bp, Homo sapiens
  misc_feature: GYAE6OF01CPWT9.17.25.C03.1.454.CMB.1.raw
  modified_base (286)..(286): a, c, t, g, unknown or other
  misc_feature (286)..(286): n is a, c, g, or t
  modified_base (297)..(297): a, c, t, g, unknown or other
  misc_feature (297)..(297): n is a, c, g, or t
  modified_base (478)..(478): a, c, t, g, unknown or other
  misc_feature (478)..(478): n is a, c, g, or t
tcagcgtagactagcacgaccggtgctcgatttagtagtgtagatttggttttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtgggggcctcgaggtgaaggtctccgtgcaggcttcgtggattcacgtttcctcctatagtatcaacgtgggtncgccaggccgntcggacaacgcctggacgtggactggggagtcggggaccgtaaccccgtaagaccgttgggtacgtccgacgaggttgtccttacaccctctccgtccgggacacgtacttaccatcgaaccaccgtaactccctacctaacaaaccacacgaccctaacacgtggacgtttagagggacnccgtagacacttcgacggacgtaccgacgggtccgttactacgtttaccgtggtcgacggtacggaaccgtccccgaacggtattcccgggtacgacgggtccccgtaacggggcgtacggtcccgggtacctttcggacccgtttcgggtaccggggg

SEQ ID NO: 207946 - DNA, 855 bp, Homo sapiens
  misc_feature: GYAE6OF01B6YG1.17.25.C03.1.454.CMB.1.raw
  modified_base (170)..(170): a, c, t, g, unknown or other
  misc_feature (170)..(170): n is a, c, g, or t
  modified_base (471)..(471): a, c, t, g, unknown or other
  misc_feature (471)..(471): n is a, c, g, or t
  modified_base (481)..(481): a, c, t, g, unknown or other
  misc_feature (481)..(481): n is a, c, g, or t
  modified_base (532)..(532): a, c, t, g, unknown or other
  misc_feature (532)..(532): n is a, c, g, or t
  modified_base (558)..(558): a, c, t, g, unknown or other
  misc_feature (558)..(558): n is a, c, g, or t
  modified_base (595)..(595): a, c, t, g, unknown or other
  misc_feature (595)..(595): n is a, c, g, or t
tcagcgtagactagcacgaccggtgctcgatttagtagtgtagatttgggtttgggggagtcagtctcagtcaggacacagcatggacagtggacgggtcccccgctcagccttccgtggggcctcctgctactcgtggcctccggagctcgccaagtgtgtcgactacnccgaagactccgaaccctgttcctaccacttcccctcccttgtccgtcgtcccgttgggttcggggtacgggggtacacggttaccgtacccgaacctacggttaccctaccggttaccgggacccgggtaaacctaaccggtaacccgtaaaccgggttaaaaacccctttttaaaaacttttaagttttaaaaggttcgttaataccgtaaacgaacgtaaaaaccggtaaaacccgttaacgggaaaaccccgccctaaacgtcccttcgaaggttcctcgtacgtggtcaccttacncctagtacgngaccggaagtcgaccccgtgtacgtggacgttgaggtgtacggtaggtcgngtacgggagactttacgtactttacnccttacaaccgtctaccgtaccaacctcgtaaccgtntaacccgtagttaggtacgttacgttacgtaccgtaaacttacccttacggttaacctacttaacggtaacgttaacttaccggttaaacggttttcccctaccccgttacccgttaaccggttccgtttaaccggtccggtaaaccggtaacggtaaggttaccgtaaacgtaacccgttaacgtaacccggtaaacggttcgggaccgtttacgacccgtttacaccgttaacgtttcttccgttactttaaccccgg

SEQ ID NO: 207947 - DNA, 891 bp, Homo sapiens
  misc_feature: GYAE6OF01CYNVS.17.25.C03.1.454.CMB.1.raw
tcagcgtagactagcacgaccggtgctcgatttagtagtgtagatttgggtttgggggactcaaacaaccacatctgtcctctagagaaaaccctgtgagcacagctcctcaccatggactggaccgtgggaggactccttcttcgttgggtggacctagacaacgcctaacaaggttccgccccaaccttacccgagggtcgacgacgtcgtgggtacgcgtaggtcggtcgggggctaggtacgggtagaaggtacgtccggtcggggtacctacggtaggtacggtaacgggttcctaccgtaggacgtaacggtcttcgtacggtacttccgttaccgttacctctaagtactactacgtaacgtgggcaccgccgtacggccgtacggtacgaaccgtacgtcgtacggtagggtacggaacggtcgggtaaccggtaacggggtaacccctaaaccctaaacggtccggttcggggtactaacccgtagtaacggtttcccggttaccttaaccccggaaccccttaccggtacccgggttaacccgggggaaacttaaaccggttaaaccgttaaccctaacggtaacccggtaacccgttaaccgtaaccccttacccgttaaaccaaaacctaaccgaacccgtaaccgttaccctaaaaggtcggttaacgggtacggttacgggtaaccggtacgccccgtttaaggaacccttaaccggtaacgttaaccgggaaacccgtacccgggtaaccggtttccgtaattaccggtaacgtcggtacggacgtacgtacccgtaccgaacggtaccggtcggacggtacgcccgggtaagtcgtaaccggttccgttaatcccgggtagttggggaccccggg

SEQ ID NO: 207948 - DNA, 869 bp, Homo sapiens
  misc_feature: GYAE6OF01DOMMD.17.25.C03.1.454.CMB.1.raw
  modified_base (145)..(145): a, c, t, g, unknown or other
  misc_feature (145)..(145): n is a, c, g, or t
tcagcgtagactagcacgaccggtgctcgatttagtagtgtagatttgggtttgggactcaacaaccacatctgtcctctatagaaaaccctgtgagcacagctcctcaccagtgactggaccgtggaggatcctcttcgttggnggcagcagctacgaacgtcgccctacctcccgaaggtcgcagcgtggtacgacgtaggtccggtggggtctaggtagggtacgaaacggaacggtcccggtcgggggtaccctacgtagggtacggtaacggttccctccgtggacgtaacggtcttacgtaggactttaccgtacgtttacctactatacgtactacgtaacggtgggtcgaccgaccgtacgggtcccgacggtacggaaccgtaaccggtacgtagggtaggtacgggtagtacggggtaacggtcgggaaacccgtaaacccctaagtggttacggtactaccgaagtacgttcgtaccccgttacccgaacccgttaccggtcccgtaacccggggaacttaacccggtaacccgttaaccgtacgtaacccgaaaccccgtaaccgttaacccgtaccccttaaacctaaacttaaaccccgaacgtaaccgtacccgttaaacggtaggttaacgggttaacgggttacgggaaaccgggtaccgtacgtaacggtactaacgtaccggaccggaaccgtaaccggtacccggttaccgttaactttacgtaccggtacgacggtaaccggtaccgtaccgtacccgtacggtacccgttacgggcgtaccccggtaccgtaccggaccgtacgggttcccgtacgttttaccggcccggttcggggtaacccgggg

SEQ ID NO: 207949 - DNA, 770 bp, Homo sapiens
  misc_feature: GYAE6OF01A3OWY.17.25.C03.1.454.CMB.1.raw
  modified_base (190)..(190): a, c, t, g, unknown or other
  misc_feature (190)..(190): n is a, c, g, or t
  modified_base (241)..(241): a, c, t, g, unknown or other
  misc_feature (241)..(241): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcgttggtggtagcagctacaagtcgcccactcccaggtcgcagctggtgcngtcgtggggctgaggtgaagaacgccgtggggcctcgagtggaagtctccngcaaggtcttcgtggattcgaccgtttacctccttataggtactctaacgttggggtcgcgccgagggcccgtctacggtaccgaaaccgacccgttgaaggtgggaacgttggggtactcggggaccgaaaccccgtaacacgttggtacggtccaacgtaggttcgttccttaccgaaccctacgtcccgtcccgggaactacgtacccgttaaccacgtaccgaaccctaacccggtaacctaccctaccaaactaaaccactaaccgacctaacgacgtagggtacgtttacgggaacgggtacggtacccgacggtaacctacgtaccggtacggtaacccggaaccggtacccgggtcccgttacgtttaacttccgtacggttcggtaccggaacggtcccggtaaccccgaacccggtacggttacccggggtaggaccggtcccggaacccggtcgtacccggtacccgggttcccgttttaccgtaccggttttcccggggccggggttaaccccgggg

SEQ ID NO: 207950 - DNA, 790 bp, Homo sapiens
  misc_feature: GYAE6OF01BET9F.17.25.C03.1.454.CMB.1.raw
  modified_base (314)..(314): a, c, t, g, unknown or other
  misc_feature (314)..(314): n is a, c, g, or t
  modified_base (430)..(430): a, c, t, g, unknown or other
  misc_feature (430)..(430): n is a, c, g, or t
  modified_base (453)..(453): a, c, t, g, unknown or other
  misc_feature (453)..(453): n is a, c, g, or t
tcagcgtagactagcacgaccggtgctcgatttagtagtgtagatttgggtttggggactcaacaaccacatctgtcctctagagaaaaccctggtgagcacagctcctcaccagtggactggacctggaggatcctcttcttggtggcagcagctacgagtcgcccacctcccgaggtgcaggcgtggtcgctagtcgtgggtctggaggtagaaggaacgccggtcggggcctcgaggtagtaacggtcctccgtgacgaacggtcgttcgtggtacttccgttaaccgtttccctaccgttagtagttacnccgtaacgtcgggtacgccggtccgacggtccgccggtacggaaccgtaaccggccgtaggacggtcggaggtgggacgtccgggacccgtaaaccctacgtacgtcggtcgtacncggtacggttcgtccgttacccncccgtaccgtcccggacggtaaccgtaacgtaacccgttcgaaccgtcccgtaaacccgtaccgtaaccttacccgtaactaaccgtaaacccgtacgaccgtacccgtaagacggttagggtacgtagggtacggtacgtacgtagtactacgttacgacggtaacccggaccggtaaccggtacccgttaccgttacgttccgtcgggtaccgacgggttaccgacccgtacccggtaccggtaccgggttacggtacccgggtccgtaaccccggccgggtacggtacccggtccggtttacccgtttacgtcccggttccggggttaccgggg

SEQ ID NO: 207951 - DNA, 865 bp, Homo sapiens
  misc_feature: GYAE6OF01A57ND.17.25.C03.1.454.CMB.1.raw
  modified_base (850)..(850): a, c, t, g, unknown or other
  misc_feature (850)..(850): n is a, c, g, or t
tcagcgtagactagcacgaccggtgctcgatttagtagtgtagatttgggtttgggagtcagtctcagtcaggacacagcatggacatgagggtccccgctcagctcctgggctcctgctactctggctccgagctgccagatgtgacatccagatgacccagtcctccatcctcctgtctgcctcgtggtgggggtcaggactccaacctatcgtacttcggaccggaactaaacggtcgtaaccgggtacgtttaaaaaacccgttattttaaaagttggggtaacttcgaaacggaccaagtaaaaacccgttagggaaaaaacggtcccccaaggtaaccccgttcgttacggtaacttccgttccgtaggggttcgcctaacgttaccgaaccgttctacggcgggtaaaaggtccgggtaccgtttaccccgaaggttcccggtaggggtttaaccgcggggtttacgggaccgttagggtagggtaacggttcccgttagggggaacctaaacgggtaactttttacgaaacttacccgtaacctaaccctaacgttaccctaaacccttaaccgtttcttacggtaacccgttaaaaccgttcggtaaacggggttatttccgggtaagtaaccgtaactttaaccgtaacttaccgttacggtaacccctaagtaccggttaaccgtttacgaacccgggtttccccttaccggtaccgttaaccggttttccggaacccgggtaaaggggtaaccccgttaaaggtaggtaaccgtaacgtaaccgtaaacggtacgtttacgggacggttaacccgtcgtaaccgtaaccgtttaccgngtttacgggttaccc

SEQ ID NO: 207952 - DNA, 782 bp, Homo sapiens
  misc_feature: GYAE6OF01DDTQM.17.25.C03.1.454.CMB.1.raw
  modified_base (312)..(312): a, c, t, g, unknown or other
  misc_feature (312)..(312): n is a, c, g, or t
tcagcgtagactagcacgaccggtgctcgatttagtagtgtagatttgggtttggggactcaacaaccacatctgtcctctagagaaaaccctgtgagcacagctcctcaccatggactcggacctggaggatcctcttcgttggtgcagcagctacaagtcgcccactccgaggtgcagctggtgcagtcgtggggctaggaggtagaaggaacgtccgtggggccttcgaggtagtacggtcctcgtgacgtaggtcttacgtggtacttacgtaccgtttacctcttatagtactcctaagttgggtcncggccgtacggccgtacgtacgaaccgtaaccgaccgtggaacggtgggtagtgggacgttcgggacctaaaccctaacgtcgtcggtacgtcgacgtaggttctccgttaccacccgtacgtcccggtaccggactacgtaactttaccgactaccgacccgtaacgtaaccccttacctaacctaaactaaacctaccgaacctacctaacgtacggttacgggtacgttaccgggaaggtaccgtaccgttacggaacccgttacgttaccggaaccggtaacggtaccccggtaaccgggttacccttacgttaacctttaccggtcgggtaggtaacccgtaaggtccccgttaaccgaccgggtaccggttacccgggtacggttaccccggtacggttacccgaccgggttaccggtacccggtttccgtttaccgggtcccggtttccgggtacccgggggg

SEQ ID NO: 207953 - DNA, 505 bp, Homo sapiens
  misc_feature: GYAE6OF02I3PKN.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtacaacagagttacacgttcccctcgcctacgtttcggaccgaggggacctaagttgaagatacgaaacgactgtggctcgccaccattctgtc

SEQ ID NO: 207954 - DNA, 492 bp, Homo sapiens
  misc_feature: GYAE6OF02JZ4ZM.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgagattgtgcaatctactactgtcaacagagttacacgttccctcgtctacttttcggccgtagggaccaagttgagatacaaacgaactgtgctgcacatctgtc

SEQ ID NO: 207955 - DNA, 585 bp, Homo sapiens
  misc_feature: GYAE6OF02GSSU8.17.25.C03.1.454.CMB.1.raw
  modified_base (277)..(277): a, c, t, g, unknown or other
  misc_feature (277)..(277): n is a, c, g, or t
  modified_base (288)..(288): a, c, t, g, unknown or other
  misc_feature (288)..(288): n is a, c, g, or t
  modified_base (336)..(336): a, c, t, g, unknown or other
  misc_feature (336)..(336): n is a, c, g, or t
  modified_base (438)..(438): a, c, t, g, unknown or other
  misc_feature (438)..(438): n is a, c, g, or t
tcagcgtagactagcacgaccggtgctcgatttagtagtgtagatttgggtttggggacgtcaacgaaccacatctgttcctctagagaaaccctgtgagcacagctcctcaccatggactggacctggaggatcctcttcttggtggcagcagctacaagtgcccactcccaggtgcagctggtgcagtctgggctgaggtgaagagcctgggctcagtgaggtctcctgcaaggcttctggattcacgtttacctctatagtattcaactgggtncgccaggccgntggacaacgacctgagtggatgggatgggacgaaccctaacactggtntcacgagtgtcttcacccatcctccgggacagacttaccagtgaccagtaacctcctaccaataaaccacacgcccttaacagttcggagtttgagggtacncctagactattcgtagaaccgtacgtaccgggcccgttattaactttaacgtgtacgcggaagtacgttccccaacgggtactcccgggtagaccgcccgttaggaccgagggtcccggtaccttttaggacctttggtaccggggg

SEQ ID NO: 207956 - DNA, 519 bp, Homo sapiens
  misc_feature: GYAE6OF02HUQUW.17.25.C03.1.454.CMB.1.raw
  modified_base (455)..(455): a, c, t, g, unknown or other
  misc_feature (455)..(455): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggcgaaccctaacactggtgtcacagtgtcttcacccatcctcgggacagacttaccatgaccacgaactcctccataaacacagcctacatggagttgaggagcctgacatctgacgacacggccgtctattacngtgcgagacgtcccacggatccggtgacgcctacggcaggccggtcctttgaccttcgtcgggg

SEQ ID NO: 207957 - DNA, 500 bp, Homo sapiens
  misc_feature: GYAE6OF02I6IG1.17.25.C03.1.454.CMB.1.raw
  modified_base (432)..(432): a, c, t, g, unknown or other
  misc_feature (432)..(432): n is a, c, g, or t
tcagcgtagactagcacgaccggtgctcgatttagtagtgtagatttgggtttgggagtcagtctcagtcaggacacagcatggacatgagggtccccgctcagctcctgggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctctgatctctggtgcatccactctgcgaagtggcgtcccatcgaggttcagtggcagtgatctgggacagatttcaatctcaccatcaccactctgcaacctgaggattgtgcaattctactactgtacaacagagttacacgtttccccncgtcctacgtttcggcctaggggacctaaggttgagtactacaaacgactgtggctgcaccatctgtc

SEQ ID NO: 207958 - DNA, 522 bp, Homo sapiens
  misc_feature: GYAE6OF02JBRJE.17.25.C03.1.454.CMB.1.raw
  modified_base (477)..(477): a, c, t, g, unknown or other
  misc_feature (477)..(477): n is a, c, g, or t
  modified_base (483)..(483): a, c, t, g, unknown or other
  misc_feature (483)..(483): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatgggcgaaccctaacactggtgtcacagtgtcttcacccatcctccgggacagacttaccatcgaccacgaacctcctccaataaacacagcctaacatggagttgaggagcctgacatctgacgacacggccgtctattactgtgcgagcgtcccacgntccggngacgcctacggcacggccggtcctttgacttcgtcgggg

SEQ ID NO: 207959 - DNA, 497 bp, Homo sapiens
  misc_feature: GYAE6OF02I0AHV.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagattcaatctcaccatcaccactctgcaactgagatgtgcaatctactactgtacaacagtagttacacgttccctcgcctacttttcggaccagggaccaaggttgagatacaaacgtaactggtgctgccacactctgttac

SEQ ID NO: 207960 - DNA, 515 bp, Homo sapiens
  misc_feature: GYAE6OF02JE8UF.17.25.C03.1.454.CMB.1.raw
  modified_base (259)..(259): a, c, t, g, unknown or other
  misc_feature (259)..(259): n is a, c, g, or t
  modified_base (279)..(279): a, c, t, g, unknown or other
  misc_feature (279)..(279): n is a, c, g, or t
  modified_base (330)..(330): a, c, t, g, unknown or other
  misc_feature (330)..(330): n is a, c, g, or t
  modified_base (450)..(450): a, c, t, g, unknown or other
  misc_feature (450)..(450): n is a, c, g, or t
  modified_base (476)..(476): a, c, t, g, unknown or other
  misc_feature (476)..(476): n is a, c, g, or t
  modified_base (483)..(483): a, c, t, g, unknown or other
  misc_feature (483)..(483): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggcctcagtgaaggtctcctgcaaggcttctggattcacgtttaccncctatagtatcaactgggtncgccaggccgctggacaacgacctgagtggatgggatgggcgaaccctaanactggtagtcacagtgtcttcacccatcctccgggacagacttaccatgaccacgaactcctccaataaacacagcctacatggagttgaggagcctgacatctgaccgacacgggcctntaattactgcgcgagacgtcccaggntccggtnagcctaggcaggcggcctttgaccttgcgggg

SEQ ID NO: 207961 - DNA, 536 bp, Homo sapiens
  misc_feature: GYAE6OF02GSGNF.17.25.C03.1.454.CMB.1.raw
tcagcgtagactagcacgaccggtgctcgatttagtagtgtagatttgggtttgggggaccatatttggactcaactctcttgtccaccttggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggattgaggagcctgacatctgacgacacggccgtctattactgtgcgagagtcccacgatccggtgagcctacggcagcggcctttgacttctggggccagggagccctggtcaccgtcacgtcagcttccaccagggcccatccgtcttcccctgccgccctgcctccgacggacgccacctccgagacgcaccacgcccgcccgtgggccg

SEQ ID NO: 207962 - DNA, 492 bp, Homo sapiens
  misc_feature: GYAE6OF02HS3JV.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaaacctatttaaaattggtatcagcagaaacctggaaaagccccagacctcctgatctctggtgcatccactctgcgaagtggcgtcccatcgaggttcagtggcagtggatcgtgggacagatttcaattctcaccatccaccactctgcaacctgagattgtgcaatctactactgtcaacagagttacacgttccctcgtctactttgccagggaccaagttgagatacaaacgaactgtgctgcacatctgtc

SEQ ID NO: 207963 - DNA, 526 bp, Homo sapiens
  misc_feature: GYAE6OF02IZX4E.17.25.C03.1.454.CMB.1.raw
  modified_base (394)..(394): a, c, t, g, unknown or other
  misc_feature (394)..(394): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatgggcgaacctaacactggtgtcacagtgtcttcacccatcctccgggacagacttaccatcgaccacgaacctccnccaataaacacagcctacatggagttgaggagcctgacatctgacgacacggcctctattactgtgcgagacgtcccacggatcccggtgacgtccgtacggcacggccggtctttcggaccttcgtcgggg

SEQ ID NO: 207964 - DNA, 508 bp, Homo sapiens
  misc_feature: GYAE6OF02GIPEO.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgagttcagtggcagtggatctgggacagatttcaatctcaccatcaccactctgcaacctgaggattgtgcaatctactactgtacaacagagttacacgttcccctcgcctacttttcggccgaaggggtacctaagttgagtaactacaaacgtaactgtaggctgccaccattctgttcc

SEQ ID NO: 207965 - DNA, 513 bp, Homo sapiens
  misc_feature: GYAE6OF02F3QWC.17.25.C03.1.454.CMB.1.raw
  modified_base (447)..(447): a, c, t, g, unknown or other
  misc_feature (447)..(447): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctcgggacagacttaccatgaccacgaactcctccataaacacagcctacatggagttgaggagcctgacatctgacgacacggccgtntattactgtgcgagacgtcccacgatccggtgacgcctaggcaggccggctttgacttcgtcgggg

SEQ ID NO: 207966 - DNA, 515 bp, Homo sapiens
  misc_feature: GYAE6OF02ICKFB.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgacgcctacggcaggccggcctttgaccttgtcgggg

SEQ ID NO: 207967 - DNA, 521 bp, Homo sapiens
  misc_feature: GYAE6OF02G28T2.17.25.C03.1.454.CMB.1.raw
  modified_base (426)..(426): a, c, t, g, unknown or other
  misc_feature (426)..(426): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatcgaccacgaactcctaccaataaacacagcctacatggagttgaggancctgacatctgacgacacggccgtactattactgtgcgagacgtcccagctccggagacgcctacggcaggccggtcctttggacttcgtcgggg

SEQ ID NO: 207968 - DNA, 489 bp, Homo sapiens
  misc_feature: GYAE6OF02HA9NY.17.25.C03.1.454.CMB.1.raw
  modified_base (391)..(391): a, c, t, g, unknown or other
  misc_feature (391)..(391): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtccatcgaggttcagtgcagtggatctgggacagatttcaatctcacatcaccactctgcaacctgagattgngcaatctactactgtacaacagagttacacgttcccctcgctactttggccaggggaccaagttgagatacaaacgaactgtggctgcacatctgttc

SEQ ID NO: 207969 - DNA, 528 bp, Homo sapiens
  misc_feature: GYAE6OF02JA399.17.25.C03.1.454.CMB.1.raw
  modified_base (280)..(280): a, c, t, g, unknown or other
  misc_feature (280)..(280): n is a, c, g, or t
  modified_base (406)..(406): a, c, t, g, unknown or other
  misc_feature (406)..(406): n is a, c, g, or t
  modified_base (413)..(413): a, c, t, g, unknown or other
  misc_feature (413)..(413): n is a, c, g, or t
  modified_base (423)..(423): a, c, t, g, unknown or other
  misc_feature (423)..(423): n is a, c, g, or t
  modified_base (430)..(430): a, c, t, g, unknown or other
  misc_feature (430)..(430): n is a, c, g, or t
  modified_base (453)..(453): a, c, t, g, unknown or other
  misc_feature (453)..(453): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatggggatggggcgaaccctaacacgtggtgtcacagtgtcttcgacccatcctcgggacagacttaccatcgaccacgaactcctacaataaacncagctanatgattgagnctgacanctgacgacgacgcctctattacngtgcgagtcgtccagtacgtccggtagacgtccgtacggcctaggccggttacccttggtaccttcggtacgggg

SEQ ID NO: 207970 - DNA, 491 bp, Homo sapiens
  misc_feature: GYAE6OF02FJHJR.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtccatcgaggttcagtggcagtggatctgggacagatttcaatctcaccatcaccactctgcaacctgagattgtgcaatctactactgtcaacagagttacacgttcccctcgctacttttggccaggggaccaagtgagatacaaacgaactgtggctgcaccatctgttc

SEQ ID NO: 207971 - DNA, 523 bp, Homo sapiens
  misc_feature: GYAE6OF02GDAZF.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatggggcgaaccctaacactggtgtcacagtgtcttcacccatcctccgggacagacttaccatgaccacgaactcctccataaacacagcctacatggagttgaggagcctgacatctgacgacacggccgtctattactgtgcgagacgtcccacggactccggtgacgccgtacggcaggccggtcctttgaccttcgtcgggg

SEQ ID NO: 207972 - DNA, 525 bp, Homo sapiens
  misc_feature: GYAE6OF02HWE4Y.17.25.C03.1.454.CMB.1.raw
  modified_base (332)..(332): a, c, t, g, unknown or other
  misc_feature (332)..(332): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatgggcgaaccctaanactggtgtcacagtgtcttcacccatcctccgggacagacttaccatcgaccacgaactcctccataaacacagcctacatggagttgaggacgcctgacatctgacgacacggccgtctattactgtgcgagacgtcccacggatccgggtagacgccctaacggcaggccggtcctttgacttcgtcgggg

SEQ ID NO: 207973 - DNA, 500 bp, Homo sapiens
  misc_feature: GYAE6OF02H8GQS.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtgcagtggatctgggacagtatttcaatctcaccatcaccactctgcaacctgaggattgtgctaatctaactactgtacaacagagttacacgttccctcgtctactttcggcctagggaccaagttgagtatacaacgaactgtggctgccacctatctgtc

SEQ ID NO: 207974 - DNA, 510 bp, Homo sapiens
  misc_feature: GYAE6OF02JGQWC.17.25.C03.1.454.CMB.1.raw
  modified_base (379)..(379): a, c, t, g, unknown or other
  misc_feature (379)..(379): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaaattggtatcagcagaaacctggaaaagccccaagacctcctgactctctggtgcatccactctgcgaagtgcgtccatcgaggttcagtgcagtggatctgggacagatttcaatctcacatcacactcncgacaactgagatgtgcaatctactactagtcaacagtacttacacgttcccctagccttaactttcggcctaaggggtacctaagttgaacgtactacaaacgaactgtagctcgacaccatctgttacc

SEQ ID NO: 207975 - DNA, 602 bp, Homo sapiens
  misc_feature: GYAE6OF02JEDWD.17.25.C03.1.454.CMB.1.raw
  modified_base (263)..(263): a, c, t, g, unknown or other
  misc_feature (263)..(263): n is a, c, g, or t
  modified_base (343)..(343): a, c, t, g, unknown or other
  misc_feature (343)..(343): n is a, c, g, or t
  modified_base (347)..(347): a, c, t, g, unknown or other
  misc_feature (347)..(347): n is a, c, g, or t
tcagcgtagactagcacgaccggtgctcgatttagtagtgtagatttgggtttggggtacgtcaacaaccacatctgtcctctagagaaaaccctagtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttaccncctatagtatcaactgggtgcgccaggccgctggacaacgacctgagtggatggggatgggcgaaccctaagactgggtntcanagtgtcttcacccatcccgtccgggacagacttaccatcgaccacgaactcccctcaacgtaaaccacacgacctacagtggtagttgaggaacgcctagaaccatcgtacggaaccgaccgaccggggcccttacgttaacttcgtacgtcggacggacgtaccgtaccccgaacggtaccggttaccggttaggaccgtacccgtacggacgtacggcccggttcccgtttaggtacccgttcggtccggggg

SEQ ID NO: 207976 - DNA, 517 bp, Homo sapiens
  misc_feature: GYAE6OF02HNY2G.17.25.C03.1.454.CMB.1.raw
  modified_base (279)..(279): a, c, t, g, unknown or other
  misc_feature (279)..(279): n is a, c, g, or t
  modified_base (330)..(330): a, c, t, g, unknown or other
  misc_feature (330)..(330): n is a, c, g, or t
  modified_base (425)..(425): a, c, t, g, unknown or other
  misc_feature (425)..(425): n is a, c, g, or t
  modified_base (435)..(435): a, c, t, g, unknown or other
  misc_feature (435)..(435): n is a, c, g, or t
  modified_base (472)..(472): a, c, t, g, unknown or other
  misc_feature (472)..(472): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtncgccaggccgctggacaacgacctgagtggatgggatgggcgaaccctaanactggtgtcacagtgtcttcacccatcctccgggacagacttaccatcgaccacgaacctcctaccataaacacagcctacatggagttgaggancctgacatcngacacacgccgtctattctgtgcgagacgtcccacgntccggtgacgccgtacggcacgccggtcctttgacttcgtcgggg

SEQ ID NO: 207977 - DNA, 491 bp, Homo sapiens
  misc_feature: GYAE6OF02FMOIR.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtacaacagagttacagttcccctcgctactttggccgagggaccaagttgagatacaaacgaactgtggctgcacatctgtc

SEQ ID NO: 207978 - DNA, 521 bp, Homo sapiens
  misc_feature: GYAE6OF02H4W2P.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgctaatctacttactgtcaacagtaagttacacgtttcccctcgtctacgttttcggaccgtacggggaacctaagttcgaagtaataccaaacggaacttgtaggctcgaccaccatcctgttcc

SEQ ID NO: 207979 - DNA, 523 bp, Homo sapiens
  misc_feature: GYAE6OF02II9DM.17.25.C03.1.454.CMB.1.raw
  modified_base (306)..(306): a, c, t, g, unknown or other
  misc_feature (306)..(306): n is a, c, g, or t
  modified_base (312)..(312): a, c, t, g, unknown or other
  misc_feature (312)..(312): n is a, c, g, or t
  modified_base (402)..(402): a, c, t, g, unknown or other
  misc_feature (402)..(402): n is a, c, g, or t
  modified_base (424)..(424): a, c, t, g, unknown or other
  misc_feature (424)..(424): n is a, c, g, or t
  modified_base (434)..(434): a, c, t, g, unknown or other
  misc_feature (434)..(434): n is a, c, g, or t
  modified_base (455)..(455): a, c, t, g, unknown or other
  misc_feature (455)..(455): n is a, c, g, or t
  modified_base (472)..(472): a, c, t, g, unknown or other
  misc_feature (472)..(472): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgngtaggntgggatgggcgaacctaacactggtgtcacagtgtcttcacccatcctccgggacagacttaccatcgaccacgaactcctccataaacncagcctacatggagttgaggancctgacatcngacgacacggcctctattacngtgcgagagtcccaggntcccggtgacgcccgtacggcacggccggtcctttggaccttcgtcggggg

SEQ ID NO: 207980 - DNA, 521 bp, Homo sapiens
  misc_feature: GYAE6OF02FOLSM.17.25.C03.1.454.CMB.1.raw
  modified_base (280)..(280): a, c, t, g, unknown or other
  misc_feature (280)..(280): n is a, c, g, or t
  modified_base (427)..(427): a, c, t, g, unknown or other
  misc_feature (427)..(427): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggcgaaccctaacactggtgtcacagtgtcttcacccatcctcgggacagacttaccatcgaccacgaactcctaccaataaacacagcctaacatggagttgaggacncctgacatctgacgacacggccgtctattactgtgcgagacgtcccagactccggtgacgccctaggcaggccgtcctttggaccttgtcgggg

SEQ ID NO: 207981 - DNA, 580 bp, Homo sapiens
  misc_feature: GYAE6OF02JCD58.17.25.C03.1.454.CMB.1.raw
  modified_base (277)..(277): a, c, t, g, unknown or other
  misc_feature (277)..(277): n is a, c, g, or t
tcagcgtagactagcacgaccggtgctcgatttagtagtgtagatttgggtttgggagtcagtctcagtcaggacacagcatggacatgagggtccccgctcagctcgtgggctctgctactctggctccgagctgccagatgtgacatccagatcgacccagtcctccactccctcctgtctcgcctctggtgggggtcagagtcaccatcacttgccggacagtcacggtacgttaaactatttaattggtatcagcaagaaacctaggaaaacnccccagaccctcctgactctcgtggtgcatcccactctgcgaagtggccgtccatcgaggttcagtggcaggtggatcgtgggacagtatttacaattcctacaccactaccacctactctcgacctaaccgtgaggtattgtcgactaacttctaacttactcgtaccaacgtagtacgttactaccgttcccctacgtaccttacgtttacggaccgtaacggggtaacctaaggttagaacggtaactaaccgaaacgtaacgttggtacggtctacgacctaccacgttcttcgttacc

SEQ ID NO: 207982 - DNA, 523 bp, Homo sapiens
  misc_feature: GYAE6OF02HWCOD.17.25.C03.1.454.CMB.1.raw
  modified_base (404)..(404): a, c, t, g, unknown or other
  misc_feature (404)..(404): n is a, c, g, or t
  modified_base (412)..(412): a, c, t, g, unknown or other
  misc_feature (412)..(412): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatggggcgaaccctaacactggtgtcacagtgtcttcacccatcctcgggacagacttaccatcgaccacgaactcctaccataaacncagcctanatggagttgaggagcctgacatctagacgacacggccgtctattactgtcgacgagacgtcccaggatccggtgacgccctaggcaggccggtcctttgaccttgtcgggg

SEQ ID NO: 207983 - DNA, 539 bp, Homo sapiens
  misc_feature: GYAE6OF02I0IMO.17.25.C03.1.454.CMB.1.raw
  modified_base (280)..(280): a, c, t, g, unknown or other
  misc_feature (280)..(280): n is a, c, g, or t
  modified_base (330)..(330): a, c, t, g, unknown or other
  misc_feature (330)..(330): n is a, c, g, or t
  modified_base (337)..(337): a, c, t, g, unknown or other
  misc_feature (337)..(337): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggcgaacctaanactggtntcacagtgtcttcacccatcctcgggacagacttaccatcgaccacgaactcctaccaataaaccacacgcctacatggagttgaggagcctgaccatctgacgacacggcctctattactgtacgcgagacgtcccgacgtacgtccggtagtacgcccgtacgggccaggccggtaccctttggaccgtttcgtacgggg

SEQ ID NO: 207984 - DNA, 525 bp, Homo sapiens
  misc_feature: GYAE6OF02F2V85.17.25.C03.1.454.CMB.1.raw
  modified_base (334)..(334): a, c, t, g, unknown or other
  misc_feature (334)..(334): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggggcctcagtgaaggtctcctgcaaggcttctggattcacgtttacctcctatagtatcaactgggtgcgccaggccgctggacaacgacctgagtggatggggatggggcgaaccctaanactggtgtcacagtgtcttcacccatcctccgggacagacttaccatgaccacgaactcctccataaacacagcctacatggagttgagagcctgacatctgacgacacgggcctctattactgtcgcgagcgtcccacggtactccggtgacgcctacggcaggccggtcctttggaccttgtccggggg

SEQ ID NO: 207985 - DNA, 528 bp, Homo sapiens
  misc_feature: GYAE6OF02GL1CT.17.25.C03.1.454.CMB.1.raw
  modified_base (280)..(280): a, c, t, g, unknown or other
  misc_feature (280)..(280): n is a, c, g, or t
  modified_base (426)..(426): a, c, t, g, unknown or other
  misc_feature (426)..(426): n is a, c, g, or t
  modified_base (436)..(436): a, c, t, g, unknown or other
  misc_feature (436)..(436): n is a, c, g, or t
  modified_base (448)..(448): a, c, t, g, unknown or other
  misc_feature (448)..(448): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggcgaaccctaacactggtgtcacagtgtcttcacccatcctcgggacagacttaccatcgaccacgaacctcctaccaataaaccacagacctacatggattgagancctgacatcngacacgacgctntatactgtgcgagcgtcccacggtatccggtagacgcccgttacggccaggtccggtccttttggaccttcggtacgggg

SEQ ID NO: 207986 - DNA, 497 bp, Homo sapiens
  misc_feature: GYAE6OF02I046P.17.25.C03.1.454.CMB.1.raw
  modified_base (484)..(484): a, c, t, g, unknown or other
  misc_feature (484)..(484): n is a, c, g, or t
  modified_base (494)..(494): a, c, t, g, unknown or other
  misc_feature (494)..(494): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggctcccatcgaggttcagtggcagtggatcgtgggacagatttcaatctcaccatcaccactctgcaacctgaggattgtgcaatctactactgtcaacagagttacacgttcccctcgctacttttggccacggggacctaagttgaagactacaaacgaactgtgcngcaccatctnttc

SEQ ID NO: 207987 - DNA, 526 bp, Homo sapiens
  misc_feature: GYAE6OF02GSGSC.17.25.C03.1.454.CMB.1.raw
  modified_base (430)..(430): a, c, t, g, unknown or other
  misc_feature (430)..(430): n is a, c, g, or t
  modified_base (463)..(463): a, c, t, g, unknown or other
  misc_feature (463)..(463): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggcgaaccctaacacgtggtgtcacagtgtcttcacccatccgtccgggacacgacttaccatcgaccacgaactcctaccaataaacacagcctacatggagttgaggancctgacatctgacgacacggcctctattactgngcgagcgtcccacgtctccggtgacgcctacggcacggtccggtcctttgccgttcgtcgggg

SEQ ID NO: 207988 - DNA, 556 bp, Homo sapiens
  misc_feature: GYAE6OF02IQ2HA.17.25.C03.1.454.CMB.1.raw
  modified_base (338)..(338): a, c, t, g, unknown or other
  misc_feature (338)..(338): n is a, c, g, or t
  modified_base (392)..(392): a, c, t, g, unknown or other
  misc_feature (392)..(392): n is a, c, g, or t
  modified_base (410)..(410): a, c, t, g, unknown or other
  misc_feature (410)..(410): n is a, c, g, or t
  modified_base (423)..(423): a, c, t, g, unknown or other
  misc_feature (423)..(423): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacacctggngtcacagtgtcttcacccatcctcgggacagacttaccatgaccacgaactccnccaataaacacagcctanatggattgaggancctgacatctgaccgacacggccgtctattacgtgtagcgaagacgtccccaacggacttcccggggtagacggccccgttaacgggcccgaacgggtccgggtcccttttggacccgtttcggtacgggggg

SEQ ID NO: 207989 - DNA, 512 bp, Homo sapiens
  misc_feature: GYAE6OF02GJH8V.17.25.C03.1.454.CMB.1.raw
  modified_base (331)..(331): a, c, t, g, unknown or other
  misc_feature (331)..(331): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaanactggtgtcacagtgtcttcacccatcctccgggacagacttaccatgaccacgaactcctaccataaacacagcctaacatggagttgaggagcctgacatctgacgacacgccgtctattactgtgcgagagtcccaggatccggtgacgcctacggcagcggcctttgacttgtcggg

SEQ ID NO: 207990 - DNA, 550 bp, Homo sapiens
  misc_feature: GYAE6OF02HVNAS.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaacgccccagacctcctgatctctggtgcatccactctgcgaagtggctccatcgaggttcagtggcagtggatcgtgggacagtatttcaatctcaccatcaccactctgacaacctgaggtattgtgactaatctactactgtacaaactagtacttactacgtttcccctcgtccttacgttttcggaccgtacggggtaacctaaggttggaagtaactaaccgaaaacgtaacgttcggtacggtaccgtcgacctaaccctattccgttgttcc

SEQ ID NO: 207991 - DNA, 523 bp, Homo sapiens
  misc_feature: GYAE6OF02I2O3E.17.25.C03.1.454.CMB.1.raw
  modified_base (279)..(279): a, c, t, g, unknown or other
  misc_feature (279)..(279): n is a, c, g, or t
  modified_base (330)..(330): a, c, t, g, unknown or other
  misc_feature (330)..(330): n is a, c, g, or t
  modified_base (337)..(337): a, c, t, g, unknown or other
  misc_feature (337)..(337): n is a, c, g, or t
  modified_base (422)..(422): a, c, t, g, unknown or other
  misc_feature (422)..(422): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtncgccaggccgctggacaacgacctgagtggatgggatgggcgaaccctaanactggtntcacagtgtcttcacccatcctcgggacagacttaccatcgaccacgaactccacataaacacacgcctacatggagttgaggancctgacatctagacgataccggctctattactgtagcgagacgtcccacgtctccggtagacgtccgtacggccaggccggtcctttgaccttcgtcgggg

SEQ ID NO: 207992 - DNA, 524 bp, Homo sapiens
  misc_feature: GYAE6OF02G4CVZ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatccctccgggacagacttaccatcgaccacgaactcctaccataaacacagcctacatggagttgaggagcctgacatctgacgacacggccgtctattactgtgcgagacgtcccagctccggtgacgcccgtacggcacggccggtcctttggaccttcgtcgggg

SEQ ID NO: 207993 - DNA, 524 bp, Homo sapiens
  misc_feature: GYAE6OF02GKPQO.17.25.C03.1.454.CMB.1.raw
  modified_base (337)..(337): a, c, t, g, unknown or other
  misc_feature (337)..(337): n is a, c, g, or t
  modified_base (426)..(426): a, c, t, g, unknown or other
  misc_feature (426)..(426): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcaaccctaacactggtntcacagtgtcttcacccatccgtcgggacagaccttacatcgaccacgaactcctaccaataaaccacagccctaacatggagttgagncctgacatctgaccgacacggccgtctattactgtgcgagacgtcccgagcgtccggtgacgtccgtacggcacggccgtctttcgacttcgtcgggg

SEQ ID NO: 207994 - DNA, 499 bp, Homo sapiens
  misc_feature: GYAE6OF02GQ9NA.17.25.C03.1.454.CMB.1.raw
  modified_base (424)..(424): a, c, t, g, unknown or other
  misc_feature (424)..(424): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgagatgtgcaatctactactgtcaacagagttaccngttcccctcgtcaccttttggccaggggaccaagttgagatacaaacgaactgtaggctcgcaccatcgtgttcc

SEQ ID NO: 207995 - DNA, 508 bp, Homo sapiens
  misc_feature: GYAE6OF02GP8UU.17.25.C03.1.454.CMB.1.raw
  modified_base (407)..(407): a, c, t, g, unknown or other
  misc_feature (407)..(407): n is a, c, g, or t
  modified_base (450)..(450): a, c, t, g, unknown or other
  misc_feature (450)..(450): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcaaccctaacactggtgtcacagtgtcttcacccatcctcgggacagacttaccatgaccacgaactcctccataaacacagcctanatggattgagagcctgacatctgacgacacgccgtctattacngtgcgagacgtcccaggatccggtgacgcctacggcaggcggctttgacttgtcgggg

SEQ ID NO: 207996 - DNA, 510 bp, Homo sapiens
  misc_feature: GYAE6OF02FYTD3.17.25.C03.1.454.CMB.1.raw
  modified_base (395)..(395): a, c, t, g, unknown or other
  misc_feature (395)..(395): n is a, c, g, or t
  modified_base (424)..(424): a, c, t, g, unknown or other
  misc_feature (424)..(424): n is a, c, g, or t
  modified_base (448)..(448): a, c, t, g, unknown or other
  misc_feature (448)..(448): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatggggcgaaccctaacactggtgtcacagtgtcttcacccatcctccgggacagacttaccatcgaccacgaactccncataaacacagcctacatggattgaggancctgacatctgacgatacggcctntattctgtgcgagagtcccagatccggtgacgcctacggcaggccgtctttgacttgtcggg

SEQ ID NO: 207997 - DNA, 526 bp, Homo sapiens
  misc_feature: GYAE6OF02FR5E2.17.25.C03.1.454.CMB.1.raw
  modified_base (331)..(331): a, c, t, g, unknown or other
  misc_feature (331)..(331): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaanactggtgtcacagtgtcttcacccatcctcgggacagacttaccatgaccacgaactcctaccaataaacacagcctacatggagttgaggacgcctagacatctgacgacaccgggcctctattactggtcacgagacgtcccaacggctccggtgacgcccgtaggcacggccggtcctttgacttcgcgggg

SEQ ID NO: 207998 - DNA, 516 bp, Homo sapiens
  misc_feature: GYAE6OF02GA4W6.17.25.C03.1.454.CMB.1.raw
tcagcgtagactagcacgaccggtgctcgatttagtagtgtagatttgggtttgggggaggtcagtctcagtcaggacacagcatggacatgagggtccccgctcagctcctgggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgagttcagtcggcagtggatctgggacagatttcaatctcaccatcaccactctgcaacctgaggtattgtgacaatctactactgtacaacagtagttacagttcccctgactactttggccgaaggggtaccaagttcgaagtactacaaacggaacttgtacggctggacctaccattctgttacc

SEQ ID NO: 207999 - DNA, 520 bp, Homo sapiens
  misc_feature: GYAE6OF02IXN0T.17.25.C03.1.454.CMB.1.raw
  modified_base (243)..(243): a, c, t, g, unknown or other
  misc_feature (243)..(243): n is a, c, g, or t
  modified_base (411)..(411): a, c, t, g, unknown or other
  misc_feature (411)..(411): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctnttaaattggtatcagcagaaacctggaaaagccccagacctcctgatctctggtgcatccactctgcgaagtggcgtcccatcgagttcagtggcagtggatcgtgggacagatttcaatctcaccatcaccactctgacaactgagtattgtgctaatctactactntaccaacagtacgttacacgttccctcgacctacgttttcggaccgtacggggacctaaggttgaagtactacgaaacgtaactgtaggctcgaccaccgatcctgtcc

SEQ ID NO: 208000 - DNA, 518 bp, Homo sapiens
  misc_feature: GYAE6OF02IJ2QQ.17.25.C03.1.454.CMB.1.raw
  modified_base (294)..(294): a, c, t, g, unknown or other
  misc_feature (294)..(294): n is a, c, g, or t
  modified_base (335)..(335): a, c, t, g, unknown or other
  misc_feature (335)..(335): n is a, c, g, or t
  modified_base (345)..(345): a, c, t, g, unknown or other
  misc_feature (345)..(345): n is a, c, g, or t
  modified_base (368)..(368): a, c, t, g, unknown or other
  misc_feature (368)..(368): n is a, c, g, or t
  modified_base (398)..(398): a, c, t, g, unknown or other
  misc_feature (398)..(398): n is a, c, g, or t
  modified_base (404)..(404): a, c, t, g, unknown or other
  misc_feature (404)..(404): n is a, c, g, or t
  modified_base (417)..(417): a, c, t, g, unknown or other
  misc_feature (417)..(417): n is a, c, g, or t
  modified_base (420)..(420): a, c, t, g, unknown or other
  misc_feature (420)..(420): n is a, c, g, or t
  modified_base (422)..(422): a, c, t, g, unknown or other
  misc_feature (422)..(422): n is a, c, g, or t
  modified_base (440)..(440): a, c, t, g, unknown or other
  misc_feature (440)..(440): n is a, c, g, or t
  modified_base (449)..(449): a, c, t, g, unknown or other
  misc_feature (449)..(449): n is a, c, g, or t
  modified_base (477)..(477): a, c, t, g, unknown or other
  misc_feature (477)..(477): n is a, c, g, or t
tcagcgtagactagcacgaccggtgctcgatttagtagtgtagatttgggtttggggactcaacaaccacatctcgtcctctacgacgaaaccctgtgagcacaggctcctcaccatgggctggacctggaggatcctcttcttggtggcagcagctacgaagtgcccactcccaggtgcagctggtgcagtctggggctgaggtgaagaagcctggggcctcagtgaaggtctcctgcaaggcttctggattcacgtttacctcctatagtatcaactgggtgcgccaggccnctggacaacgacctgagtggatgggatggggcaaccctaanactggtgcanagtgtcttcacccatcctcgganagacttacatgaccagaactcacataaacnagctanatgattgaggacncanantcacgacgacgacgcctntatacgtgngacgagacgtacccgagtcgtccggtanacgtcctacggcgacggtccgttctttgaccgttcggcggg

SEQ ID NO: 208001 - DNA, 508 bp, Homo sapiens
  misc_feature: GYAE6OF02IOFUY.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcaagaaacctggaaaagccccagacctcctgatctctggtgcatccactctgcgaagtggcgtccatcgaggttcagtgcagtgatcgtgggacagtatttcaatctcacatcaccactctgcaacctgagattgtgcaatctactactgtacaacagagttactacgttccctcgtcctacgttttcggaccgtaggggaacctaagttgaagaactaccaaacgtaactgtaggctgccacactctgtc

SEQ ID NO: 208002 - DNA, 527 bp, Homo sapiens
  misc_feature: GYAE6OF02G9JDP.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagatcgtcctatcgttgacacaccaaactacgcacagaagttcagggcagactcaccataaccgcggacaaattaacgaacacagttaatctaggagctgaacagcctgtcatctgaggacacgggcttctacttctgtgcgaggagtaattactataacactgtctccttttacaccttcccttcgtacttcggtcggtctagtacccgg

SEQ ID NO: 208003 - DNA, 525 bp, Homo sapiens
  misc_feature: GYAE6OF02I0V9T.17.25.C03.1.454.CMB.1.raw
  modified_base (338)..(338): a, c, t, g, unknown or other
  misc_feature (338)..(338): n is a, c, g, or t
  modified_base (413)..(413): a, c, t, g, unknown or other
  misc_feature (413)..(413): n is a, c, g, or t
  modified_base (461)..(461): a, c, t, g, unknown or other
  misc_feature (461)..(461): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatggggcgaacctaacactggngtcacagtgtcttcacccatcctccgggacagacttaccatcgaccacgaacctcctaccataaacacagcctanatggagttgaggagcctgacatctgacgacacggccttactatttacngtgcgagacgttcccaggactccggtgacgccgtacggcacggccgtctttgacttcgtcgggg

SEQ ID NO: 208004 - DNA, 534 bp, Homo sapiens
  misc_feature: GYAE6OF02GK6IA.17.25.C03.1.454.CMB.1.raw
  modified_base (431)..(431): a, c, t, g, unknown or other
  misc_feature (431)..(431): n is a, c, g, or t
  modified_base (441)..(441): a, c, t, g, unknown or other
  misc_feature (441)..(441): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacacgtggtgtcacagtgtcttcacccatcccgtcgggacagtaccttaccatcgaccacgaacctccctacaataaacacagcctacagtggagttgaggncctgacatcngacgacacggcctactattactgtgcgagacgtcccaggtactccggtagacgtccctacggcacggccggtcctttggaccttcggtcgggg

SEQ ID NO: 208005 - DNA, 521 bp, Homo sapiens
  misc_feature: GYAE6OF02GW0D1.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctaccataaacacagcctacatggagttgaggagcctgacatctagacgacgacggccgtactattactgtgcgagcgtcccagactccggtgacgccgtaggcacggccggtcctttggaccttgcgggg

SEQ ID NO: 208006 - DNA, 519 bp, Homo sapiens
  misc_feature: GYAE6OF02F3JOO.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctcataaacacagcctacatggagttgaggagcctgacatctgacgacacggcctctattactgtgacgagacgtcccacgactccggtgacgccgtacggcacggccgtcctttgaccttcgtcgggg

SEQ ID NO: 208007 - DNA, 524 bp, Homo sapiens
  misc_feature: GYAE6OF02IH4J3.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggaccaacgacctgagtggatggggatggggcaaccctaacactggtgtcacgagtgtcttcacccatcctccgggacagacttaccatgaccacgaactccacaataaacacagcctacatggagttgaggagcctgacatctgacgacacggccgtctattactgtgcgagacgtcccaaggctccggtgacgcctacggctaggccggtcctttggacctttgacgggg

SEQ ID NO: 208008 - DNA, 524 bp, Homo sapiens
  misc_feature: GYAE6OF02G3CRI.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatccgtcgggacagacttaccatcgaccacgaactcctaccaataaaccacagacctacatggagttgaggagcctgacatctgacgacgacgccgtctattacgtgtcgcgagacgtcccagactccggtgacgccctaggcaggccggtcctttgacttcgtcgggg

SEQ ID NO: 208009 - DNA, 558 bp, Homo sapiens
  misc_feature: GYAE6OF02F5S9E.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggggcctcagtgaaggtctcctgcaaggcttctggattcacgtttacctcctatagtatcaactgggtgcgccaggccgctggacaacgacctgagtggatggggatgggcgaaccctaacacggtggtgtcacagtgtcttcacccatccgtccgggacagacttaccatcgaccacgaacctcctaccaactaaacacagaccctacatggagttgaggacgcctgacatcgtagaccgaccaccgggtcctacttacttactggtagacgtagacgtcccacggagttcccgggtagaccgccgtacggcacggtccggtcctttggaccgttcggtacgggg

SEQ ID NO: 208010 - DNA, 525 bp, Homo sapiens
  misc_feature: GYAE6OF02GGPDO.17.25.C03.1.454.CMB.1.raw
  modified_base (516)..(516): a, c, t, g, unknown or other
  misc_feature (516)..(516): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtacccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctcataaacacacgcctacatggagttgaggagcctgacatctgacgacacggcctctattactgtgcgagacgtcccacgacgtccggtgacgccctacggcacggcggtcctttggaccttcgnggggtaccg

SEQ ID NO: 208011 - DNA, 516 bp, Homo sapiens
  misc_feature: GYAE6OF02HU0K4.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaacgccccagacctcctgatctctggtgcatccactctgcgaagtggcgtccatcgagttcagtggcagtggatcgtgggacagtatttcaatctcaccatcaccactctcgcaacctgaggtattgtgacaatctactactgtacaacagtagttactacgttcccctcgtcctacgttttcggaccgtacggggacctaagttgaagatacaaacgaactagtggctcgccaccactctgtc

SEQ ID NO: 208012 - DNA, 538 bp, Homo sapiens
  misc_feature: GYAE6OF02IXW3Y.17.25.C03.1.454.CMB.1.raw
  modified_base (333)..(333): a, c, t, g, unknown or other
  misc_feature (333)..(333): n is a, c, g, or t
  modified_base (426)..(426): a, c, t, g, unknown or other
  misc_feature (426)..(426): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggacgaaccctaanacgtggtgtcacagtgtcttcacccatcctcgggacagacttaccatgaccacgaacctcctcataaacacagcctacatggagttgaggacncctagacatctagacgacacgggcctactatttactgtgcgacgtacgtcccacgacgttcccggtgaacgcccgttagggccaggccggtcctttggaccttcggtcgggg

SEQ ID NO: 208013 - DNA, 510 bp, Homo sapiens
  misc_feature: GYAE6OF02IPAL3.17.25.C03.1.454.CMB.1.raw
  modified_base (419)..(419): a, c, t, g, unknown or other
  misc_feature (419)..(419): n is a, c, g, or t
  modified_base (508)..(508): a, c, t, g, unknown or other
  misc_feature (508)..(508): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaacctatttaaattggtatcagcagaaacctggaaaacgccccagacctcctgatctctggtgcatccactctgcgaagtgctccatcgagttcagtgcagtggatcgtgggacagtatttcaatctacaccatcaccactctgacaacctgaggtattgtgcaatctactactgtacaanagtagttactacgttccctcgtcctacgttttcggaccgagggacctaagttagagtaactaccaaacgaactgtgctcgcaccatctntc

SEQ ID NO: 208014 - DNA, 513 bp, Homo sapiens
  misc_feature: GYAE6OF02F2O19.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctcataaacacagcctacatggagttgaggagcctgacatctgacgacacggccgtctattactgtgcgagagtcccagatccggtgacgcctacggcaggccggcctttggacttgtcgggg

SEQ ID NO: 208015 - DNA, 689 bp, Homo sapiens
  misc_feature: GYAE6OF02IFYSW.17.25.C03.1.454.CMB.1.raw
  modified_base (200)..(200): a, c, t, g, unknown or other
  misc_feature (200)..(200): n is a, c, g, or t
  modified_base (556)..(556): a, c, t, g, unknown or other
  misc_feature (556)..(556): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgggngagaagcgtcgggcgtcagtgaggtacgtcctcgcgacgacgttctcggagttctaccgtttaaccttaccttactaagtagttactaaccgtagggttggccgcccgtacgggcccggccgtggtaaccgaaccgaacccgtcggtaggtacggagtgggaggtagggaccggaaacccgtaaaccgaacgtcgggttacggtctaaccgacgttagtccgttcctacccaacttcccgtccgggaccgacgaaccttaacctacacgtacccaaccgtaaccgttccctacccgaataaaaccaacgcgtaccgtaaccagtagggtaggttacgtaagggacgtcctcggaanactcgtacgaaccggaactacccggccgttactaacgttactggtcgcgacgattccccgacgtacgtccggtggaacgcccgttacggcgacggtcccggttccgtttagtaccgttccggcgggggaccgg

SEQ ID NO: 208016 - DNA, 555 bp, Homo sapiens
  misc_feature: GYAE6OF02I3719.17.25.C03.1.454.CMB.1.raw
  modified_base (454)..(454): a, c, t, g, unknown or other
  misc_feature (454)..(454): n is a, c, g, or t
tcagcgtagactagcacgaccggtgctcgatttagtagtgtagatttgggtttggggggactcaacaaccacatctgtcctctagagaaaaccctgtgagcacagctcctcaccatggactggacctggaggatcctcttcgttggtggcagcagctacaagtcgcccactcccaggtgcagctggtgcagtctggggctgaggtgaagaagcctggggcctcagtgaaggtctcctgcaaggcttctggattcacgtttacctcctatagtatcaactgggtgcgccacggccgctggacaacgacctggagtggatgggatggggacgtaaccctaacactggtgtcacgagtgtccttcacccatccctaccgggacacgaccttaccatcgaccacgaacctccctacaactaaacacagccctacatggattgaggagtcctgacatcngacgacgacgggtcgtctagttacgtggtgacgtagcgtcccgaggactccggtagacgcccgtacggcacggtccggtcctttgaccgttcgtaccgggg

SEQ ID NO: 208017 - DNA, 572 bp, Homo sapiens
  misc_feature: GYAE6OF02HJYE0.17.25.C03.1.454.CMB.1.raw
  modified_base (298)..(298): a, c, t, g, unknown or other
  misc_feature (298)..(298): n is a, c, g, or t
  modified_base (483)..(483): a, c, t, g, unknown or other
  misc_feature (483)..(483): n is a, c, g, or t
  modified_base (524)..(524): a, c, t, g, unknown or other
  misc_feature (524)..(524): n is a, c, g, or t
tcagcgtagactagcacgaccggtgctcgatttagtagtgtagatttgggtttggggactcgaacaaccacatctgtcctctagagaaaacccgtgtgagcctacagctcctcacccactggactggaccgtggtaggagtcctcgttcttggtcggacgagcacgctacaagtgcccacctccccaggtgcagctggtgcagtcgtgggctgaggtgaagaagcctggggcctcagtgaaggtctcctgcaaggcttctggattcacgtttacctcctatagtatcaactgggtgcnccaggccgctggacaacgacctgagtggatgggatgggcgaaccctaacacgtggtgtacacagtgtccttacacccctatccctaccgggactagacctttaccgatcgaaccacgaacctccctaccaataaacacacgcctacatggagttgaggcgcctgacatctgacgacacggccgtntacttactgtagcgtagacgttccccaacggtctcccgggngaacggcctaacgggcacggccggtccctttggaccttcgtacggggg

SEQ ID NO: 208018 - DNA, 522 bp, Homo sapiens
  misc_feature: GYAE6OF02IGEXS.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacacgcctaacatggagttgaggagccctgacatctgacgacacggccgtctattactgtgcgagacgtcccacgatccgggtgacgtcctacggcaggccggtcctttgaccttgtcgggg

SEQ ID NO: 208019 - DNA, 559 bp, Homo sapiens
  misc_feature: GYAE6OF02G4NAD.17.25.C03.1.454.CMB.1.raw
  modified_base (410)..(410): a, c, t, g, unknown or other
  misc_feature (410)..(410): n is a, c, g, or t
  modified_base (429)..(429): a, c, t, g, unknown or other
  misc_feature (429)..(429): n is a, c, g, or t
  modified_base (443)..(443): a, c, t, g, unknown or other
  misc_feature (443)..(443): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagcctggggcctcagtgaaggtctcctgcaaggcttctggattcacgtttacctcctatagtatcaactgggtgcgccaggccgcgtggacaacgacctgagtggagtgggatgggaccgaaccctaacacgtggtcgtacacgaggttgtccttcaccctatccgtccgggacagtaccttaccatcgaccacgaactccnccaataaacacacgcctanatggattgaggacncctgactatctgaccgacacggtcctatattacgtgtacgcgaagcgtcccacggtgtaccggtgaaccgtccctacgggcacggtccggtcctttaggaccgttcggtaccgggg

SEQ ID NO: 208020 - DNA, 490 bp, Homo sapiens
  misc_feature: GYAE6OF02GRIYV.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtccatcgagttcagtggcagtggatctggacagatttcaatctcaccatcaccactctgacaacctgaggattgtgcaatctactactgtcaacagagttacacgttcccctcgtctactttggccacggggacaagttgagatacaaacgaactgtgctgctacatctgtc

SEQ ID NO: 208021 - DNA, 539 bp, Homo sapiens
  misc_feature: GYAE6OF02F6ZPY.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggaacaaattaacgaacacagtaatctggagctgaacagcctgtcatctgaggacacgggcttctacttctgtgcgagataattactataacactgcttccttttacaccttcccttgtacttcgtcgggcctagtcggtaccccggtctacccg

SEQ ID NO: 208022 - DNA, 515 bp, Homo sapiens
  misc_feature: GYAE6OF02HW09P.17.25.C03.1.454.CMB.1.raw
  modified_base (457)..(457): a, c, t, g, unknown or other
  misc_feature (457)..(457): n is a, c, g, or t
  modified_base (474)..(474): a, c, t, g, unknown or other
  misc_feature (474)..(474): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctcgggacagacttaccatgaccacgaactcctccaataaacacagcctacatggattgaggagcctgaccatctagacgataccggcctctattacgngtgcgagacgtcccagntccggtgagcctacggcaggccggcctttggacttgcgggg

SEQ ID NO: 208023 - DNA, 786 bp, Homo sapiens
  misc_feature: GYAE6OF02H4GPU.17.25.C03.1.454.CMB.1.raw
  modified_base (198)..(198): a, c, t, g, unknown or other
  misc_feature (198)..(198): n is a, c, g, or t
tcagcgtagactagcacgaccggtgctcgatttagtagtgtagatttgggtttgggggacgtacaacgtactcacgtccaggacaacaccgcaatggacaatccgacgggtccccgcgtccaggccttcgtggggctcctgttcgtacgtctggctccgacgctggccacgatcgtggacagtcctaggatcgacccngtcgtccagtccgtcctagtctcgccgtctgtggggtcaaggtcgtcgaccagtctacttggacggacaacgtcacggtacgttaaacctattaaacttggtaactctaggcaaggtaaacctagggaaaaccgcccaaggccttcgtagacgtctcgtaggtcgactacgttaccactcgtcgacgtaaggtacggaccttaaacccagtaccggtaaggttaccaggtagggcctaaggtcggtacttcggttaacgggaccgtaatacttcaactcgtaccgactagtaccacctacgtcgtacgtacaacgtacggtaacggtattcggtaacgaccgtaaacgttacgttaaccgtaacgttacgtaaccgttaaacgttaacggtttaacgtttaaccgtacccggtttaccccttcggttaaccgtttaccggttttaacgggacccgttaaacgggggttaaccttaaacgggtttccgtaacgtaacgtttaaccggtaaaccgtaaccggttttacgggaccggttaccggtaacggtacccgttaacccgtaacgtttcccgtacggttttaccccg

SEQ ID NO: 208024 - DNA, 573 bp, Homo sapiens
  misc_feature: GYAE6OF02HQVFI.17.25.C03.1.454.CMB.1.raw
  modified_base (279)..(279): a, c, t, g, unknown or other
  misc_feature (279)..(279): n is a, c, g, or t
  modified_base (336)..(336): a, c, t, g, unknown or other
  misc_feature (336)..(336): n is a, c, g, or t
  modified_base (409)..(409): a, c, t, g, unknown or other
  misc_feature (409)..(409): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtncgccaggccgctggacaacgacctgagtggatgggatgggcgaacctaacactggtntcacagtgtcttcacccatccgtcgggacagacttaccatcgaccacgaactcctacaataaacacagcctanatggattgagagcctagacatcgtcgaacgacgaccggccgttacttacgtttacgtggtacggcgaaggtacgtccccgaacggtacgttcccgggtagaccgtcccgtaaccgggcacgggtcccgggtccctttttaggacccgtttcgggtaccgggggg

SEQ ID NO: 208025 - DNA, 523 bp, Homo sapiens
  misc_feature: GYAE6OF02IQSG1.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctcgggacagacttaccatgaccacgaactcctcataaacacagcctacatggagttgaggagcctgacatctagacgacacggccgtctattactgtgcgagacgtcccacggactccgggtgacgccctacggcacggccggtcctttgaccttcgtcggggg

SEQ ID NO: 208026 - DNA, 517 bp, Homo sapiens
  misc_feature: GYAE6OF02GZ05U.17.25.C03.1.454.CMB.1.raw
  modified_base (330)..(330): a, c, t, g, unknown or other
  misc_feature (330)..(330): n is a, c, g, or t
  modified_base (456)..(456): a, c, t, g, unknown or other
  misc_feature (456)..(456): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcaaccctaanactggtgtcacagtgtcttcacccatcctccgggacagacttaccatgaccacgaactcctaccataaacacagcctacatggagttgaggagcctgacatctgacgacacggccgtactattacngtgcgagcgtcccaggactccggtgacgcctaggcaggccggcctttggaccttcgcgggg

SEQ ID NO: 208027 - DNA, 517 bp, Homo sapiens
  misc_feature: GYAE6OF02H284F.17.25.C03.1.454.CMB.1.raw
  modified_base (280)..(280): a, c, t, g, unknown or other
  misc_feature (280)..(280): n is a, c, g, or t
  modified_base (331)..(331): a, c, t, g, unknown or other
  misc_feature (331)..(331): n is a, c, g, or t
  modified_base (423)..(423): a, c, t, g, unknown or other
  misc_feature (423)..(423): n is a, c, g, or t
  modified_base (454)..(454): a, c, t, g, unknown or other
  misc_feature (454)..(454): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatggggcaaccctaanactggtgtcacagtgtcttcacccatcctccgggacagacttaccatgaccacgaactcctaccataaacacagcctacatggattgaggancctgacatctgacgacacggccgtctattcngtgcgagacgtcccaggatccgggtgacgccctaggcaggccggtcctttgaccttgtcgggg

SEQ ID NO: 208028 - DNA, 570 bp, Homo sapiens
  misc_feature: GYAE6OF02IT9HA.17.25.C03.1.454.CMB.1.raw
  modified_base (369)..(369): a, c, t, g, unknown or other
  misc_feature (369)..(369): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacacgtggtgtcacagtgtcttcacccatccgtccggganagacttaccatcgaccagaacctcctaccaataaacacacgcctacagtggacgttggaaggacgccctagacagttctacgacgacgaccggtccgtactattaccgtgtacgacgacgacgtcccgacgaagttcccggtagaccgacccgttacgggccacgggtacccggtccttttcgaccgtttcgtaccggggg

SEQ ID NO: 208029 - DNA, 516 bp, Homo sapiens
  misc_feature: GYAE6OF02HAJHN.17.25.C03.1.454.CMB.1.raw
  modified_base (280)..(280): a, c, t, g, unknown or other
  misc_feature (280)..(280): n is a, c, g, or t
  modified_base (331)..(331): a, c, t, g, unknown or other
  misc_feature (331)..(331): n is a, c, g, or t
  modified_base (338)..(338): a, c, t, g, unknown or other
  misc_feature (338)..(338): n is a, c, g, or t
  modified_base (424)..(424): a, c, t, g, unknown or other
  misc_feature (424)..(424): n is a, c, g, or t
  modified_base (481)..(481): a, c, t, g, unknown or other
  misc_feature (481)..(481): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacggacctgagtggatgggatgggcaaccctaanactggtntcacagtgtcttcacccatcctccgggacagaccttacatgaccacgaactcctccaataaacacagcctaacatgagttgaggancctgacatctgacgacacggcctctattactgtgcgagacgtcccacgagtcccggngacgcctaggcaggccgtcctttgacttcgcgggg

SEQ ID NO: 208030 - DNA, 518 bp, Homo sapiens
  misc_feature: GYAE6OF02GOYYS.17.25.C03.1.454.CMB.1.raw
  modified_base (403)..(403): a, c, t, g, unknown or other
  misc_feature (403)..(403): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatcgaccacgaactcctaccataaacncagcctacatggagttgaggagcctgacatctgacgacacggcctctattactgtgcgagagtcccagactccggtgacgtcctaggcaggccggtcctttgaccttcgtcgggg

SEQ ID NO: 208031 - DNA, 531 bp, Homo sapiens
  misc_feature: GYAE6OF02I7ZGZ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggcgaacctaacactggtgtcacagtgtcttcacccatcctccgggacagacttaccatcgaccacgaactcctacaataaacacagcctacatggagttgaggacgcctagacatcgtgaccgacaccggccgtctattacgtgtgcgagacgtcccacgatccggtgacgtcctacggcacggccggtcctttcggtaccttcgtcgggg

SEQ ID NO: 208032 - DNA, 523 bp, Homo sapiens
  misc_feature: GYAE6OF02GUDRU.17.25.C03.1.454.CMB.1.raw
  modified_base (280)..(280): a, c, t, g, unknown or other
  misc_feature (280)..(280): n is a, c, g, or t
  modified_base (405)..(405): a, c, t, g, unknown or other
  misc_feature (405)..(405): n is a, c, g, or t
  modified_base (516)..(516): a, c, t, g, unknown or other
  misc_feature (516)..(516): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacccgagtggatgggatgggcgaaccctaacactggtgtcacagtgtcttcacccatcctccgggacagaccttacatcgaccacgactcctccaataaacacancctacatggattgaggagcctgacatctgacgacacggcctctattctgtgcgagacgtcccacgacgtccggtagacggcctacggcacggccggtcctttgaccttcgnggggccg

SEQ ID NO: 208033 - DNA, 559 bp, Homo sapiens
  misc_feature: GYAE6OF02IR78P.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctcgggacagacttaccatcgaccacgaacctccctcaataaacacagccctaacatcggagttgagggacgcctggaaccatctgaccgacgacgggcccgttactactttacgtgtgccgagacgttccccaacggtctacccgggtgacgtcccgtacgggccagggcccggtcctttcggtaccgttcgtccggggg

SEQ ID NO: 208034 - DNA, 532 bp, Homo sapiens
  misc_feature: GYAE6OF02JJMUF.17.25.C03.1.454.CMB.1.raw
  modified_base (280)..(280): a, c, t, g, unknown or other
  misc_feature (280)..(280): n is a, c, g, or t
  modified_base (290)..(290): a, c, t, g, unknown or other
  misc_feature (290)..(290): n is a, c, g, or t
  modified_base (402)..(402): a, c, t, g, unknown or other
  misc_feature (402)..(402): n is a, c, g, or t
  modified_base (410)..(410): a, c, t, g, unknown or other
  misc_feature (410)..(410): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgcaggccgntggacaacgacctgagtggatgggatgggccaacctaacacgtggtgtcacagtgtctcaccatcctacgggacacgacttaccgatagaccacgaacctcaccaataaacncagcctanatggattagagacgcctgactatctagacacgacggcctacttaattcgcgtgaccagacgttcccgaagtcgtacggtgacgtccgtaacgctacggcggttccttaggaccttggacggg

SEQ ID NO: 208035 - DNA, 539 bp, Homo sapiens
  misc_feature: GYAE6OF02I1CNW.17.25.C03.1.454.CMB.1.raw
  modified_base (328)..(328): a, c, t, g, unknown or other
  misc_feature (328)..(328): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgcctgagtggatgggatgggcaacctaanactggtgtcacagtgtcttcacccatcctcgggacagacttacatcgaccacgaactcctacataaacacacgacctacatggagttgaggacgcctgacatctagacgacacggccgtactagttactgtgcgagacgtcccgacgactccggtagacgcccgtacggaccgtacggccggtccctttcggtaccgtttcggtaccgggg

SEQ ID NO: 208036 - DNA, 510 bp, Homo sapiens
  misc_feature: GYAE6OF02GI61N.17.25.C03.1.454.CMB.1.raw
  modified_base (331)..(331): a, c, t, g, unknown or other
  misc_feature (331)..(331): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaanactggtgtcacagtgtcttcacccatcctcgggacagacttaccatgaccacgaactcctccataaacacagcctacatggagttgaggagcctgacatctgatgacacggccgtctattactgtgcgagacgtcccgacgatccggtgacgcctacggcagccggctttcgacttcgg

SEQ ID NO: 208037 - DNA, 535 bp, Homo sapiens
  misc_feature: GYAE6OF02GO0ZQ.17.25.C03.1.454.CMB.1.raw
  modified_base (425)..(425): a, c, t, g, unknown or other
  misc_feature (425)..(425): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatgggcgaacctaacactggtgtcacagtgtcttcacccatcctccgggacagacttaccatcgaccacgaactcctaccataaacacacgcctacatggagttgaggncctgacatctgacgacacggccgtactacttactgtgcgagacgtcccacggctcccgggtgacgcccgtacggccacggccggtcccttttggaccttcggtccggggg

SEQ ID NO: 208038 - DNA, 529 bp, Homo sapiens
  misc_feature: GYAE6OF02I0TQS.17.25.C03.1.454.CMB.1.raw
  modified_base (462)..(462): a, c, t, g, unknown or other
  misc_feature (462)..(462): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccactcgaccacgaacctcctaccaataaacacagacctacatggagttgaggacgcctgacatctgacgacacggccgtctattacngtgcgagacgtcccacgtacgtccggtgacgccgtacggcgaggccggctttcgacttcggtcgggg

SEQ ID NO: 208039 - DNA, 513 bp, Homo sapiens
  misc_feature: GYAE6OF02FUJYI.17.25.C03.1.454.CMB.1.raw
  modified_base (490)..(490): a, c, t, g, unknown or other
  misc_feature (490)..(490): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaacctacactggtgtcacagtgtcttcacccatcctccgggacagacttaccatcgaccacgaactcctaccataaacacagcctacatggagttgaggagcctgacatctgacgacacggccgtctatactgtgcgagacgtcccagctccggtgacgcctacggcncgccggctttgacttcgtcgggg

SEQ ID NO: 208040 - DNA, 526 bp, Homo sapiens
  misc_feature: GYAE6OF02G4RCN.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccaagacctcctgatctctggtgcatccactctgcgaagtcggcgtcccatcgaggttcagtggcagtggatcgtgggacagatttcaatctcaccatcaccactctgccaactgagattgtgacaattctactactgtacaacagtacgttacacgtttcccctcgtcttacgtttcggaccgtaaggggaacctaaggttgacgtaataccgaaacgtacgtggtagctcggaccaccattcctgttcc

SEQ ID NO: 208041 - DNA, 525 bp, Homo sapiens
  misc_feature: GYAE6OF02F796M.17.25.C03.1.454.CMB.1.raw
  modified_base (280)..(280): a, c, t, g, unknown or other
  misc_feature (280)..(280): n is a, c, g, or t
  modified_base (435)..(435): a, c, t, g, unknown or other
  misc_feature (435)..(435): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatggggatggggcgaaccctaacactggtgtcacagtgtcttcacccatcctccgggacagacttaccatgaccacgaactcctcataaacacagcctaacatggagttgaggagcctgacatcngacgacacggccgtctattactgtcgcgagagtcccacggtactcccggtagacgcctacggcaggccggtcctttgaccttcgtcgggg

SEQ ID NO: 208042 - DNA, 539 bp, Homo sapiens
  misc_feature: GYAE6OF02GF8GS.17.25.C03.1.454.CMB.1.raw
  modified_base (329)..(329): a, c, t, g, unknown or other
  misc_feature (329)..(329): n is a, c, g, or t
  modified_base (423)..(423): a, c, t, g, unknown or other
  misc_feature (423)..(423): n is a, c, g, or t
  modified_base (455)..(455): a, c, t, g, unknown or other
  misc_feature (455)..(455): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcaacctaanactggtgtcacagtgtcttcacccatcctccgggacagacttaccatgaccacgaactcctacaataaacacagcctaacatggagttgaggancctgacatctgacgacacggccttctattacngtcgcgtagacgtccccaaggtactcccgggtagacggcccttacgggcacggccggtcctttaggaccgtttcggaccggggg

SEQ ID NO: 208043 - DNA, 551 bp, Homo sapiens
  misc_feature: GYAE6OF02IOIR1.17.25.C03.1.454.CMB.1.raw
  modified_base (280)..(280): a, c, t, g, unknown or other
  misc_feature (280)..(280): n is a, c, g, or t
  modified_base (406)..(406): a, c, t, g, unknown or other
  misc_feature (406)..(406): n is a, c, g, or t
  modified_base (438)..(438): a, c, t, g, unknown or other
  misc_feature (438)..(438): n is a, c, g, or t
  modified_base (461)..(461): a, c, t, g, unknown or other
  misc_feature (461)..(461): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatggggatggggcgaaccctaacacgtggtgtcacagtgtcttcacccatccctcgggacagacttaccatcgaccacgaactcctaccataaacncagcctacatggagttgaggcgcctgacatcngaccgacacggcctactattacngtcgacgagaccgtcccaaggtacgttcccgggtagacgcccgtaacgggccacgggccggtacccgttttggaccgttcgtacgggggg

SEQ ID NO: 208044 - DNA, 537 bp, Homo sapiens
  misc_feature: GYAE6OF02IZA73.17.25.C03.1.454.CMB.1.raw
  modified_base (410)..(410): a, c, t, g, unknown or other
  misc_feature (410)..(410): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatggggcgaaccctaacgactggtgtcacagtcgtcttcacccatcctccgggacagaccttaccatcgaccacgaactcctacataaacacancctacatggagttgaggacgcctgacatctgacgacgacggccgtactacttacgtgtgcgagacgtcccagacgtccggtaggacgcccgtacggcacggccggtcctttcgaccgttcgtcgggg

SEQ ID NO: 208045 - DNA, 534 bp, Homo sapiens
  misc_feature: GYAE6OF02HTS46.17.25.C03.1.454.CMB.1.raw
  modified_base (464)..(464): a, c, t, g, unknown or other
  misc_feature (464)..(464): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggcgaaccctaacactggtgtacactagtgtcttcacccatcctccgggacagacttaccatgaccacgaactcctccaataaacacagcctacatggagttgaggagcctagacattctgacgacacggtcctacttattaacngtgcgagacgtccccacggattcccggtgacgcccgtacggcacggcggtccttttggacttcgtcgggg

SEQ ID NO: 208046 - DNA, 530 bp, Homo sapiens
  misc_feature: GYAE6OF02FVSAQ.17.25.C03.1.454.CMB.1.raw
  modified_base (333)..(333): a, c, t, g, unknown or other
  misc_feature (333)..(333): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatggggcgaaccctaanactggtgtcacagtgtcttcacccatccctccgggacagaccttaccatcgaccacgaactcctccaataaacacagcctacactggattggaggagcctgacatctggacgacgaccggccgtctattactgtcgcgagacgtcccagtctccggtgacgcccgtaggcacggccggtcctttgacttcgtcgggg

SEQ ID NO: 208047 - DNA, 518 bp, Homo sapiens
  misc_feature: GYAE6OF02F4YNL.17.25.C03.1.454.CMB.1.raw
  modified_base (331)..(331): a, c, t, g, unknown or other
  misc_feature (331)..(331): n is a, c, g, or t
  modified_base (423)..(423): a, c, t, g, unknown or other
  misc_feature (423)..(423): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaanactggtgtcacagtgtcttcacccatcctccgggacagacttaccatgaccacgaactcctccataaacacagcctacatggagttgaggancctgacatctgacgacacggccgtctattactgtgcgagacgtcccagatccggtgacgccgtacggcaggccggtcctttgaccttcgtcgggg

SEQ ID NO: 208048 - DNA, 519 bp, Homo sapiens
  misc_feature: GYAE6OF02F6LZ3.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatggggcaaccctaacactggtgtcacagtgtcttcacccatcctccgggacagacttaccatgaccacgaactcctaccaataaacacagccctacatggagttagaggagcctgacatctgaccgacacggcctctattactgtgcgagacgtcccacgactccggtgacgcctacggcagcggcctttgacttgtcgggg

SEQ ID NO: 208049 - DNA, 524 bp, Homo sapiens
  misc_feature: GYAE6OF02IPHPJ.17.25.C03.1.454.CMB.1.raw
  modified_base (457)..(457): a, c, t, g, unknown or other
  misc_feature (457)..(457): n is a, c, g, or t
  modified_base (482)..(482): a, c, t, g, unknown or other
  misc_feature (482)..(482): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggctctggattcacgtttacctcctatagtatcaactgggtgcgccaggccgctggacaacgacctgagtggatgggatgggcgaaccctaacactggtgtcacgagtgtcttcacccatcctcgggacagacttaccatcgaccacgaacctcctccaataaacacagcctacatggagttgaggagcctgacatctgacgacacggccgtctattacngtgcgagacgtcccacgactccggngacgtcccgtacggcgacgccggtcctttgaccttgtcgggg

SEQ ID NO: 208050 - DNA, 529 bp, Homo sapiens
  misc_feature: GYAE6OF02FGGF4.17.25.C03.1.454.CMB.1.raw
  modified_base (280)..(280): a, c, t, g, unknown or other
  misc_feature (280)..(280): n is a, c, g, or t
  modified_base (402)..(402): a, c, t, g, unknown or other
  misc_feature (402)..(402): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccagccgctggacaacgacctgagtggatgggatggggccgaaccctaacactgggtgtcacagtgtcttcacccatcctccgggacagacttaccatgaccacgactcctcaataaacncagcctacatggagttgaggacgcctagacatctagaccgacacggccgtactatactgtgcgagacgtcccacgactccggtgacgccgtaacggcaggccggtcctttcggaccttcgtcggggg

SEQ ID NO: 208051 - DNA, 531 bp, Homo sapiens
  misc_feature: GYAE6OF02HXV1A.17.25.C03.1.454.CMB.1.raw
  modified_base (358)..(358): a, c, t, g, unknown or other
  misc_feature (358)..(358): n is a, c, g, or t
  modified_base (487)..(487): a, c, t, g, unknown or other
  misc_feature (487)..(487): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatggggcgaaccctaacactggtgtcacagtgtcttcacccntccctccgggacagacttaccatcgaccacgactcctccaataaacacacgcctaacatggattggaggagcctgacatctgacgacacggcctctattactgtgcgagtagtcccaggactccgggtnacgcctacggctacggccggtctttacggaccttcggtacgggg

SEQ ID NO: 208052 - DNA, 547 bp, Homo sapiens
  misc_feature: GYAE6OF02JLZ6I.17.25.C03.1.454.CMB.1.raw
  modified_base (260)..(260): a, c, t, g, unknown or other
  misc_feature (260)..(260): n is a, c, g, or t
  modified_base (290)..(290): a, c, t, g, unknown or other
  misc_feature (290)..(290): n is a, c, g, or t
  modified_base (408)..(408): a, c, t, g, unknown or other
  misc_feature (408)..(408): n is a, c, g, or t
  modified_base (421)..(421): a, c, t, g, unknown or other
  misc_feature (421)..(421): n is a, c, g, or t
  modified_base (441)..(441): a, c, t, g, unknown or other
  misc_feature (441)..(441): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttaccncctatagtatcaactgggtgcgccaggccnctggacaacgacctgagtggatgggatggcgaacctagactggtgtcacagtgtcttcacccatcctccgggacagaccttacatcgacccagaacctccacaataaacacagcctanatggattgaggcncctagacatcgtagacgacncggccttactactttcgagtgacgtacgacgttcccaacggtgttcccggtgacgtccgtaaccgggctaacggccgggtccttttacggaccgtttgtccggggg

SEQ ID NO: 208053 - DNA, 547 bp, Homo sapiens
  misc_feature: GYAE6OF02IDQCC.17.25.C03.1.454.CMB.1.raw
  modified_base (301)..(301): a, c, t, g, unknown or other
  misc_feature (301)..(301): n is a, c, g, or t
  modified_base (381)..(381): a, c, t, g, unknown or other
  misc_feature (381)..(381): n is a, c, g, or t
  modified_base (397)..(397): a, c, t, g, unknown or other
  misc_feature (397)..(397): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtaatcagcagaaacctggaaaacgccccagacctcctgatctctggtncatccactctgcgaagtggcgtcccatcgaggttcaggtgcagtgatctgggacagtatttcaatctcacatcacactcngcaacctgagattgtnactaatctaactactgtacaacagtaacgttacacgttcccctgccttactttcggaccgtaaggggaccctaaggttcgaagtaacgtaaccaaaaccggtaacgttggtacggccttacggaccctaaccctacgttcctagttaccc

SEQ ID NO: 208054 - DNA, 517 bp, Homo sapiens
  misc_feature: GYAE6OF02G9IRP.17.25.C03.1.454.CMB.1.raw
  modified_base (410)..(410): a, c, t, g, unknown or other
  misc_feature (410)..(410): n is a, c, g, or t
  modified_base (423)..(423): a, c, t, g, unknown or other
  misc_feature (423)..(423): n is a, c, g, or t
  modified_base (448)..(448): a, c, t, g, unknown or other
  misc_feature (448)..(448): n is a, c, g, or t
  modified_base (463)..(463): a, c, t, g, unknown or other
  misc_feature (463)..(463): n is a, c, g, or t
  modified_base (481)..(481): a, c, t, g, unknown or other
  misc_feature (481)..(481): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgcaggccgctggacaacgacctgagtggatgggatgggcaaccctaacactggtgtcacagtgtcttcacccatcctcgggacagacttaccatcgaccacgactcctccaataaaccactagacctanatggagttgaggncctgacatctgacgtacacggcctntattactgtcgcgangtccccaggtctccggtnacgccctaggcaggccgtcctttggactttgcgggg

SEQ ID NO: 208055 - DNA, 503 bp, Homo sapiens
  misc_feature: GYAE6OF02IB4TY.17.25.C03.1.454.CMB.1.raw
  modified_base (484)..(484): a, c, t, g, unknown or other
  misc_feature (484)..(484): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctcctgtctgcctctgtgggggtcagagtcaccatcacttgccggacaagtcacggacgttaaaacctatttaaattggtatcagcagaaacctggaaaagccccagacctcctgatctctggtgcatccactctgcgaagtggcgtcccatcgagttcagtgcagtggatctgggacagatttcaatctcacatcaccactctgcaacctgagattgtgactaatctactactgtacaacagagttacacgttcccctcgtactctttcggaccgagggacctaagttgagaactacaaacgaacgtgnggctgacacctatctgtcc

SEQ ID NO: 208056 - DNA, 522 bp, Homo sapiens
  misc_feature: GYAE6OF02HMH7I.17.25.C03.1.454.CMB.1.raw
  modified_base (448)..(448): a, c, t, g, unknown or other
  misc_feature (448)..(448): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctcgggacagacttaccatcgaccacgaactcctaccataaacacagcctacatggagttgaggagcctgacatctgacgacacggcctntattactgtgcgagacgtcccaggtctccggtgacgtccgtacggcaggccggtcctttggaccttcgtcgggg

SEQ ID NO: 208057 - DNA, 521 bp, Homo sapiens
  misc_feature: GYAE6OF02FVZS2.17.25.C03.1.454.CMB.1.raw
  modified_base (331)..(331): a, c, t, g, unknown or other
  misc_feature (331)..(331): n is a, c, g, or t
  modified_base (458)..(458): a, c, t, g, unknown or other
  misc_feature (458)..(458): n is a, c, g, or t
  modified_base (483)..(483): a, c, t, g, unknown or other
  misc_feature (483)..(483): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaanactggtgtcacagtgtcttcacccatcctccgggacagaccttaccatcgaccacgaactcctccaataaacacacgcctaacatggagttgaggagcctgacatctgacgcacggcctctattacngtgcgagacgtcccagctccgggtnacgccgtaggcaggccggtcctttggaccttgtcgggg

SEQ ID NO: 208058 - DNA, 578 bp, Homo sapiens
  misc_feature: GYAE6OF02IESU6.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcaagaaacctggaaaacgcccccagacctcctgatctctggtgcatccactctgcgaagtggcgtcccatcgagttcagtggcagtggatcgtgggacagtatttcaatctcaccatccaccactctcgccaactgacgtattgtgactaattcctaactactgtacaactagtacgttactacgtttcccctcgtaccttacgttttcggaccgtagggggtaaccctaaggtttacggaacgtaacttaaccgaaaaccggtaacgttacggttacgggtaccttacggaccctaacccgtacgttccgttagttaccc

SEQ ID NO: 208059 - DNA, 526 bp, Homo sapiens
  misc_feature: GYAE6OF02GXBXJ.17.25.C03.1.454.CMB.1.raw
  modified_base (427)..(427): a, c, t, g, unknown or other
  misc_feature (427)..(427): n is a, c, g, or t
  modified_base (454)..(454): a, c, t, g, unknown or other
  misc_feature (454)..(454): n is a, c, g, or t
  modified_base (488)..(488): a, c, t, g, unknown or other
  misc_feature (488)..(488): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggcgaaccctaacactggtgtcacagtgtcttcacccatcctccgggacagaccttaccatcgaccacgaactcctaccataaacacagcctacatggagttgaggancctagacatctgacgacgacggccgtntattactgtgcgagacgtcccacggctccgggtnacggcctacggcaggccggtcctttgaccttgtcgggg

SEQ ID NO: 208060 - DNA, 546 bp, Homo sapiens
  misc_feature: GYAE6OF02IWXOX.17.25.C03.1.454.CMB.1.raw
  modified_base (281)..(281): a, c, t, g, unknown or other
  misc_feature (281)..(281): n is a, c, g, or t
  modified_base (433)..(433): a, c, t, g, unknown or other
  misc_feature (433)..(433): n is a, c, g, or t
  modified_base (447)..(447): a, c, t, g, unknown or other
  misc_feature (447)..(447): n is a, c, g, or t
  modified_base (454)..(454): a, c, t, g, unknown or other
  misc_feature (454)..(454): n is a, c, g, or t
  modified_base (457)..(457): a, c, t, g, unknown or other
  misc_feature (457)..(457): n is a, c, g, or t
  modified_base (464)..(464): a, c, t, g, unknown or other
  misc_feature (464)..(464): n is a, c, g, or t
  modified_base (500)..(500): a, c, t, g, unknown or other
  misc_feature (500)..(500): n is a, c, g, or t
  modified_base (507)..(507): a, c, t, g, unknown or other
  misc_feature (507)..(507): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaaactgggtncgccaggccgctggacaacgacctgagtggatggggatggggacaaccctaacacgtggtgtcaacgagtcgtcttccaccccatcccgtccgggaacacggtaaccttaccatcgaccaaccgaacctcctaccaataaacacagacctanatggattggagacncctgacntcngacgacncgtccgtactacttactgtgcgagacgtcccacgtntccggtnacgtcctacggcaggccgtcgtttcgacgttcgtcgggg

SEQ ID NO: 208061 - DNA, 526 bp, Homo sapiens
  misc_feature: GYAE6OF02GLZ9S.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatgggcgaaccctaacactggtgtcacagtgtcttcacccatcctccgggacagacttaccatcgaccacgaacctcctaccaataaaccacacgcctacatggagttgaggagcctgacatcagacacgaccggccgtcttattactgtgcgagacgtcccagtctccggtgacgccgtacggcaggccggcctttgacttcgtcgggg

SEQ ID NO: 208062 - DNA, 530 bp, Homo sapiens
  misc_feature: GYAE6OF02G4XOA.17.25.C03.1.454.CMB.1.raw
  modified_base (280)..(280): a, c, t, g, unknown or other
  misc_feature (280)..(280): n is a, c, g, or t
  modified_base (411)..(411): a, c, t, g, unknown or other
  misc_feature (411)..(411): n is a, c, g, or t
  modified_base (431)..(431): a, c, t, g, unknown or other
  misc_feature (431)..(431): n is a, c, g, or t
  modified_base (434)..(434): a, c, t, g, unknown or other
  misc_feature (434)..(434): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggcaaccctaacactggtgtcacagtgtcttcacccatccgtccgggacagaccttaccatcgaccacgaactcctacataaacacagcctanatggagttgagagcctgacntcngaccgacacggcctactattactgtgcgagacgtcccacggctcccggtagacgtcccgtacggcacggccggtcctttcggaccgttcgtcgggg

SEQ ID NO: 208063 - DNA, 590 bp, Homo sapiens
  misc_feature: GYAE6OF02J24KK.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacagtcacggcgttaaaacctattaaatggtatcagcagaaacctggaaaacgccccagacctcctgactctctggtgcatccactctcgacgaagtcgcgtccatcgagttcagtgcagtgatcgtggacagtattcaatctcacctatcaccactctcgacaacgtgtacggtattcgtagactaagttcctaacttactacgtaccaacgtaacgtaacgtttaccgtaaccgttcccttaccgtaccttaccgttttacggaccgtaacgggtaacctaaggttcgtaacggtaacttaccgaaaacggtaaccgttaggtacggtaccgttacggtacctaaccgtactaccgttcggttaaccc

SEQ ID NO: 208064 - DNA, 516 bp, Homo sapiens
  misc_feature: GYAE6OF02F4RDS.17.25.C03.1.454.CMB.1.raw
  modified_base (481)..(481): a, c, t, g, unknown or other
  misc_feature (481)..(481): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggcgaaccctaacactgggtgtcacagtgtcttcacccatcctcgggacagacttaccatcgaccacgaactcctcaataaacacagcctacatggagttgaggagcctgacatctgacgacacggccgtctattactgtcgcgagcgtcccagactccggngagcctaggcacggccgtctttgacttcgtcgggg

SEQ ID NO: 208065 - DNA, 618 bp, Homo sapiens
  misc_feature: GYAE6OF02FY1NQ.17.25.C03.1.454.CMB.1.raw
  modified_base (285)..(285): a, c, t, g, unknown or other
  misc_feature (285)..(285): n is a, c, g, or t
  modified_base (377)..(377): a, c, t, g, unknown or other
  misc_feature (377)..(377): n is a, c, g, or t
  modified_base (413)..(413): a, c, t, g, unknown or other
  misc_feature (413)..(413): n is a, c, g, or t
  modified_base (421)..(421): a, c, t, g, unknown or other
  misc_feature (421)..(421): n is a, c, g, or t
  modified_base (437)..(437): a, c, t, g, unknown or other
  misc_feature (437)..(437): n is a, c, g, or t
tcagcgtagactagcacgaccggtgctcgatttagtagtgtagatttgggtttgggggacgtcaacaaccacattctgtcctctagtagaaaaccctgtgagcacagctcctcaccatggactggacctgggaggatcctcttcttggtggcagcagctacaagtgcccactcccaggtgcagctggtgcagtctggggctgaggtgaagaagcctggggcctcagtgaaggtctccgtgcaaggcttctggattcacgtttacctctatagtatcaactgggtncgccaggccgctggaccacgacctgagtggatggggatgggacgaaccctaacactggtgtcacaggtgtcttacacccatccgtccggganagtacttaccatcgaccacgaactcctacataaacncagcctanatggagttgaggtacncctagactagtccttaggaccgtacgaccgggtcccgtaccttaagttaccgtggtcgaccggtaacgtaccgtccccgtaacggtaacgttccccggggtagaacccggaccccggttaacgggccctaacgggtccccggggttcccctttttcgggacctttcccgggtaccgggggg

SEQ ID NO: 208066 - DNA, 529 bp, Homo sapiens
  misc_feature: GYAE6OF02GTEPO.17.25.C03.1.454.CMB.1.raw
  modified_base (406)..(406): a, c, t, g, unknown or other
  misc_feature (406)..(406): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctcgggacagacttaccatcgaccacgactcctcataacacagcctanatggagttgagagcctagacatcgtagacgacgacggccgtactattacgtcgtgcgagacgtcccagtctccggtagacgaccgtacggccacggccggtcctttggaccttcgtaccgggg

SEQ ID NO: 208067 - DNA, 657 bp, Homo sapiens
  misc_feature: GYAE6OF02JYNO7.17.25.C03.1.454.CMB.1.raw
  modified_base (278)..(278): a, c, t, g, unknown or other
  misc_feature (278)..(278): n is a, c, g, or t
  modified_base (288)..(288): a, c, t, g, unknown or other
  misc_feature (288)..(288): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctggggcctcagtgaaggtctcctgcaaggcttctggattcacgtttacctcctatagtatcaactgggtncgccaggccnctggacaacgacctgagtggatgggatgggccgaacctagactggtgtcacgagtgtcttcgaccctatccgtccgggacacgacttaccatcgaccacgaactcctacataaccacacgaccctagacttgggacgttaggacggtacgacccgttgaacccgtattaccgtacggaaccggaccgtaacccggggtacccgtttaccttaacgttttaccgtacgggttcggtaccggaaccggtacgttacccccggtaacgggtaccttacccggggtcgtaaacccgggtcccgtaaccgggggtcccgtaacgggtcccggggttacccctttttacgggtacccgtttccgggtccgggggg

SEQ ID NO: 208068 - DNA, 519 bp, Homo sapiens
  misc_feature: GYAE6OF02FXYZE.17.25.C03.1.454.CMB.1.raw
  modified_base (331)..(331): a, c, t, g, unknown or other
  misc_feature (331)..(331): n is a, c, g, or t
  modified_base (403)..(403): a, c, t, g, unknown or other
  misc_feature (403)..(403): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaanactggtgtcacagtgtcttcacccatcctccgggacacgtacttaccatgaccacgaactcctccataaacncacgcctacatggagttgagagcctgacatctgacacgacggcctctattactgtcgcgagacgtcccacggatccggtgacgccgtacggcagccggtcttcgaccttgtcgggg

SEQ ID NO: 208069 - DNA, 561 bp, Homo sapiens
  misc_feature: GYAE6OF02HIJ68.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaacgccccagacctcctgatctctggtgcatccactctgcgaagtggcgtcccatcgagttcagtggcagtggatcgtgggacagtatttcaatctcaccatcaccactctgcaacctgaggattgtgacaatctactactgtacaacagtacgttacacgttcccctcgtccttacgttttcggccgtaacggggtaccgtaaggttacgtaacggtaactaaccgaaaacggtaaccgttacggttacggtccgttacggtacctaacccgtacgttccgtgtttaccc

SEQ ID NO: 208070 - DNA, 527 bp, Homo sapiens
  misc_feature: GYAE6OF02HNKNQ.17.25.C03.1.454.CMB.1.raw
  modified_base (280)..(280): a, c, t, g, unknown or other
  misc_feature (280)..(280): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatggggacaaccctaacactggtgtcacagtgtcttcacccatcctcgggacagacttaccatcgaccacgaacctcctaccaataaacacacgacctacagtggagttgaggacgcctgacatctagacgacacggcctcttattactgtgacgagacgtcccacgtctccggtgacgtcctagtcggcaggccggtcctttggacttcgg

SEQ ID NO: 208071 - DNA, 532 bp, Homo sapiens
  misc_feature: GYAE6OF02G2MWR.17.25.C03.1.454.CMB.1.raw
  modified_base (280)..(280): a, c, t, g, unknown or other
  misc_feature (280)..(280): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggcgaaccctaacactggtgtcacagtgtcttcacccatcctcgggacagacttaccatcgaccacgaacctcctccaataaaccacacgcctacatggagttgagagcctgacatctgacgacacggccgtatattactgtgcgagcgtcccacgactccggtagacgcccgtacgggcacggtccgtccgttttcggaccttcgtccggggg

SEQ ID NO: 208072 - DNA, 594 bp, Homo sapiens
  misc_feature: GYAE6OF02IGYBC.17.25.C03.1.454.CMB.1.raw
tcagcgtagactagcacgaccggtgctcgatttagtagtgtagatttgggtttggggagtcagtctcagtcaggacacagcatggacatgagggtccccgactcagctcctggggctcctgctacgtctggctccgagctgccagatgtgacatccagatgacccagtctccatcctccctgtcgtgcctctgtgggggtcagagtcgaccatcacttgccggactaagtcacggacgttaaaaacctatttaaattggtatcagtcagaaacctggaaaacgccccagacctcctagactcctactgggtcgcgattccacgtctgcggaaagtggtccgtaccccagtcggaggttcagtggcagtgatcgagggacagatttcgaatctcactatcaccactctagccaaccgtgacgtattgtagactaagtcttactacgtcgacaacgtagtaagttactacgttccctcgaccttacgtttacggaccgtaacggggtaactaaggttggaacgtaacgttaaccgaaacggttaaccgttaggtacggtaccgtacggtacctaaccgtagttccgtagttacccg

SEQ ID NO: 208073 - DNA, 542 bp, Homo sapiens
  misc_feature: GYAE6OF02JAJWQ.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaacgccccagacctcctgatctctggtgcatccactctgcgaagtggctcccatcgaggttcagtgcagtggatcgtgggacagtatttcaattctacaccatccaccactctgaccaacctgagtattgtgactaattctaactactcgtacaacagtacgttactacgttcccctcgtccttacgtttcggaccgtaaggggtacctaagttaggaacgtaactaaccgaaacgtaactgtacggtctacgacctacctattcctgttcc

SEQ ID NO: 208074 - DNA, 534 bp, Homo sapiens
  misc_feature: GYAE6OF02HWG22.17.25.C03.1.454.CMB.1.raw
  modified_base (280)..(280): a, c, t, g, unknown or other
  misc_feature (280)..(280): n is a, c, g, or t
  modified_base (331)..(331): a, c, t, g, unknown or other
  misc_feature (331)..(331): n is a, c, g, or t
  modified_base (467)..(467): a, c, t, g, unknown or other
  misc_feature (467)..(467): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgactgagtggatggggatgggcgaaccctaanacgtggtgtcacagtgtcttcacccatcctcgggacagacttaccatcgaaccacgaactccctaccaataaaccacacgcctaacagtggattggacgagcctagacatctagacgacacggccgtctattctgngcgagacgtcccaggactcccggtgacgtaccgtacggcaggccggtcctttggaccttcgtcgggg

SEQ ID NO: 208075 - DNA, 533 bp, Homo sapiens
  misc_feature: GYAE6OF02F8SRP.17.25.C03.1.454.CMB.1.raw
  modified_base (331)..(331): a, c, t, g, unknown or other
  misc_feature (331)..(331): n is a, c, g, or t
  modified_base (338)..(338): a, c, t, g, unknown or other
  misc_feature (338)..(338): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaanactggtntcacagtgtcttcacccatcctccgggacagacttaccatgaccacgaactcctaccaataaacacacgcctacatggagttgaaggagcctgacatctgacgacacggccgtactattactgtgacgagacgtccccaaggctccgggtgacgtcccgtacggcacggtccggtccttttgaccttcgcggggg

SEQ ID NO: 208076 - DNA, 571 bp, Homo sapiens
  misc_feature: GYAE6OF02ITFXC.17.25.C03.1.454.CMB.1.raw
  modified_base (280)..(280): a, c, t, g, unknown or other
  misc_feature (280)..(280): n is a, c, g, or t
  modified_base (471)..(471): a, c, t, g, unknown or other
  misc_feature (471)..(471): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggcgaacctacactggtgtcacagtgtcttcaccatcctcgggacagactaccatgaccacgaactcctacaataacacagcctacatggagttgaggacgcctagacctatctaggaccgaccgtaccgggcccgttcgtaacttttaccgnggttcgacggacgtacggtccccaggacgttcccgggaggtaaccgcccgttaacggacctacgggcccggttccgtttacgaccgttccgtaccggggg

SEQ ID NO: 208077 - DNA, 520 bp, Homo sapiens
  misc_feature: GYAE6OF02F7YO5.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactcgcacagaagttccagggcagactcaccataaccgcgacaaattaacgaacacagtaatctgagctgaacagcctgtcatctgagacacgggcttctacttctgtgcgagagtaattactatacactgctccttttacaccttcccttgacttcgtgggccatcgacccgtcg

SEQ ID NO: 208078 - DNA, 511 bp, Homo sapiens
  misc_feature: GYAE6OF02FPZ7F.17.25.C03.1.454.CMB.1.raw
  modified_base (368)..(368): a, c, t, g, unknown or other
  misc_feature (368)..(368): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatcgtgggacagatttcaatctnacccccatcaccactctcgcaacctgaggattgtgcaatctactactgtacaacagagttactacgttccctcgtctactttcggccgacgggtaccaagttcgagtaatacaaacgaactgtggctcgaccaccatctgtcc

SEQ ID NO: 208079 - DNA, 531 bp, Homo sapiens
  misc_feature: GYAE6OF02FXL78.17.25.C03.1.454.CMB.1.raw
  modified_base (280)..(280): a, c, t, g, unknown or other
  misc_feature (280)..(280): n is a, c, g, or t
  modified_base (327)..(327): a, c, t, g, unknown or other
  misc_feature (327)..(327): n is a, c, g, or t
  modified_base (334)..(334): a, c, t, g, unknown or other
  misc_feature (334)..(334): n is a, c, g, or t
  modified_base (420)..(420): a, c, t, g, unknown or other
  misc_feature (420)..(420): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtgacagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgcctgagtggatgggatgggcaacctanactggtntcacagtgtcttcacccatcctcgggacagacttaccatgaccacgaactcctaccataaacacacgcctacatggagttgaggancctgacatctgacgacgacggtccgtactacttactgtcgacgagtacgtcccaacggtatccggtagacgccgtacggcacggccggtcctttggtaccttgtaccgggg

SEQ ID NO: 208080 - DNA, 533 bp, Homo sapiens
  misc_feature: GYAE6OF02JNEN9.17.25.C03.1.454.CMB.1.raw
  modified_base (279)..(279): a, c, t, g, unknown or other
  misc_feature (279)..(279): n is a, c, g, or t
  modified_base (338)..(338): a, c, t, g, unknown or other
  misc_feature (338)..(338): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaatgggtncgccaggccgctggacacgacctgacgtggatgggatggggcaacccgtaacactggtntcgacagtgtcttcacccatccctcgggacaggacttaccatcgaccacgaacctcctacataaacacagcctacatgattgagtagcctgacatctgacgacacggcctactattacgtgtgcgagacgtcccaacgctcccggtagacgtccctaacggccacggccggtccctttggaccttcgtacggggg

SEQ ID NO: 208081 - DNA, 511 bp, Homo sapiens
  misc_feature: GYAE6OF02GE7TU.17.25.C03.1.454.CMB.1.raw
  modified_base (454)..(454): a, c, t, g, unknown or other
  misc_feature (454)..(454): n is a, c, g, or t
  modified_base (470)..(470): a, c, t, g, unknown or other
  misc_feature (470)..(470): n is a, c, g, or t
  modified_base (477)..(477): a, c, t, g, unknown or other
  misc_feature (477)..(477): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaaggcttctggattcacgtttacctcctatagtatcaactgggtgcgccaggccgctggacaacgacctgagtggatgggatggggcgaaccctaacactggtgtcacagtgtcttcacccatcctccgggacagacttaccatgaccacgaactcctccataaacacagcctacatggattgaggagcctgacatctgacgacacggccgtctattacngtgcgagagtcccagntccggtnagcctaggcaggcggcctttggaccttgtcgggg

SEQ ID NO: 208082 - DNA, 503 bp, Homo sapiens
  misc_feature: GYAE6OF02FM5AH.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaacgccccagacctcctgatctctggtgcatccactctgcgaagtggctcccatcgaggttcagtggcagtggatcgtgggacagtatttcaatcctcaccatcaccactctgcaacctgagattgtgcaatctactactgtacaacagtagttacacgttccctcgtctactttcggccgtagggacctaagttgagtatacaaacgaacgttgtgctgccacatctgtc

SEQ ID NO: 208083 - DNA, 559 bp, Homo sapiens
  misc_feature: GYAE6OF02HSOCY.17.25.C03.1.454.CMB.1.raw
  modified_base (416)..(416): a, c, t, g, unknown or other
  misc_feature (416)..(416): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcttaaaacctatttaaattggtatcagcagaaacctggaaaacgccccagacctcctgatctctggtgcatccactctgcgaagtggctcccatcgagttcagtgcagtggatcgtgggacagtatttcaatctcaccatcacctactctgcaactgagattgtgactaatctactactgtaccaanagtaacgttacacgtttcccctcgtccttacgttttcggaccgtaacggggtaaccctaaaggttcgaacggtaactaaccgtaaaacggtaaccgttggtacggaccgtacggaccctaaccgtaacgttccgttagttccc

SEQ ID NO: 208084 - DNA, 522 bp, Homo sapiens
  misc_feature: GYAE6OF02HKKWS.17.25.C03.1.454.CMB.1.raw
  modified_base (412)..(412): a, c, t, g, unknown or other
  misc_feature (412)..(412): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaaattggtatcagcagaaacctggaaaacgccccagacctcctgatctctggtgcatccactctgcgaagtggcgtcccatcgagttcagtggcagtggatcgtgggacagtatttcaatctcaccatcaccactctcgcaacctgagattgtgcaatctactactntacaacagtagttactacgttccctcgtctacgtttcggaccgtacgggacctaagttagaagtaactacaaacgtaacttagtaggtctacgaccacctatcttagttc

SEQ ID NO: 208085 - DNA, 585 bp, Homo sapiens
  misc_feature: GYAE6OF02GFYZV.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgcgtggacaacgacctgagtggatgggatgggcgaacctacgactggtgtcacagtgtcttcacccatccgtcgggacacgacttaccgatcgaccacgaacctcctaccaataaaccacacgacctacagtggagttgaggacgcctagacacgtctacggaaccgaccgaccgggtcccgttacttaacgttacgtcggtacgacgaacggtaccgtaccccgacggtacgttcccgggtagaccgtcccgtacggcgtacggtccggtccttttggaccgttcggtccggggg

SEQ ID NO: 208086 - DNA, 518 bp, Homo sapiens
  misc_feature: GYAE6OF02HWVJZ.17.25.C03.1.454.CMB.1.raw
  modified_base (429)..(429): a, c, t, g, unknown or other
  misc_feature (429)..(429): n is a, c, g, or t
  modified_base (483)..(483): a, c, t, g, unknown or other
  misc_feature (483)..(483): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggcgaaccctaacacgtggtgtcacagtgtcttcacccatcctcgggacagacttaccatcgaccacgaacctcctccaataaaccacacgcctacatggagttgaggancctgacatctgaccgcacggcctctattactgtgcgagacgtcccagctccggnacgcctaggcaggccgtcctttgaccttgtcgggg

SEQ ID NO: 208087 - DNA, 521 bp, Homo sapiens
  misc_feature: GYAE6OF02GIKTS.17.25.C03.1.454.CMB.1.raw
  modified_base (331)..(331): a, c, t, g, unknown or other
  misc_feature (331)..(331): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaanactggtgtcacagtgtcttcacccatcctccgggacagacttaccatgaccacgaactcctccataaacacagcctacatggagttgaggagcctgacatctgacgacacggccgtctattactgtgcgagacgtcccacggatccggtgacgcctacggcacggccggtcctttggaccttcgtcgggg

SEQ ID NO: 208088 - DNA, 534 bp, Homo sapiens
  misc_feature: GYAE6OF02HKMZZ.17.25.C03.1.454.CMB.1.raw
  modified_base (332)..(332): a, c, t, g, unknown or other
  misc_feature (332)..(332): n is a, c, g, or t
  modified_base (429)..(429): a, c, t, g, unknown or other
  misc_feature (429)..(429): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggcgaaccctaanactggtgtcacagtgtcttcacccatccgtccgggacagtacttaccatcgaccacgaactcctaccataaacacagcctacatggagttgaggacncctagacatctgacgacacggcctactattcgtgtcgcgagacgtcccacgacgtccggagacgtcccgtacggcacggccggtcctttggaccgttcgtcgggg

SEQ ID NO: 208089 - DNA, 609 bp, Homo sapiens
  misc_feature: GYAE6OF02HNSQP.17.25.C03.1.454.CMB.1.raw
  modified_base (418)..(418): a, c, t, g, unknown or other
  misc_feature (418)..(418): n is a, c, g, or t
  modified_base (428)..(428): a, c, t, g, unknown or other
  misc_feature (428)..(428): n is a, c, g, or t
  modified_base (452)..(452): a, c, t, g, unknown or other
  misc_feature (452)..(452): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggaccaacgacctgagtggagtgggatggggaccgaaccctaacgacgtggtgtacacgagtgtccttcacccatcccgtcgggacagaccttaccatcgaccacgaacctcctaccaataaaccncacgcctaanagtggagttgaggacgcctagacntcgtgaaccgacgaccggcccgttacttaatttaccgtgtacggacgacgtacgttacccccgaaggtacgttcccggggtagaaccgggtccccgttaacggggcctaaccgggcccggtttcccgttttacggtaccgtttcccggtacgggggg

SEQ ID NO: 208090 - DNA, 526 bp, Homo sapiens
  misc_feature: GYAE6OF02GCE87.17.25.C03.1.454.CMB.1.raw
  modified_base (338)..(338): a, c, t, g, unknown or other
  misc_feature (338)..(338): n is a, c, g, or t
  modified_base (454)..(454): a, c, t, g, unknown or other
  misc_feature (454)..(454): n is a, c, g, or t
  modified_base (465)..(465): a, c, t, g, unknown or other
  misc_feature (465)..(465): n is a, c, g, or t
  modified_base (469)..(469): a, c, t, g, unknown or other
  misc_feature (469)..(469): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaacctaacactggtntcacagtgtcttcacccatcctcgggacagaccttaccatgacccacgaacctcctccaataaacacagcctaacatggagttgaggagcctagacatctgaccgacacggccgtntattactggtncgancgtcccaggactccggtgacgtcctacggcaggccggtctttcggacttcgtcgggg

SEQ ID NO: 208091 - DNA, 534 bp, Homo sapiens
  misc_feature: GYAE6OF02F3ZV9.17.25.C03.1.454.CMB.1.raw
tcagcgtagactagcacgaccggtgctcgatttagtagtgtagatttgggtttggggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatcgtgggacagtatttcaattcctcaccatcaccactctgcaacctgaggtattgtgacaattctactactgtacaacagtacgttactacgttcccctcgtcctacgttttcggaccgtacggggaacctaagttggacgtaactaaccgaaacgtaactgtaggtctgccacctattcgtgttcc

SEQ ID NO: 208092 - DNA, 525 bp, Homo sapiens
  misc_feature: GYAE6OF02GMI6Y.17.25.C03.1.454.CMB.1.raw
  modified_base (429)..(429): a, c, t, g, unknown or other
  misc_feature (429)..(429): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatccctccgggacagaccttaccatcgaccacgaactcctccaataaaccacagcctaacatggagttgaggancctgacatctgacgacacggccgtctattactgtgcgagacgtcccacgatcccggtgacgcctacggcaggccggtcctttgaccttcgtcgggg

SEQ ID NO: 208093 - DNA, 545 bp, Homo sapiens
  misc_feature: GYAE6OF02ICKJB.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggccgaaccctaacactggtgtcacagtgtcttcacccatcctccgggacagacttaccatcgaccacgaactcctacataaacacacgcctacatggagttgaggagcctagacatctgacgacaccgggcctacttaacttactgtcgcgagacgtaccccagacgtccgggtgaccggtcccgtacggcaggcccggtaccttttcggaccttgtaccggggg

SEQ ID NO: 208094 - DNA, 530 bp, Homo sapiens
  misc_feature: GYAE6OF02JAKF8.17.25.C03.1.454.CMB.1.raw
  modified_base (332)..(332): a, c, t, g, unknown or other
  misc_feature (332)..(332): n is a, c, g, or t
  modified_base (436)..(436): a, c, t, g, unknown or other
  misc_feature (436)..(436): n is a, c, g, or t
  modified_base (454)..(454): a, c, t, g, unknown or other
  misc_feature (454)..(454): n is a, c, g, or t
  modified_base (462)..(462): a, c, t, g, unknown or other
  misc_feature (462)..(462): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggacgaaccctaanctggtgtcacagtgtcttcacccatcctcgggacacgacttaccatcgaccacgaacctcctacaataaacacagacctacagtgagttgaggactcctgaccntctgacgacacggtcctntattacgngtgacgtagacgtcccaggcgtccggtgacgccgtacggcaggccgtccgtttgacgtttcggcgggg

SEQ ID NO: 208095 - DNA, 574 bp, Homo sapiens
  misc_feature: GYAE6OF02IG1TZ.17.25.C03.1.454.CMB.1.raw
  modified_base (351)..(351): a, c, t, g, unknown or other
  misc_feature (351)..(351): n is a, c, g, or t
  modified_base (400)..(400): a, c, t, g, unknown or other
  misc_feature (400)..(400): n is a, c, g, or t
  modified_base (425)..(425): a, c, t, g, unknown or other
  misc_feature (425)..(425): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgcctgatgtgacatccagatgacccagtctccatcctccctgtctgcctctgtgggggtcagagtcaccatcacttgccggacaagtcacggcgttaaaacctatttaaattggtatcagcaagaaacctggaaaacgccccagaccctcctgatctctggtgcatccactctgcgaagtggctcccatcgaggttcagtgcaggtgatcgngggacagatttcaatctcaccatccaccactctgacaactgagtattgngactaatacttactactgtaccaanagtaacgttactacgttccccctacgtaccttaccgttttcggaccgtaacggggtaacctaaacggtttaggaacgtaacgttaaccgaaaacgtaaccgttaggtacggtaccgtacggaccctaacctacttccgttagttacccg

SEQ ID NO: 208096 - DNA, 719 bp, Homo sapiens
  misc_feature: GYAE6OF02HNB4E.17.25.C03.1.454.CMB.1.raw
  modified_base (261)..(261): a, c, t, g, unknown or other
  misc_feature (261)..(261): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttaccncctatagtatcaacgtgggtgcgccgaggccgctggacaacgacctgagtggatgggatggggacgaaccctaacgactagggtcgtacacgagtcgtcttccaccctatcccgtccggggaacacgtacgttacccaatcgaacccgaccgaacctccctaaccaacttaaaaccgacaacggtaccctaactaagttaccggggtaagtttacgggaacgggaacgtacccgttaggaaccctaacgttacgttaccgggaaaccgtaaacccgacccggggtacccgtttacctttaactttaacggtacgttacggacggtaacgtaccgggttacccccgaacgggtacttaccccggggggttagaaccggaccccggttaacccgggacgtacgggtaccccggggtttacctttttacccgggtacggtttacccgggtacccggggggg

SEQ ID NO: 208097 - DNA, 523 bp, Homo sapiens
  misc_feature: GYAE6OF02GCUCA.17.25.C03.1.454.CMB.1.raw
  modified_base (330)..(330): a, c, t, g, unknown or other
  misc_feature (330)..(330): n is a, c, g, or t
  modified_base (406)..(406): a, c, t, g, unknown or other
  misc_feature (406)..(406): n is a, c, g, or t
  modified_base (427)..(427): a, c, t, g, unknown or other
  misc_feature (427)..(427): n is a, c, g, or t
  modified_base (452)..(452): a, c, t, g, unknown or other
  misc_feature (452)..(452): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtgcgccaggccgctggacaacgacctgagtggatgggatgggcgaaccctaanactggtgtcacagtgtcttcacccatcctccgggacagactacatcgaccacgaactcctcataaacacagcctanatggagttgaggagcctgacntctgacgacacggcctactattacngtgcgagacgtcccgacgtagtcccggtagacgtcctacggcaggccgtccgtttgaccgttcgtacgggg

SEQ ID NO: 208098 - DNA, 524 bp, Homo sapiens
  misc_feature: GYAE6OF02IMLB0.17.25.C03.1.454.CMB.1.raw
  modified_base (334)..(334): a, c, t, g, unknown or other
  misc_feature (334)..(334): n is a, c, g, or t
  modified_base (463)..(463): a, c, t, g, unknown or other
  misc_feature (463)..(463): n is a, c, g, or t
  modified_base (480)..(480): a, c, t, g, unknown or other
  misc_feature (480)..(480): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggcgaaaccctaanactggtgtcacagtgtcttcacccatcctcgggacagacttaccatcgaccacgaacctcctaccaataaacacacacctacatggagttgaggagcctgacatctgacgacacggccgtactattacngtgcgagcgtcccacgntccggtgacgcctacggcacggccggtcctttgaccttgcgggg

SEQ ID NO: 208099 - DNA, 522 bp, Homo sapiens
  misc_feature: GYAE6OF02HYKZG.17.25.C03.1.454.CMB.1.raw
  modified_base (423)..(423): a, c, t, g, unknown or other
  misc_feature (423)..(423): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgactgagtggatggggatggggcgaaccctaacactggtgtcacagtgtcttcacccatcctccgggacagacttaccatgaccacgactcctccaataaacacagcctacatggagttgagancctgacatctgacgacacggccgtctattctgtgcgagacgtcccacggactccggtgacgtccctaggcacggccggtccctttgaccgttgtcgggg

SEQ ID NO: 208100 - DNA, 527 bp, Homo sapiens
  misc_feature: GYAE6OF02F6X93.17.25.C03.1.454.CMB.1.raw
  modified_base (298)..(298): a, c, t, g, unknown or other
  misc_feature (298)..(298): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaacgccccagacctcctgatctctggtncatccactctgcgaagtggcgtccatcgaggttcagtgcagtggatcgtgggacagtatttcaatctacaccatcaccactctcgctaactgagtattgtgacaatctactactgtacaacagtacgttactacgttcccctcgtcctacgttttcggaccgtacggggacctaagttagaagtaactacaaacgtaacgtagtaggctcgaccacctacttctgttac

SEQ ID NO: 208101 - DNA, 535 bp, Homo sapiens
  misc_feature: GYAE6OF02IAZ22.17.25.C03.1.454.CMB.1.raw
  modified_base (356)..(356): a, c, t, g, unknown or other
  misc_feature (356)..(356): n is a, c, g, or t
  modified_base (384)..(384): a, c, t, g, unknown or other
  misc_feature (384)..(384): n is a, c, g, or t
  modified_base (388)..(388): a, c, t, g, unknown or other
  misc_feature (388)..(388): n is a, c, g, or t
  modified_base (394)..(394): a, c, t, g, unknown or other
  misc_feature (394)..(394): n is a, c, g, or t
  modified_base (403)..(403): a, c, t, g, unknown or other
  misc_feature (403)..(403): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaacctatttaaattggtatcagcagaaacctgaaaacgccccagacctcctgatctctggtgcatccactctgacgaagtggccgtcccatccgaggttcaggtggcaggtggatcgngggacagtatttcaatctcacatcaccnctcngcaacngaggattgngactaatctactactgtacaactagtacgttacacgttcccctcgtaccttacgtttcggaccgtaacgggaacctaaggttcgagtataccgaaaacgtacgtgtaggacctgaccactattcctgttacc

SEQ ID NO: 208102 - DNA, 498 bp, Homo sapiens
  misc_feature: GYAE6OF02IXPG3.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcaagaaacctggaaaagccccagacctcctgatctctggtgcatccactctgcgaagtggcgtcccatcgaggttcagtggcagtggatctgggacagatttcaatctcaccatcaccactctgcaactgagattgtgcaatctactactgtacaacagtagttacacgttcccctcgtctacgtttggccgagggaccaagttgagtatacaaacgaactgtgctcgcaccatctgtc

SEQ ID NO: 208103 - DNA, 563 bp, Homo sapiens
  misc_feature: GYAE6OF02G5O4F.17.25.C03.1.454.CMB.1.raw
  modified_base (281)..(281): a, c, t, g, unknown or other
  misc_feature (281)..(281): n is a, c, g, or t
  modified_base (360)..(360): a, c, t, g, unknown or other
  misc_feature (360)..(360): n is a, c, g, or t
  modified_base (409)..(409): a, c, t, g, unknown or other
  misc_feature (409)..(409): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgttttacctcctatagtatcaactgggtncgccaggccgctggacaacgcctgagtggatggggatggggcgaaccctaacgacgtggtgtcacagtgtcttcacccntcctcgggacagacttaccatcgaccacgaacctcctaccaactaaacncagccctaacatcggagttgaggagcctgacatctgaccgacgaccggccgtactattacctggtacgcgagacgttacccacggtaacgttcccgggagacgcccgttaacgggaccacggccggttcccgttttgaccgtttcgtccggggg

SEQ ID NO: 208104 - DNA, 564 bp, Homo sapiens
  misc_feature: GYAE6OF02JFQ16.17.25.C03.1.454.CMB.1.raw
  modified_base (283)..(283): a, c, t, g, unknown or other
  misc_feature (283)..(283): n is a, c, g, or t
  modified_base (294)..(294): a, c, t, g, unknown or other
  misc_feature (294)..(294): n is a, c, g, or t
  modified_base (458)..(458): a, c, t, g, unknown or other
  misc_feature (458)..(458): n is a, c, g, or t
  modified_base (472)..(472): a, c, t, g, unknown or other
  misc_feature (472)..(472): n is a, c, g, or t
  modified_base (482)..(482): a, c, t, g, unknown or other
  misc_feature (482)..(482): n is a, c, g, or t
  modified_base (510)..(510): a, c, t, g, unknown or other
  misc_feature (510)..(510): n is a, c, g, or t
tcagcgtagactagcacgaccggtgctcgatttagtagtgtagatttgggtttggggtacgtcaacaaccacatctgtcctctagagaaaaccctagtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgntggacaacgacctgagtggatggggatggggcaacccgtaacactgggtgtccacacgttgtcctttcaccccagttccctaccggggacacggaacctttaccatcgaaccacgaacctccctaccaacgtaaaccacacgcctacactggaggttgacggancctgacatctgacncacggccgtntacttactgtcgcgagagtccccacggnttacccggtgaacgcccgtaacggcacggccgtaccctttgacttcggtcgggg

SEQ ID NO: 208105 - DNA, 516 bp, Homo sapiens
  misc_feature: GYAE6OF02HATG3.17.25.C03.1.454.CMB.1.raw
  modified_base (424)..(424): a, c, t, g, unknown or other
  misc_feature (424)..(424): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatggggcgaaccctaacactggtgtcacagtgtcttcacccatcctcgggacagacttacatcgaccacgaactcctacataaacacagcctacatggagttgaggancctgacatctgacgacacggcctctattactgtgcgagacgtcccagctccggtgacgccgtacggcaggccgcctttgaccttcgtcgggg

SEQ ID NO: 208106 - DNA, 566 bp, Homo sapiens
  misc_feature: GYAE6OF02IL150.17.25.C03.1.454.CMB.1.raw
  modified_base (284)..(284): a, c, t, g, unknown or other
  misc_feature (284)..(284): n is a, c, g, or t
  modified_base (415)..(415): a, c, t, g, unknown or other
  misc_feature (415)..(415): n is a, c, g, or t
tcagcgtagactagcacgaccggtgctcgatttagtagtgtagatttgggttttgggggggagtcagtctcagtcagggacacagcatgggacatgagggtccccgcttcacgctcctgggctcctgctactctggctccgagctgccagatgtgacatccagattgacccagtctccagtcctccctgtctgcctctgtgggggtcagagtcaccatcacttgccggacaagtcacggcgttaaaacctatttaaattggtatcagcagaaacctggaaaacnccccagacctctagatctactggtagcatccactctgcgaagtggcgtccatcgagttcagtgcagtggatcgtgggacagtatttcaattctacacatccacactcgtacgacaaccgtgaggtattgtnactaatcctactactgacaacagtagttacgtacgttcccgtcgtaccgttacgttttacggacccgtaaggggtacctaaggtttcgaaggtactaaccgaaaccggtaacgtcgtacggtctacggtaccaccgtattcctacgttccc

SEQ ID NO: 208107 - DNA, 522 bp, Homo sapiens
  misc_feature: GYAE6OF02IK6Y7.17.25.C03.1.454.CMB.1.raw
  modified_base (331)..(331): a, c, t, g, unknown or other
  misc_feature (331)..(331): n is a, c, g, or t
  modified_base (338)..(338): a, c, t, g, unknown or other
  misc_feature (338)..(338): n is a, c, g, or t
  modified_base (346)..(346): a, c, t, g, unknown or other
  misc_feature (346)..(346): n is a, c, g, or t
  modified_base (356)..(356): a, c, t, g, unknown or other
  misc_feature (356)..(356): n is a, c, g, or t
  modified_base (453)..(453): a, c, t, g, unknown or other
  misc_feature (453)..(453): n is a, c, g, or t
tcagcgtagactagcacgaccggtgctcgatttagtagtgtagatttgggtttgggggactcaacaaccacatctgtcctctagagaaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcaacctaanactggtntcacagtntcttcacccntcctcgggacagactacatgaccagactcctaccaataaacacagacctacatggagttgaggagcctgacatctgacgacgacgccgtctattacngtgcgagacgtcccacgagtccggtgacgtccgtacggcaggtccggtcctttggaccttcggtcgggg

SEQ ID NO: 208108 - DNA, 527 bp, Homo sapiens
  misc_feature: GYAE6OF02H5ZZO.17.25.C03.1.454.CMB.1.raw
  modified_base (302)..(302): a, c, t, g, unknown or other
  misc_feature (302)..(302): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctcactgtctgcctctgtgggggtcagagtcaccatcacttgccggacaagtcacggcgttaaaacctatttaaattggtatcagcagaaacctggaaaacgcccccagacctcctgactctctggtncatccactctgcgaagtggctcccatcgaggttcagtggcagtggatcgtgggacagtatttcaatctcaccatcaccactctgacactgaggtattgtgacaatctactactgtacaacagtacgttactacgttcccctcgtcctacgtttcggaccgtacgggacctaaggttacgaagtaactacgaaaccgtacgtaggtcggctcgacacctactctcg

SEQ ID NO: 208109 - DNA, 615 bp, Homo sapiens
  misc_feature: GYAE6OF02G66P0.17.25.C03.1.454.CMB.1.raw
  modified_base (387)..(387): a, c, t, g, unknown or other
  misc_feature (387)..(387): n is a, c, g, or t
  modified_base (466)..(466): a, c, t, g, unknown or other
  misc_feature (466)..(466): n is a, c, g, or t
  modified_base (469)..(469): a, c, t, g, unknown or other
  misc_feature (469)..(469): n is a, c, g, or t
  modified_base (474)..(474): a, c, t, g, unknown or other
  misc_feature (474)..(474): n is a, c, g, or t
tcagcgtagactagcacgaccggtgctcgatttagtagtgtagatttgggtttggggactcaacaaccacatctgtcctctagaacgaaaaccctgtgagcacagctcctccaccatggactggacctggaggactcctctttcgttggtggcagcagctaacaagtcgcccactcccaggtgcagctggtgcagtcgtgggctggaggtgaagagccgtgggcctcgagtaggaaggtcctccgtgacgaaggtcttcgtggtacttccgtaccgttttacctcctaatagttactacgtaacggtgggtcgccgccgacggcccgcgtacggaaccaaccgcctggaggtggagtgggagtcgggaccgaacctaagacgtggtntacacgtagtcgttccttaccaccctacgtcccgtacggacacgtacctacatcgaccacgacctccacaataaaccanacncctangtggtaagttggacgacgcctagacatcgaacgacgacgtaccgcgttactacttcgtgcgacgacggtcctacccgagtccgtccggtagacccgccgtacggcgcgggtccgttcgttagtcccgttcgggtaccgggg

SEQ ID NO: 208110 - DNA, 551 bp, Homo sapiens
  misc_feature: GYAE6OF02H9U5G.17.25.C03.1.454.CMB.1.raw
  modified_base (382)..(382): a, c, t, g, unknown or other
  misc_feature (382)..(382): n is a, c, g, or t
  modified_base (448)..(448): a, c, t, g, unknown or other
  misc_feature (448)..(448): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctggagtggatggggatggggcgaaccctaacacgtggtgtcacagtgtcttcacccatcccgtcgggacagaccttacntacgaccacgaactccctaccaataaaccacacgcctaacagtcggagttgaggagcctgacatcngaccgacacggcctcttacttcgtgtacgcgagtacgtcccaaggctcccggtgaccgccgtacgggcacggtccggttcccttttggaccttcggtacgggg

SEQ ID NO: 208111 - DNA, 525 bp, Homo sapiens
  misc_feature: GYAE6OF02H3C38.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatggggcgaaccctaacacgtggtgtcacagtgtcttcacccatcctccgggacagacttaccatcgaccacgaactcctaccataaacacagcctaacatggattgaggagcctgacatctgacgacacggcctctattactgtgcgagacgtcccacgattcccggtgacgccctagggcaggccggtcctttgacttcgtcggggg

SEQ ID NO: 208112 - DNA, 538 bp, Homo sapiens
  misc_feature: GYAE6OF02GVYY2.17.25.C03.1.454.CMB.1.raw
  modified_base (338)..(338): a, c, t, g, unknown or other
  misc_feature (338)..(338): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtntcacagtgtcttcacccatcctcgggacagacttaccatcgaccacgaactcctacaataaacacacgcctaacatggagttgaggacgccgtgacatctcggacgacgaccggccgtacttattacgtgtagcgagacgtcccacggtactccggtgacgcccgtaggcacgggccgtcctttcgaccttggtccgggg

SEQ ID NO: 208113 - DNA, 658 bp, Homo sapiens
  misc_feature: GYAE6OF02IYAQM.17.25.C03.1.454.CMB.1.raw
  modified_base (283)..(283): a, c, t, g, unknown or other
  misc_feature (283)..(283): n is a, c, g, or t
  modified_base (339)..(339): a, c, t, g, unknown or other
  misc_feature (339)..(339): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaaggtctcctgcaaggcttctggattcacgtttacctcgtatagtatcaactgggtcncgccaggccgctggacaacgacctgagtggatgggagtcggggaccaacccgtaanacgtggtcgtacacgtagtcgtccttccgaaccctacgtcccgtcccgggaacacggtaaccttacccagtcgaacccaacgtaacctccctaccaaataaaccaccacgacctaacagtggaaggttggaaggtacgcccgttagactacgtcgtacggaaccgtaccgaccgggtacccttacgtaagtttacctcggttcgacggtaacgtaccgtacccgaacggtacgttacccgggtagaaccggtcccgttaaccgggccgtacggtcccgggttacccgttttacggtacccgtttcgggtacccgggggg

SEQ ID NO: 208114 - DNA, 553 bp, Homo sapiens
  misc_feature: GYAE6OF02JB1BJ.17.25.C03.1.454.CMB.1.raw
  modified_base (338)..(338): a, c, t, g, unknown or other
  misc_feature (338)..(338): n is a, c, g, or t
  modified_base (381)..(381): a, c, t, g, unknown or other
  misc_feature (381)..(381): n is a, c, g, or t
  modified_base (384)..(384): a, c, t, g, unknown or other
  misc_feature (384)..(384): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaacctatttaaattggtatcagcaagaaacctggaaaagccccagacctctgatctctggtgcatccactctgcgaagtggcgtccatcgaggttcagtgcngtgatctgggacagtattcgaattcctacaccatacacctacnctnactaaccgtgaggtattgtgactaatcttactactgacctaacgagtacgttaccacgttcccctcgtactacgttttcgaccgaacggggtaacctaaggttacgaagtaactaacgtaaacgtaacgtaggtcggtactacgtacctaccgtaacgttctcgttacc

SEQ ID NO: 208115 - DNA, 554 bp, Homo sapiens
  misc_feature: GYAE6OF02G7ZA0.17.25.C03.1.454.CMB.1.raw
  modified_base (329)..(329): a, c, t, g, unknown or other
  misc_feature (329)..(329): n is a, c, g, or t
  modified_base (439)..(439): a, c, t, g, unknown or other
  misc_feature (439)..(439): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgttacctcctatagtatcaactgggtgcgccaggccgctggacaacgacctgagtggatgggatgggcaaccctaanactggtgtcacagtgtcttcacccatccgtccgggacagacctacatgaccacgaacctcctaccaataaacacagcctacataggagttgaggacgctgacctagtccngaccgacgaccggccgtctaattcgtgtcggcgtagacgtcccacggtacgtccggtagacggacctacgggaccacgggcccggtccgtttcgtaccgtttccggtaccggggg

SEQ ID NO: 208116 - DNA, 522 bp, Homo sapiens
  misc_feature: GYAE6OF02G5KMY.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaacctatttaaattggtatcagcagaaacctggaaaagccccagacctcctgatctctggtgcatccactctgcgaagtggcgtcccatcgaggttcagtggcagtgatcgtgggacagtatttcaatctacaccatccaccactctgcaactgaggtatgtgctaatctactactgtacaacagtagttactacgttccctcgtcctacgttttcggaccgtaggggtacctaagttcgaagtataccaaacgtaactgtgcgtacgcaccattcgtgttacc

SEQ ID NO: 208117 - DNA, 513 bp, Homo sapiens
  misc_feature: GYAE6OF02IZ9NX.17.25.C03.1.454.CMB.1.raw
  modified_base (280)..(280): a, c, t, g, unknown or other
  misc_feature (280)..(280): n is a, c, g, or t
  modified_base (331)..(331): a, c, t, g, unknown or other
  misc_feature (331)..(331): n is a, c, g, or t
  modified_base (410)..(410): a, c, t, g, unknown or other
  misc_feature (410)..(410): n is a, c, g, or t
  modified_base (434)..(434): a, c, t, g, unknown or other
  misc_feature (434)..(434): n is a, c, g, or t
  modified_base (448)..(448): a, c, t, g, unknown or other
  misc_feature (448)..(448): n is a, c, g, or t
  modified_base (456)..(456): a, c, t, g, unknown or other
  misc_feature (456)..(456): n is a, c, g, or t
  modified_base (471)..(471): a, c, t, g, unknown or other
  misc_feature (471)..(471): n is a, c, g, or t
  modified_base (478)..(478): a, c, t, g, unknown or other
  misc_feature (478)..(478): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctggagtggatgggatggggcaaccctanactggtgtcacagtgtcttcacccatcctccgggacagacttaccatgaccacgaactcctacataaacacagcctaanatggagttgaggagcctgacatcngacgacacggcctntattctgngcgagcgtcccacgntccgggngacgctacggcacggcggcctttgcttcgtcgggg

SEQ ID NO: 208118 - DNA, 528 bp, Homo sapiens
  misc_feature: GYAE6OF02I51MW.17.25.C03.1.454.CMB.1.raw
  modified_base (456)..(456): a, c, t, g, unknown or other
  misc_feature (456)..(456): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaacctaacactggtgtcacagtgtcttcacccatcctccgggacagacttaccatcgaccacgaactccaccataaacacagcctacatggagttgaggagcctgacatctgacgacacggccgtctattacgngtgcgagacgtcccacgacgtccggtagacgcccgtacggcacggccggtcctttggaccttcggtcggggg

SEQ ID NO: 208119 - DNA, 588 bp, Homo sapiens
  misc_feature: GYAE6OF02H8EFF.17.25.C03.1.454.CMB.1.raw
  modified_base (281)..(281): a, c, t, g, unknown or other
  misc_feature (281)..(281): n is a, c, g, or t
  modified_base (309)..(309): a, c, t, g, unknown or other
  misc_feature (309)..(309): n is a, c, g, or t
  modified_base (538)..(538): a, c, t, g, unknown or other
  misc_feature (538)..(538): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggctcagtgaaggtctcctgcaaggcttcgtggattcacgtttacctcctatagtatcaactggggtncgcaggccgctggacaacgacctggagnggatggggagtcgggcggaaaccctaacgacgtggtgacacgagtcgtcttcaccctacgtccgtaccgggaactacgaacctttacgaatcgacccgaacgaacctcccgtaccaataaaccacacgtaccttaacatggaagttggaaggacgtccctagacagttcgcgaacgaccgcggtccgtcttaattacgtgtcgacagtcgtcccaggtaacttccgggnacggcccgtacggtcacgggtccgtaccggtttcaccgttcggtacgggg

SEQ ID NO: 208120 - DNA, 528 bp, Homo sapiens
  misc_feature: GYAE6OF02F3MQT.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggcccgctggacaacgacctggagtgggatggggatggggcgaaccctaacactggtgtcacagtgtcttcacccatcctccgggacagacttaccatcgaccacgaactcctaccaataaacacagcctacatggattgagagcctgacatctgacgacacgccgtatattactgtcgcgagcgtcccacgtctccggtagacgccgtacggcacggccggtcctttggaccttggtcgggg

SEQ ID NO: 208121 - DNA, 587 bp, Homo sapiens
  misc_feature: GYAE6OF02G8OWL.17.25.C03.1.454.CMB.1.raw
  modified_base (281)..(281): a, c, t, g, unknown or other
  misc_feature (281)..(281): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcacactcccaggtgcagctggtgcagtctggggctgaggtgaagaagcctggggcctcagtgaaggtctcctgcaaggcttctggattcacgtttacctcctatagtatcaacgtgggtncgccaggccgctggacaacgacctgagtggatgggatgggacgaaccctaacgacgtggtgtcacagtgtcttcacccatccgtccggacagtacttaccatcgaccacgtaacctcctaccaataaaccacagtccctaacatgggtaagttggaggacgcctaggaacatccgtagaccgaccgaccgggtcccttacgttaacttaccgtggtcggaccgtaagtaccggtccccgaaggtacgttcccgggtagaccgcccgtaacgggcaacggtccggttccctttaggcccgtttcggg

SEQ ID NO: 208122 - DNA, 533 bp, Homo sapiens
  misc_feature: GYAE6OF02GX0KU.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgagttcagtggcagtggatctgggacagatttcaatctcaccatcaccactctgcaactgagattgtgcaatctactactgtacaacagagttacacgttccctcgtcctacgttttcggaccgtaacggggacctaagttgaacggtaactaaccgtaaaacgtaacgtcggtacggacgtacgaccaacctacttcgttcgttacc

SEQ ID NO: 208123 - DNA, 525 bp, Homo sapiens
  misc_feature: GYAE6OF02G85QA.17.25.C03.1.454.CMB.1.raw
  modified_base (423)..(423): a, c, t, g, unknown or other
  misc_feature (423)..(423): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctacataaacacagcctacatggagttgaggancctgacatctgacgacacggcctcgtacttactgtgcgagacgtcccgagtactcccgggtgacgccctaggctacggccggtcctttggactttcgcgggg

SEQ ID NO: 208124 - DNA, 536 bp, Homo sapiens
  misc_feature: GYAE6OF02GE975.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggacgaaccctaacactggtgtcacagtgtcttcaccccatcccgtccgggacagaccttaccatcgaccacgaacctccctccaataaaccacacgccctaacatggagttgaggagcctgacatctgacacacggcctctacttactgtgcgagacgtccccaggtctccggtgacgtccctaggccaggccggtcctttcgaccttcgtccgggg

SEQ ID NO: 208125 - DNA, 538 bp, Homo sapiens
  misc_feature: GYAE6OF02HBJAR.17.25.C03.1.454.CMB.1.raw
  modified_base (332)..(332): a, c, t, g, unknown or other
  misc_feature (332)..(332): n is a, c, g, or t
  modified_base (394)..(394): a, c, t, g, unknown or other
  misc_feature (394)..(394): n is a, c, g, or t
  modified_base (413)..(413): a, c, t, g, unknown or other
  misc_feature (413)..(413): n is a, c, g, or t
  modified_base (426)..(426): a, c, t, g, unknown or other
  misc_feature (426)..(426): n is a, c, g, or t
  modified_base (437)..(437): a, c, t, g, unknown or other
  misc_feature (437)..(437): n is a, c, g, or t
  modified_base (462)..(462): a, c, t, g, unknown or other
  misc_feature (462)..(462): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatgggcgaaccctaanactggtgtcacagtgtcttcacccatcctccgggacagacttaccatcgaccacgacctccnccaataaacacagcctaanatggattgaggancctagacatcngaccgacgaccggtcctctattacngtgcgagacgtcccacgattccggtagacgccctagggcacggtccggtccttttacggaccgtttcgaccggggg

SEQ ID NO: 208126 - DNA, 517 bp, Homo sapiens
  misc_feature: GYAE6OF02H5M3I.17.25.C03.1.454.CMB.1.raw
  modified_base (421)..(421): a, c, t, g, unknown or other
  misc_feature (421)..(421): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaacgccccagacctcctgatctctggtgcatccactctgcgaagtgcgtcccatcgaggttcagtggcagtgatcgtgggacagtatttcaatctacaccatccaccactctgacaacctgaggattgtgacaatctactactgacaanagtagttacacgttccctcgtactacgtttcggaccgtaggggacctaaggttgagtaactacaaacgtactgtgctcgaccaccatcctagttcc

SEQ ID NO: 208127 - DNA, 520 bp, Homo sapiens
  misc_feature: GYAE6OF02G1VQH.17.25.C03.1.454.CMB.1.raw
  modified_base (428)..(428): a, c, t, g, unknown or other
  misc_feature (428)..(428): n is a, c, g, or t
  modified_base (445)..(445): a, c, t, g, unknown or other
  misc_feature (445)..(445): n is a, c, g, or t
  modified_base (476)..(476): a, c, t, g, unknown or other
  misc_feature (476)..(476): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatggggcgaaccctaacactggtgtcacagtgtcttcacccatcctccgggacagacttaccatgacccacgaactcctaccaataaacacagcctacatggagttgaggancctgacatctgacgacncggcctctattactgtgcgagacgtcccagntccggtgacgcctaggcaggccggtcctttgaccttcgtcgggg

SEQ ID NO: 208128 - DNA, 513 bp, Homo sapiens
  misc_feature: GYAE6OF02FJKN1.17.25.C03.1.454.CMB.1.raw
  modified_base (404)..(404): a, c, t, g, unknown or other
  misc_feature (404)..(404): n is a, c, g, or t
  modified_base (425)..(425): a, c, t, g, unknown or other
  misc_feature (425)..(425): n is a, c, g, or t
  modified_base (435)..(435): a, c, t, g, unknown or other
  misc_feature (435)..(435): n is a, c, g, or t
  modified_base (489)..(489): a, c, t, g, unknown or other
  misc_feature (489)..(489): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggacgaaccctaacactggtgtcacgagtgtcttcacccatcctccgggacagacttaccatcgaccacgaactcctaccataaacncagcctacatggattgaggancctgacatcngacacgacgctctatactgtgcgagcgtcccagctccggtgacgccgtacggcnggtcgtcctttgacttcgtcgggg

SEQ ID NO: 208129 - DNA, 527 bp, Homo sapiens
  misc_feature: GYAE6OF02IOPTH.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaacctaacactggtgtcacagtgtcttcacccatcctccgggacacgtacttaccatcgaccacgaactcctaccaataaacacacgcctacatggagttgaggacgcctgacatctgacgacacggccgtactattactgtgcgagacgtcccgacgcgtccggtgacgccgtacggcacggccggtcctttgaccttgcgggg

SEQ ID NO: 208130 - DNA, 515 bp, Homo sapiens
  misc_feature: GYAE6OF02HENUY.17.25.C03.1.454.CMB.1.raw
  modified_base (280)..(280): a, c, t, g, unknown or other
  misc_feature (280)..(280): n is a, c, g, or t
  modified_base (455)..(455): a, c, t, g, unknown or other
  misc_feature (455)..(455): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtgtcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggcaaccctaacactggtgtcacagtgtcttcacccatcctaccgggacacgacttaccatcgaccacgactcctacataaacacagcctacatggagttgaggagcctagacatctgacgacacggctctattacngtgcgagacgtcccacgactccggtgacgcctaggcaggccgtctttgacttcgtcgggg

SEQ ID NO: 208131 - DNA, 516 bp, Homo sapiens
  misc_feature: GYAE6OF02FG79P.17.25.C03.1.454.CMB.1.raw
  modified_base (361)..(361): a, c, t, g, unknown or other
  misc_feature (361)..(361): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggcgaaccctaacactggtgtcacagtgtcttcacccatccncgggacagacttaccatgaccacgaactcctccaataaacacagcctaacatggagttgaggagcctgacatctgacgacacggcctctattactgtgcgagacgtcccagactccggtgacgcctacggcagccggtcctttgacttcgcgggg

SEQ ID NO: 208132 - DNA, 547 bp, Homo sapiens
  misc_feature: GYAE6OF02G75UZ.17.25.C03.1.454.CMB.1.raw
  modified_base (434)..(434): a, c, t, g, unknown or other
  misc_feature (434)..(434): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacacgacctgagtggatgggatgggcgaaccctacacgtggtgtcacagtgtcttcacccatccgtcgggacacgtacttaccatcgaccacgaactccctaccaataaaccacacgcctaacagtggagttgagggacncctagaccatctgaccgacgaccggcctacttattacgtgtcgcgagtacgtcccacggtctcccggtgacgcccgtacggcacggccggtcctttcggaccttcggtcgggg

SEQ ID NO: 208133 - DNA, 599 bp, Homo sapiens
  misc_feature: GYAE6OF02JI8NV.17.25.C03.1.454.CMB.1.raw
  modified_base (280)..(280): a, c, t, g, unknown or other
  misc_feature (280)..(280): n is a, c, g, or t
  modified_base (413)..(413): a, c, t, g, unknown or other
  misc_feature (413)..(413): n is a, c, g, or t
  modified_base (421)..(421): a, c, t, g, unknown or other
  misc_feature (421)..(421): n is a, c, g, or t
  modified_base (437)..(437): a, c, t, g, unknown or other
  misc_feature (437)..(437): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggacgaaccctaacactggtgtcacgagtgtcttacaccctatcccgtccgggacagtaccttaccatcgaccaacgaacctcctacaataaacncagcctanactggagttgacgganccgttgactatcgtaggaccgacgaccggtcccgttactacgtttaaccgtggtcgaccggaacgtacgttccccgaacggtacggttcccggttaggaaccgtttccgaacgggtccacgggtccggttacccttttcggacccgtttcgggtaccggggg

SEQ ID NO: 208134 - DNA, 551 bp, Homo sapiens
  misc_feature: GYAE6OF02G3B9W.17.25.C03.1.454.CMB.1.raw
  modified_base (280)..(280): a, c, t, g, unknown or other
  misc_feature (280)..(280): n is a, c, g, or t
  modified_base (416)..(416): a, c, t, g, unknown or other
  misc_feature (416)..(416): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatggggcgaaccctaacactggtgtcacgagtgtcttcacccatccgtaccgggacagacttaccatcgaccacgaactcctaccaataaacacagcctanagtggagttggaggacgcctagacatctagacgacacggtccgtacttattacgtgtacgcgagacgtcccgaaggtcgtcccgggtagacgtcccgtacgggcacggtccgtcctttggaccgttcggtcgggg

SEQ ID NO: 208135 - DNA, 550 bp, Homo sapiens
  misc_feature: GYAE6OF02FRNND.17.25.C03.1.454.CMB.1.raw
  modified_base (507)..(507): a, c, t, g, unknown or other
  misc_feature (507)..(507): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgcctgagtggatgggatgggcgaaccctacactggtgtcacgagtgtcttcaccctatccctccgggacagacttaccatcgaccacgaactcctaccaataaaccacacgccctacagtggagttgaggacgcctagactagtctagaaccgacgaccggtccgtacttacttacgtgtcgacgtagacgtcccacggtctccggtnacgccgtacggcgtacggccggtcctttgaccgttcgtcgggg

SEQ ID NO: 208136 - DNA, 602 bp, Homo sapiens
  misc_feature: GYAE6OF02IDVXI.17.25.C03.1.454.CMB.1.raw
  modified_base (320)..(320): a, c, t, g, unknown or other
  misc_feature (320)..(320): n is a, c, g, or t
  modified_base (382)..(382): a, c, t, g, unknown or other
  misc_feature (382)..(382): n is a, c, g, or t
tcagcgtagactagcacgaccggtgctcgatttagtagtgtagatttgggtttgggggaggtcagtctcagtcaggacacagcatggacatgagggtccccgctcagctcctggggctcctgctactctggctccgagctgccagatgtgtacatccagatgacccagtctccatcctcctgtctgcctctggtgggggtcaggacgtcaccagtccacttgccggacaagtcacggacgttaaaacctatttaaattggtaactcagtacaacgaaacctaggaaaacgccccaagaccctcctagatcctcgtgggtncatccgactctgacgtaagtcggacgtacccagtcgaggttacaggtggacaggtgattcgngggactagatttcaactctacaaccatccaaccactctacactaacctgaacgtattagagtacaatctaactagtgacaacagtacgtacacgttccctcgtacttacgtttcggaccgtaaggggtaaccctaaggttcgtaaacgtaacgtaaccgtaaaacgtaccgttaggtaggtaccgtacggacccgtaacccgtacttccgtagttacccg

SEQ ID NO: 208137 - DNA, 531 bp, Homo sapiens
  misc_feature: GYAE6OF02HOQ2W.17.25.C03.1.454.CMB.1.raw
  modified_base (279)..(279): a, c, t, g, unknown or other
  misc_feature (279)..(279): n is a, c, g, or t
  modified_base (288)..(288): a, c, t, g, unknown or other
  misc_feature (288)..(288): n is a, c, g, or t
  modified_base (327)..(327): a, c, t, g, unknown or other
  misc_feature (327)..(327): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttactcctatagtatcaactgggtncgcaggccnctggacaacgcctgagtggatgggatgggcaaccctaanactggtgtcacgagtgtcttcatccatcctcgggacagacttaccatcgaccacgaactcctcaataaacacacgcctaacatggagttgagagcctgacatctgacgacgacggccgttatacgttactgtcgacgtagacggtaccccaggtacttccgggtagacgccttacggcacggccggtcctttaggaccttcggg

SEQ ID NO: 208138 - DNA, 518 bp, Homo sapiens
  misc_feature: GYAE6OF02GSGKB.17.25.C03.1.454.CMB.1.raw
  modified_base (331)..(331): a, c, t, g, unknown or other
  misc_feature (331)..(331): n is a, c, g, or t
  modified_base (399)..(399): a, c, t, g, unknown or other
  misc_feature (399)..(399): n is a, c, g, or t
  modified_base (407)..(407): a, c, t, g, unknown or other
  misc_feature (407)..(407): n is a, c, g, or t
  modified_base (420)..(420): a, c, t, g, unknown or other
  misc_feature (420)..(420): n is a, c, g, or t
  modified_base (471)..(471): a, c, t, g, unknown or other
  misc_feature (471)..(471): n is a, c, g, or t
  modified_base (479)..(479): a, c, t, g, unknown or other
  misc_feature (479)..(479): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaanactggtgtcacagtgtcttcacccatcctcgggacagacttaccatgaccacgaactcctcataaacncagcctanatggattgaggancctgacatctagacgacacggccgtctattactgtgcgagacgtcccacgntcccggtnacgccctaggcaggccggtcctttggaccttcgtcgggg

SEQ ID NO: 208139 - DNA, 524 bp, Homo sapiens
  misc_feature: GYAE6OF02FI5GK.17.25.C03.1.454.CMB.1.raw
  modified_base (457)..(457): a, c, t, g, unknown or other
  misc_feature (457)..(457): n is a, c, g, or t
tcagcgtagactagcacgaccggtgctcgatttagtagtgtagatttgggtttggggactcaacaaccacatctgtcctctagagaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtgcgccaggccgctggacaacgacctgagtggatggggatggggcgaaccctaacactggtgtcacagtgtcttcacccatcctcgggacagacttaccatcgaccacgaactcctaccaataaaccacacgcctaacatggattgaggagcctgacatcagacacacggcgtctattacngtgcgacgacgtcccagactcccggtgacgtccgtacggcaggccggccttttgaccttcgtcgggg

SEQ ID NO: 208140 - DNA, 779 bp, Homo sapiens
  misc_feature: GYAE6OF02INQGM.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaaggtctcctgcaaggcttctggattcacgtttacctcctatagtatcaacgtgggtgcgccaggccgctggacaacgacctggagtggatgggatcggggaccaaacccgtaacgacgttggtcgtcacgaggttcgtaccttaccaacccctagttcccgtacccggggaactaacggtaacctttaacccgaagttaccgaaccctaaccggtaaaccccttaccccgtaaacccaaacttaaaaacccaaccgtaaaccggtaccccttaaaccgaaacggttacggggtaacggttttacgggaaacggggtaccggtaaccccgttaggaaacccgtaacgttacccgttacggaaacccggtaacccgtaacccggggtaccccgtttaacgttaaacgttttaacccgtggttaaccggaccggtaaacggtaccggttacccccgaacggtacggttaccccggggtaggaaccggtccccgttaacgggccgaacggtcccgggttacccgttttacggtacccggtttccggtacccgggggg

SEQ ID NO: 208141 - DNA, 512 bp, Homo sapiens
  misc_feature: GYAE6OF02G00NY.17.25.C03.1.454.CMB.1.raw
  modified_base (510)..(510): a, c, t, g, unknown or other
  misc_feature (510)..(510): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacttaaaacctatttaaattggtatcagcagaaacctggaaaagccccagacctcctgatctctggtgcatccactctgcgaagtggccgtcccatcgaggttcaggtggcagtggatcgtgggacagtatttcaatcctacaccataccaccactctcgccaacctgagtattgtgacaatctactactgtacaacagtacgttactacgttcccctcgtctacgtttcggccgagggtacctaagttgagtatacaaacgtactgtgctcgcacatctntc

SEQ ID NO: 208142 - DNA, 568 bp, Homo sapiens
  misc_feature: GYAE6OF02GCHD3.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgcgtggacaacgacctgagtggatgggatgggaccgaaccctaacacgtggtcgtcacagtgtcttcacccagtcccgtaccgggacacgacttaccatcgacccacgaacctcctaccaataaaccacacgaccctacagtggagttgaggacgcctgacctatcgtagaccgacgaccgggccgttcttaattacgtgtcgacgtagacgtcccgacggtaacgtccggtagacgacccgtacggcacggccggtcctttcggaccttcggtcgggg

SEQ ID NO: 208143 - DNA, 547 bp, Homo sapiens
  misc_feature: GYAE6OF02FH036.17.25.C03.1.454.CMB.1.raw
  modified_base (339)..(339): a, c, t, g, unknown or other
  misc_feature (339)..(339): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgtcaggccgctggacaacgacctgagtggatgggatgggacgaaccctaacactggtntcacagtgtcttcacccatccgtcgggacagacttaccatcgaccacgaactccctaccaataaacacacgaccctacatggagttgaggagcctgacatctgacgacacggcctacttattacctgtcgcgtagacgtcccacggtactccggtagacgtcccgtacgggccagggccggtcccgtttgaccgtttcgtaccggggg

SEQ ID NO: 208144 - DNA, 537 bp, Homo sapiens
  misc_feature: GYAE6OF02GMVS5.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttgatggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatccgtccgggacagacttaccatcgaccacgaactcctccaataaacacacgcctacatggagttgaggcgctgacatctaggaccgacgaccggccgttctattacgtgtcgcgagacgtcccgaacggacttccgggtgacggccgtacggccacggccggtccgtttgacctttcggg

SEQ ID NO: 208145 - DNA, 518 bp, Homo sapiens
  misc_feature: GYAE6OF02GFMEP.17.25.C03.1.454.CMB.1.raw
  modified_base (244)..(244): a, c, t, g, unknown or other
  misc_feature (244)..(244): n is a, c, g, or t
  modified_base (280)..(280): a, c, t, g, unknown or other
  misc_feature (280)..(280): n is a, c, g, or t
  modified_base (291)..(291): a, c, t, g, unknown or other
  misc_feature (291)..(291): n is a, c, g, or t
  modified_base (329)..(329): a, c, t, g, unknown or other
  misc_feature (329)..(329): n is a, c, g, or t
  modified_base (428)..(428): a, c, t, g, unknown or other
  misc_feature (428)..(428): n is a, c, g, or t
  modified_base (432)..(432): a, c, t, g, unknown or other
  misc_feature (432)..(432): n is a, c, g, or t
  modified_base (435)..(435): a, c, t, g, unknown or other
  misc_feature (435)..(435): n is a, c, g, or t
  modified_base (455)..(455): a, c, t, g, unknown or other
  misc_feature (455)..(455): n is a, c, g, or t
  modified_base (479)..(479): a, c, t, g, unknown or other
  misc_feature (479)..(479): n is a, c, g, or t
  modified_base (493)..(493): a, c, t, g, unknown or other
  misc_feature (493)..(493): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcnggattcacgtttacctcctatagtatcaactgggtncgccaggccgntggacaacgacctgagtggatgggatgggcaaccctanactggtgtcacgagtgtcttcacccatccgtccgggacagaccttaccatcgaccacgaactcctcaataaacacacgacctacatgggattgagagcngacntcngacacgacgcgtctattcgngtgcgagcgtcccagtcgtccggngaccgcctacggcncggccgtctttgacttcggtacggg

SEQ ID NO: 208146 - DNA, 546 bp, Homo sapiens
  misc_feature: GYAE6OF02H0B3X.17.25.C03.1.454.CMB.1.raw
  modified_base (330)..(330): a, c, t, g, unknown or other
  misc_feature (330)..(330): n is a, c, g, or t
  modified_base (429)..(429): a, c, t, g, unknown or other
  misc_feature (429)..(429): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttactcctatagtatcaactgggtgcgccaggccgctggacaacgactgagtggatgggatgggacgaaccctaanacgtggtgtcactagtgtcttcaccctatcctccgggacagacttacatcgaccagacctcctccaataaaccacagacctacatggagttcgaaggancctagacaacgttctagacgaacaccgggccttacttaattaccgtgtacgcgagacgtccccaggactccggtgacgtccgtacggcacggcggtcctttgaccttcgtacggggg

SEQ ID NO: 208147 - DNA, 537 bp, Homo sapiens
  misc_feature: GYAE6OF02IO06A.17.25.C03.1.454.CMB.1.raw
  modified_base (279)..(279): a, c, t, g, unknown or other
  misc_feature (279)..(279): n is a, c, g, or t
  modified_base (504)..(504): a, c, t, g, unknown or other
  misc_feature (504)..(504): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtncgccaggccgctggacaacgacctgagtggatggggatggggcgaaaccctaacacgtggtgtcacagtgtccttcaccctatcccgtccggggacagtacttacccatcgaacccacgaaactccctccaataaacacacgacctaacatggagttgaggacgcctgacatctagacgaccacggccgtctattacgtgtacgcgagacgtcccaggctccggngacgccgtaggcaggcgcctttgacttgtcggg

SEQ ID NO: 208148 - DNA, 570 bp, Homo sapiens
  misc_feature: GYAE6OF02IYYYB.17.25.C03.1.454.CMB.1.raw
  modified_base (279)..(279): a, c, t, g, unknown or other
  misc_feature (279)..(279): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtncgccaggccgctggacaacggacctggagtggatggggatggggcgaaccctaacactggtgtcacagtcgtcttcacccatcctccgggacagaccttacactgaccacgaactccaccaataaaccacacgcctacactggaacgttgacggagcctgacatctaggacgaccacgggtcctctaagttactggtgaccgagacgtcccgacggtactcccgggtagacggtcccgttaagggcccgtagggtcccggttccgtttacggaccgtttccggtacggggg

SEQ ID NO: 208149 - DNA, 512 bp, Homo sapiens
  misc_feature: GYAE6OF02F52P8.17.25.C03.1.454.CMB.1.raw
  modified_base (330)..(330): a, c, t, g, unknown or other
  misc_feature (330)..(330): n is a, c, g, or t
  modified_base (420)..(420): a, c, t, g, unknown or other
  misc_feature (420)..(420): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctanactggtgtcacagtgtcttcacccatcctcgggacagacttacatcgaccacgactccaccataaacacagcctacatggagttgaggancctgacatctgacgacacggccgtctattactgtgcgagcgtcccagtctccggtgacgcccgtaggcacggcggtcctttgacttgtcggg

SEQ ID NO: 208150 - DNA, 542 bp, Homo sapiens
  misc_feature: GYAE6OF02HSFZO.17.25.C03.1.454.CMB.1.raw
  modified_base (472)..(472): a, c, t, g, unknown or other
  misc_feature (472)..(472): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatcgacccaacgaacctccctaccaataaaaccacaacgaccctacatggagttggaggagcctagacatctagacgacacggccttactattacngtcgcgagacgtcccacgagtcccggtagacgtccgtacggcaggtccggtcctttgaccttcgtcgggg

SEQ ID NO: 208151 - DNA, 535 bp, Homo sapiens
  misc_feature: GYAE6OF02HO7E7.17.25.C03.1.454.CMB.1.raw
  modified_base (279)..(279): a, c, t, g, unknown or other
  misc_feature (279)..(279): n is a, c, g, or t
  modified_base (333)..(333): a, c, t, g, unknown or other
  misc_feature (333)..(333): n is a, c, g, or t
  modified_base (416)..(416): a, c, t, g, unknown or other
  misc_feature (416)..(416): n is a, c, g, or t
  modified_base (430)..(430): a, c, t, g, unknown or other
  misc_feature (430)..(430): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtncgccaggcccgctggacaacgacctgagtggatggggatggggacaaccctaanactggtgtcacagtgtcttcacccatcccgtcgggacagacttaccatcgaccacgaacctcctccaataaaccacagcctanatgggattgaggancctgacatctgaccacacggcctctattactgtgcgagacgtcccaacggtctccgggtgacgcccgtacggcgacggccggtcctttaggaccttcgtcggggg

SEQ ID NO: 208152 - DNA, 503 bp, Homo sapiens
  misc_feature: GYAE6OF02FZ88N.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggctcccatcgagttcagtggcagtggatcgtgggacagatttcaatctcaccatcaccactctgcaacctgaggtattgtgcaatctactactcgtacaacagacgttacacgttccctcgctactttcggaccgtacgggacctaagttgagtatacaaacgaactgtagctcgcaccatctgtc

SEQ ID NO: 208153 - DNA, 634 bp, Homo sapiens
  misc_feature: GYAE6OF02IXZDQ.17.25.C03.1.454.CMB.1.raw
  modified_base (285)..(285): a, c, t, g, unknown or other
  misc_feature (285)..(285): n is a, c, g, or t
tcagcgtagactagcacgaccggtgctcgatttagtagtgtagatttgggtttgggggtacgtcaacaaccacatctcgtcctctagagaaaaccctgtgagcacagctcctcaccatggactggacctggacggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggagtgggacgaaccctaacatggtgtcacagtcgtcttcaccctatccgtccgggacacgacttaccatcgaccacgaactccctaccaataaacactagacctaacataggagttggaaggacgtaccttaggactacgtctcggaaccgtaaccgaacgggcccgttactttaactttaccgttagttcgggacgtaaggtacccgttacccgtaacggaccgttcccgggtacgtaacgggtcccgttaaccggggccaacggggtccccgggttacctttttacgggtaccctttccgggtacccgggggg

SEQ ID NO: 208154 - DNA, 533 bp, Homo sapiens
  misc_feature: GYAE6OF02IAZ9J.17.25.C03.1.454.CMB.1.raw
  modified_base (418)..(418): a, c, t, g, unknown or other
  misc_feature (418)..(418): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggacgaaccctaacactggtgtcacgagtgtccttcaccctatccgtccgggacagaccttaccatcgaccacgactcctaccaataaacacacgcctanatggagttgaggagcctgacatcagacgacacggcctctacttactgtcgcgagacgtcccagtctccggtgacgtcccgtaggcaggccggtcctttcggaccttcggtcgggg

SEQ ID NO: 208155 - DNA, 567 bp, Homo sapiens
  misc_feature: GYAE6OF02IKI39.17.25.C03.1.454.CMB.1.raw
  modified_base (451)..(451): a, c, t, g, unknown or other
  misc_feature (451)..(451): n is a, c, g, or t
  modified_base (524)..(524): a, c, t, g, unknown or other
  misc_feature (524)..(524): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggcctcagtgaaggtctcctgcaaggcttctggattcacgtttacctcctatagtatcaactgggtgcgccaggccgctggacaacgacctgagtggagtgggagtgggccgaaaccctaacgacgtggtgtccacgagtcgtcttccacccacgtccgtccgggaacacgtaccttaccactacgaccaacgtaacctccctaccaataaaccacagaccttacatggagttgaggcncctgacatcgagaccacgaccggccttactacgttactggtcgacgagacgtaccccaggtaccgtccgggtnacgcccgtacggcacggccgttacctttgacctttcggcgggg

SEQ ID NO: 208156 - DNA, 551 bp, Homo sapiens
  misc_feature: GYAE6OF02HDC6C.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaggcttctggattcacgtttacctctatagtatcaactggtgcgccaggccgctggacaacgacctgagtggatgggatgggaccgaaccctaacacgtggtcgtcacgagtcgtcttcaccctatcccgtcgggacagacttaccatcgaccacgacctcctacaataaaccacagtacctacgagtagggattggagtacgccttagactatcagaccgacgacggtcctacttacttacgtgtacgcgagaccgcccaggcgttcccggagacgccgtacggcgacggccgtcctttcggacgttgtccgggg

SEQ ID NO: 208157 - DNA, 723 bp, Homo sapiens
  misc_feature: GYAE6OF02IHY1H.17.25.C03.1.454.CMB.1.raw
  modified_base (248)..(248): a, c, t, g, unknown or other
  misc_feature (248)..(248): n is a, c, g, or t
  modified_base (649)..(649): a, c, t, g, unknown or other
  misc_feature (649)..(649): n is a, c, g, or t
tcagcgtagactagcacgaccggtgctcgatttagtagtgtagatttgggtttggggactcaacaaccacatctgtcctctagagaaaaccctgtgagcacagctcctcaccattggactggacctggaggatcctcttcttggtggcagcagctacaagtgcccactcccaggtgcagctggtgcagtcgtggggctgaggtgaagagccgtgggcctcagtgaaggtctccgtgcaaggtcttcgnggtattcacgtttacctcctatagtatcaacgtgggtgccgcgacggccgctaggaccaacgtacctgagtggacgtgggatggggaccgtaaaccctaagcgttggtacgtacacgtaggttcgtacttacccgaacccgtactcccgtaacggggactacgtaaccttaccgatccgaacctaacgaaccttccctacgaaactaaaccgacgtacacccttaagacgttagggtaagttacgggaaacgggtaccgtacccttagggaacctaacggttaccgtaccgggaaaacccggtacccgtaaaccgggttcccgtttaacgttaacgtttaaccgtcgggttaccgacggtaacggtacccgtaccccgtaacggtccgttacccggggtanaacccgggttccccgtaagggtccctaagggtcccgggttacccttttacggacccgtttcgggtacccggggg

SEQ ID NO: 208158 - DNA, 528 bp, Homo sapiens
  misc_feature: GYAE6OF02F0YY9.17.25.C03.1.454.CMB.1.raw
  modified_base (280)..(280): a, c, t, g, unknown or other
  misc_feature (280)..(280): n is a, c, g, or t
  modified_base (412)..(412): a, c, t, g, unknown or other
  misc_feature (412)..(412): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggcgaaccctaacactggtgtcacagtgtcttcaccccatcctccgggacagaccttaccatgaccacgaactcctccataaacacagccctanatggattgagagcctgacatctgacgacacggcctatatactgtgcgagacgtcccaggactccgggtagacgcccgttacggcacggccggtccttttggaccttcgtccggggg

SEQ ID NO: 208159 - DNA, 523 bp, Homo sapiens
  misc_feature: GYAE6OF02GXWNZ.17.25.C03.1.454.CMB.1.raw
  modified_base (334)..(334): a, c, t, g, unknown or other
  misc_feature (334)..(334): n is a, c, g, or t
  modified_base (430)..(430): a, c, t, g, unknown or other
  misc_feature (430)..(430): n is a, c, g, or t
  modified_base (486)..(486): a, c, t, g, unknown or other
  misc_feature (486)..(486): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatggggacgaaccctaanactggtgtcacagtgtcttcacccatcctcgggacagacttaccatcgaccacgaactcctaccaataaaccacagcctacatggagttgaggacncctgacatctagacgacaccggcctcttattactgtgcgagcgtcccagctccggngacgccgtaggcaggccgtacctttgaccttgcgggg

SEQ ID NO: 208160 - DNA, 535 bp, Homo sapiens
  misc_feature: GYAE6OF02ID1YX.17.25.C03.1.454.CMB.1.raw
  modified_base (423)..(423): a, c, t, g, unknown or other
  misc_feature (423)..(423): n is a, c, g, or t
  modified_base (428)..(428): a, c, t, g, unknown or other
  misc_feature (428)..(428): n is a, c, g, or t
  modified_base (442)..(442): a, c, t, g, unknown or other
  misc_feature (442)..(442): n is a, c, g, or t
  modified_base (467)..(467): a, c, t, g, unknown or other
  misc_feature (467)..(467): n is a, c, g, or t
  modified_base (473)..(473): a, c, t, g, unknown or other
  misc_feature (473)..(473): n is a, c, g, or t
  modified_base (476)..(476): a, c, t, g, unknown or other
  misc_feature (476)..(476): n is a, c, g, or t
  modified_base (480)..(480): a, c, t, g, unknown or other
  misc_feature (480)..(480): n is a, c, g, or t
  modified_base (489)..(489): a, c, t, g, unknown or other
  misc_feature (489)..(489): n is a, c, g, or t
  modified_base (495)..(495): a, c, t, g, unknown or other
  misc_feature (495)..(495): n is a, c, g, or t
  modified_base (509)..(509): a, c, t, g, unknown or other
  misc_feature (509)..(509): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattctaccgttttacctcctatagtatcaactgggtgcgccaggccgctggacaacgacctgagtggagtgggagtgggaccgaaaccctaacacgtggtgtcacagtcgtcttccaccctatcccgtccgggacagaccttaccatcgaccacgaactcctacaataaacacancctanatggagttgaggancctgacatctagacgacacggcctntattcngtncgancgtcccagntccggngaccgccgtaggcnggccggtcctttgaccttcggcgggg

SEQ ID NO: 208161 - DNA, 528 bp, Homo sapiens
  misc_feature: GYAE6OF02FYTES.17.25.C03.1.454.CMB.1.raw
  modified_base (280)..(280): a, c, t, g, unknown or other
  misc_feature (280)..(280): n is a, c, g, or t
  modified_base (331)..(331): a, c, t, g, unknown or other
  misc_feature (331)..(331): n is a, c, g, or t
  modified_base (423)..(423): a, c, t, g, unknown or other
  misc_feature (423)..(423): n is a, c, g, or t
  modified_base (434)..(434): a, c, t, g, unknown or other
  misc_feature (434)..(434): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggcgaaccctaanactggtgtcacagtgtcttcacccatcctccgggacagacttaccatcgaccacgaactcctcaataacacagcctacatggagttgaggancctagacatcngacgacacggctactattactgtgcgagacgtcccacggactccggtgacgtccgtacggcacggtccggtacctttggaccttcggtcggggg

SEQ ID NO: 208162 - DNA, 568 bp, Homo sapiens
  misc_feature: GYAE6OF02IKJNS.17.25.C03.1.454.CMB.1.raw
  modified_base (279)..(279): a, c, t, g, unknown or other
  misc_feature (279)..(279): n is a, c, g, or t
  modified_base (452)..(452): a, c, t, g, unknown or other
  misc_feature (452)..(452): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggcctcagtgaaggtctcctgcaaggcttctggattcacgtttacctcctatagtatcaactgggtncgccaggccgctggacaacgacctgagtggatggggatggggcgaaaccctaacacgttcggtgtccacgtagttcgtcctttcacccctatcccgtccgggaactagtaccttaccattcgaacctaacgaactccctaccaataaaccacacgcctacatggattgaggancctgacatctagacgacacgccgttactactttactggtgaccgagacgtcccacgagttccggagacgtcccgtacggcgtacggccggtcctttacggaccgtttgtaccgggg

SEQ ID NO: 208163 - DNA, 525 bp, Homo sapiens
  misc_feature: GYAE6OF02F8NTP.17.25.C03.1.454.CMB.1.raw
  modified_base (483)..(483): a, c, t, g, unknown or other
  misc_feature (483)..(483): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggcaaccctaacacgtggtgtcacagtgtcttcacccatcctcgggacagacttacatcgaccacgaactcctaccaataaacacacgcctaacatggagttgaggagcctagacatctgacgacacggcctctattacgtgtgcgagcgtcccagctccggtnacgccgtacggcacggtccggtcctttggaccttcgtcgggg

SEQ ID NO: 208164 - DNA, 575 bp, Homo sapiens
  misc_feature: GYAE6OF02IHRPX.17.25.C03.1.454.CMB.1.raw
  modified_base (338)..(338): a, c, t, g, unknown or other
  misc_feature (338)..(338): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacacgtggngtcacagtgtcttcacccatccgtccgggacagacttaccatcgaccaacgaacctccctaccaataaaccacacgacctaacagtggagttcgaggacgtcctagacatctgaacgacacggtccgtattacgttactggtacgcgagaccgtacccgaacgtacgtaccggtacgacggtccgtaccgggccgaacggtcccggttaccgtttcggtaccgtttcggtacggggg

SEQ ID NO: 208165 - DNA, 546 bp, Homo sapiens
  misc_feature: GYAE6OF02IXZ5B.17.25.C03.1.454.CMB.1.raw
  modified_base (280)..(280): a, c, t, g, unknown or other
  misc_feature (280)..(280): n is a, c, g, or t
  modified_base (427)..(427): a, c, t, g, unknown or other
  misc_feature (427)..(427): n is a, c, g, or t
  modified_base (482)..(482): a, c, t, g, unknown or other
  misc_feature (482)..(482): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgcctggagtggatgggatggggacgaaccctaacgactgggtgtccacgagtgtccttcacccatcccgtccgggacacgaccttaccatcgaccacgaactcctaccaataaaccacacgccctaanacgtgggagttggaaggacgcctgaccatcgtgacgacacgggccttctattacngtgcgagtacgtcccagcgtccggagacgtcccgtaggcaggtccgtcctttgaccttgcgggg

SEQ ID NO: 208166 - DNA, 535 bp, Homo sapiens
  misc_feature: GYAE6OF02FXH71.17.25.C03.1.454.CMB.1.raw
  modified_base (280)..(280): a, c, t, g, unknown or other
  misc_feature (280)..(280): n is a, c, g, or t
  modified_base (477)..(477): a, c, t, g, unknown or other
  misc_feature (477)..(477): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggcgaaccctaacactggtgtcacagtgtcttcacccatcctccgggacagacttaccatcgaccacgaactcctccataaacacagccctacatggagttgaggacgcctgacatctgacgacacggccgtctattactgtgcgagcgtcccacggtntccgggtagacggtccctacggcgaggccggtccctttggaccgtttcgtaccggggg

SEQ ID NO: 208167 - DNA, 527 bp, Homo sapiens
  misc_feature: GYAE6OF02GR8P5.17.25.C03.1.454.CMB.1.raw
  modified_base (280)..(280): a, c, t, g, unknown or other
  misc_feature (280)..(280): n is a, c, g, or t
  modified_base (428)..(428): a, c, t, g, unknown or other
  misc_feature (428)..(428): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatggggatggggcgaaccctaacactggtgtcacagtgtcttcacccatccgtccgggacagacttaccatcgaccacgaactcctaccataaacacagcctacatggagttgaggancctgacatctgacgacacggcctctattactgtgcgagacgtcccacgactccggtgacgccgtacggctacggccgtcctttggacctttcggcgggg

SEQ ID NO: 208168 - DNA, 533 bp, Homo sapiens
  misc_feature: GYAE6OF02JCKK0.17.25.C03.1.454.CMB.1.raw
  modified_base (435)..(435): a, c, t, g, unknown or other
  misc_feature (435)..(435): n is a, c, g, or t
  modified_base (446)..(446): a, c, t, g, unknown or other
  misc_feature (446)..(446): n is a, c, g, or t
  modified_base (470)..(470): a, c, t, g, unknown or other
  misc_feature (470)..(470): n is a, c, g, or t
  modified_base (495)..(495): a, c, t, g, unknown or other
  misc_feature (495)..(495): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctggagtggagtgggatggggccgaaccctaacacgtggtcgtcacgagtgtcttccacccatccctcgggacagaccttacatcgaccacgaacctcctaccaataaacacagcctacagtggagttgaggngcctgacatcngacacgacggccttatacttacgngtgcgagactcccgacgtgtccggnacgcctacggcaggccggtctttcgacgttcgacgggg

SEQ ID NO: 208169 - DNA, 567 bp, Homo sapiens
  misc_feature: GYAE6OF02HPB8U.17.25.C03.1.454.CMB.1.raw
  modified_base (414)..(414): a, c, t, g, unknown or other
  misc_feature (414)..(414): n is a, c, g, or t
  modified_base (422)..(422): a, c, t, g, unknown or other
  misc_feature (422)..(422): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggctcctggattcacgtttacctcctatagtatcaactgggtgcgccaggccgctggacaacgacctgagtggatggggatggggacaaccctaacacgtggtgtcacagtcgtcttcacccatcccgtccgggacacgtacttaccatcgaccacgaacctcctaccaataaaccncagcctanatggattgagacgcctagaccattctacgacgaccgaccgggccttactactttacgtgtcgacgaaggtacgtccccaaggacttcccgggtagaccgtcccgtacggcacggccggttccgtttcgaccgttcggtacggggg

SEQ ID NO: 208170 - DNA, 555 bp, Homo sapiens
  misc_feature: GYAE6OF02HNEAI.17.25.C03.1.454.CMB.1.raw
  modified_base (379)..(379): a, c, t, g, unknown or other
  misc_feature (379)..(379): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctcgtgtgggggtcagagtcaccatcacttgccggacaagtcacggcgttaaaacctatttaaattggtatcagcagaaacctggaaaagccccagacctcctgatctctggtgcatccactctgcgaagtgcgtcccatcgagttcagtgcagtggatcgtgggacagtattcaatctcaccatacaccactcngacaactgagattgtgctaatctaactactgtacaacagtagttacacgttccctcgtacctacgttttcggaccgtaacgggggtaacctaaggttacgaaggtaacgtaccgtaaaaccggtaacgttaggtacgggtccgtacggacccaaccgtacttccgttcgtttaccc

SEQ ID NO: 208171 - DNA, 537 bp, Homo sapiens
  misc_feature: GYAE6OF02IU3AF.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggcccgctggacaacgacctgagtggatggggatggggacaaccctaacacgtggtgtcaactagtgtccttcacccatcctccgggacacgtacttaccatcgaccacgaactcctccataaacacagcctacatggagttggaggacgcctgacactcgtgaccgacgacggccgtacttattactgtgcgagcgtccacgtcgtccggtgacgccgtacggcacggcgtcctttaggtactcgtcgggg

SEQ ID NO: 208172 - DNA, 562 bp, Homo sapiens
  misc_feature: GYAE6OF02IS7NG.17.25.C03.1.454.CMB.1.raw
  modified_base (282)..(282): a, c, t, g, unknown or other
  misc_feature (282)..(282): n is a, c, g, or t
  modified_base (429)..(429): a, c, t, g, unknown or other
  misc_feature (429)..(429): n is a, c, g, or t
  modified_base (468)..(468): a, c, t, g, unknown or other
  misc_feature (468)..(468): n is a, c, g, or t
  modified_base (518)..(518): a, c, t, g, unknown or other
  misc_feature (518)..(518): n is a, c, g, or t
tcagcgtagactagcacgaccggtgctcgatttagtagtgtagatttgggtttggggtacgtcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggccgaacctaacgacgtggtgtacacgtagtcgtccttcgaaccctatcccgtccgggacacgtaaccttaccgatcgaccaaccgtaactccctaccaataaaaccncacgcctaacagtcggaagttgagacgcctagacattcngaaccgctacgggccctattacttactggagcagactcccagctcgggtnacgcccttacggcgacggccgttaccgtttgaccttcggcgggg

SEQ ID NO: 208173 - DNA, 532 bp, Homo sapiens
  misc_feature: GYAE6OF02IF9BF.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctgggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggctccatcgaggttcagtgcagtgatcgtgggacagatttcaatctcaccatcaccactctgcaactgaggtattgtgacaatctactactgtacaacagagttacacgttccctcgtcctacgtttcggaccgtagggacctaaggttagaagtaactaaccgaaaacggtaacgttcggtacggtactacgacctaaccgtacttccgtgttaccg

SEQ ID NO: 208174 - DNA, 595 bp, Homo sapiens
  misc_feature: GYAE6OF02IH8TW.17.25.C03.1.454.CMB.1.raw
  modified_base (344)..(344): a, c, t, g, unknown or other
  misc_feature (344)..(344): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaacgtgggtgcgccagggcccgctggaccaacgacctggagtggatgggatgggcgaaaccctaacagtggtntcacagtgtcttcacccatccgtccgggacagacctttaccatcgaaccacgaacctccctaccaataaaccacacgacctacagtaggtagttagaggacgcctggacactacgtcgaacgccgaacggtcccgtaattacgttaaccgtggtcgtaccggtaacgccgtaaccccgacgtaacgtcccgggttacgacgtcccgtaacggcgacggaccggttcccgtttagcccgtttcgaccggggg

SEQ ID NO: 208175 - DNA, 536 bp, Homo sapiens
  misc_feature: GYAE6OF02F3NTV.17.25.C03.1.454.CMB.1.raw
  modified_base (361)..(361): a, c, t, g, unknown or other
  misc_feature (361)..(361): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatgggcgaaccctaacactggtgtcacagtgtcttcacccatccnccgggacagacttaccatcgaccacgaacctcctccaactaaacacacgcctacatggagttgaggagcctgacatctgacgacacggccgtactattactgtgcgagacgtcccacgtacgtccggtgacgcccgtacggcgacggccggtcctttcgtaccgttcggtcgggg

SEQ ID NO: 208176 - DNA, 529 bp, Homo sapiens
  misc_feature: GYAE6OF02GUX1V.17.25.C03.1.454.CMB.1.raw
  modified_base (280)..(280): a, c, t, g, unknown or other
  misc_feature (280)..(280): n is a, c, g, or t
  modified_base (330)..(330): a, c, t, g, unknown or other
  misc_feature (330)..(330): n is a, c, g, or t
  modified_base (355)..(355): a, c, t, g, unknown or other
  misc_feature (355)..(355): n is a, c, g, or t
  modified_base (424)..(424): a, c, t, g, unknown or other
  misc_feature (424)..(424): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggcgaaccccanactggtgtcacagtgtcttcacccntcctcgggacagacttaccatcgaccacgaactcctacaataaacacacgcctacatggagttgaggancctgacatctgacgacacggcctctattactgtgcgagacgtcccacgacgtccggtgacgtcccgtacggcacggccggtcctttcggaccgttcggtacgggg

SEQ ID NO: 208177 - DNA, 549 bp, Homo sapiens
  misc_feature: GYAE6OF02JDIFK.17.25.C03.1.454.CMB.1.raw
  modified_base (330)..(330): a, c, t, g, unknown or other
  misc_feature (330)..(330): n is a, c, g, or t
  modified_base (441)..(441): a, c, t, g, unknown or other
  misc_feature (441)..(441): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcaaccctaanacgtggtgtcacagtgtcttcacccatcctcgggacacgtactaccatcgaccacgaacctcctaccaataaaccacacgacctacagtggagttggaggacgcctagacntcgtgaccgaccgacggcctacttacttactgtcgacgagacgtaccacgtacgtccggtgaccgccgtacggcgacggtccggtctttacgaccgttcggtccgggg

SEQ ID NO: 208178 - DNA, 522 bp, Homo sapiens
  misc_feature: GYAE6OF02G4IS9.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatggggcgaaccctaacactggtcgtcacagtgtcttcacccatcctccgggacagacttaccatcgaccacgaactcctacataaacacagcctacatggagttgaggagcctgacatctgaccgacgacggccgtctacttactgtgcgagtattgttttacgtgtactagtacgtactaatttgattacgctctatggtaacg

SEQ ID NO: 208179 - DNA, 568 bp, Homo sapiens
  misc_feature: GYAE6OF02J2419.17.25.C03.1.454.CMB.1.raw
  modified_base (279)..(279): a, c, t, g, unknown or other
  misc_feature (279)..(279): n is a, c, g, or t
  modified_base (412)..(412): a, c, t, g, unknown or other
  misc_feature (412)..(412): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatgtatcaactgggtncgccaggccgctggacacgacctgagtggatgggatgggccgaaccctacactggtgtcacgagtcgtcttcgacccagtcctccggggactacgacttaccatcgacccacgaacctccctacaataaaccncacgccctacgatgggaattggaagggtaccccgttgaacacgttctagacccgacgtaccgggccgttcttattaccgtgtcgccgagacgtccccaggtacgtccggtagacgtcctaggcctacggccgtcctttagaccgtttcgccggggg

SEQ ID NO: 208180 - DNA, 545 bp, Homo sapiens
  misc_feature: GYAE6OF02JHT6F.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaacctatttaaattggtatcagcagaaacctggaaaagccccagacctcctgatctctggtgcatccactctgcgaagtggcgtcccatcgaggttcagtggcagtggatcgtgggacagtactttcaattcctcaccatccaccactctcgcaacctgaggtattgtgctaatctactactgtacaacagtacgttactacgttcccctcgtactacgttttcggaccgtacgggtaacctaagttacgagtaactacgtaaacggaacgttggtaggctacgccgtacctacttcgttcgttacc

SEQ ID NO: 208181 - DNA, 538 bp, Homo sapiens
  misc_feature: GYAE6OF02IXNFJ.17.25.C03.1.454.CMB.1.raw
  modified_base (422)..(422): a, c, t, g, unknown or other
  misc_feature (422)..(422): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcaaccctaacactggtgtcacagtgtcttcacccatcctcggacagacttaccatgaccacgaactcctacaataaacacagcctacactggagttgaggancctagacatctgacgacgacggccgtactacttactgtgacgagtacgtcccacggactccgggtgacgtccgtaccggcgacggtccggtccgtttggtaccgttcggtacgggg

SEQ ID NO: 208182 - DNA, 512 bp, Homo sapiens
  misc_feature: GYAE6OF02IRFC6.17.25.C03.1.454.CMB.1.raw
  modified_base (328)..(328): a, c, t, g, unknown or other
  misc_feature (328)..(328): n is a, c, g, or t
  modified_base (389)..(389): a, c, t, g, unknown or other
  misc_feature (389)..(389): n is a, c, g, or t
  modified_base (450)..(450): a, c, t, g, unknown or other
  misc_feature (450)..(450): n is a, c, g, or t
  modified_base (472)..(472): a, c, t, g, unknown or other
  misc_feature (472)..(472): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcaacctanactggtgtcacagtgtcttcacccatcctccgggacagacttaccatgaccacgaactccncataaacacagcctacatggagttgagacgcctgacatcagacgacacggccgtcattacngtgcgagcgtcccagctccggnacgccgtacggcaggccggtcctttgaccgttcgtcgggg

SEQ ID NO: 208183 - DNA, 788 bp, Homo sapiens
  misc_feature: GYAE6OF02J3D4X.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtagcagcagctacaagtgcccactcccaggtgcagctggtgcagtcgtggggctgaggtgaagagccgtggggcctcgagtgaggtcctccgtgacaaggtccttcgtggtacttccacgtttacctcctattacgtactccgaacgtgggtcgcgaccgacggccgcgtaggaaccaacgtaccgtggaacggtggagtcgggacgtacggggaccctaaacccgtacgacgtcgggtcgtacgacgtagttcgtaccttacccgaaccctagtcccgtacgggtaacctaacgtaccttaaccgacgttaccgaacccgtaaccgtaacctaccctacaaaccttaaaccgaccgtacgtacctacgtacggtacggtaggttacgaacgggtacctacctaggtacctacgttccgtaacgacccggtaaccgtacccgggtaccgtttaccgttaacgttaccgttacggacgtaaccggtaaccgggttacccgtacccggtaaccgggttaacccggttccggtaaacccggtccggttaaccccggtaacccgggtaacccggttacccgggttaccccggggttttaacccttttacccgggggttaccccgtttaccggggggttaaccccggggg

SEQ ID NO: 208184 - DNA, 558 bp, Homo sapiens
  misc_feature: GYAE6OF02GLVA7.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacacgtggtgtcacagtgtcttcacccatcccgtccgggacagtaccttaccatcgaccacgaacctcctaccaataaaccacacgaccctacatggagttgaggagcctgactatctgaaccgacaccggccgttactattactggtcgacgagtaccgtcccacggtcgtaccggtagacgcccgtacggcgacggccgggtcctttcggtaccttcggtccggggg

SEQ ID NO: 208185 - DNA, 655 bp, Homo sapiens
  misc_feature: GYAE6OF02IH9N7.17.25.C03.1.454.CMB.1.raw
  modified_base (280)..(280): a, c, t, g, unknown or other
  misc_feature (280)..(280): n is a, c, g, or t
  modified_base (290)..(290): a, c, t, g, unknown or other
  misc_feature (290)..(290): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccnctggacaacgacctggacgtggatgggagtcgggaccgaaaccctaacacgtgggtctcgacagtgtcttcacccattcccgtccgggacacgacttaccagtcgaccacgaactccctaccaaataaaccacaagaccctaactagtagggtagtttacgaagggacgtccctagaccaagttcctaggaaccggtacccaccggggtcccgttacttaactttaccgttaggtcggtaccggaaggtacccggttacccccgaagggtaccgttaccccggggttaggaacccggttccccgtaaccgggccgaacgggtcccgggttccctttttacgggaccctttccgggtaccgggggg

SEQ ID NO: 208186 - DNA, 548 bp, Homo sapiens
  misc_feature: GYAE6OF02I87T3.17.25.C03.1.454.CMB.1.raw
  modified_base (442)..(442): a, c, t, g, unknown or other
  misc_feature (442)..(442): n is a, c, g, or t
  modified_base (472)..(472): a, c, t, g, unknown or other
  misc_feature (472)..(472): n is a, c, g, or t
  modified_base (504)..(504): a, c, t, g, unknown or other
  misc_feature (504)..(504): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctggagtggatgggatggggcgaaccctaacacgtggtgtacacgagtgtcttccaccctactccgtccgggacacgacttaccatcgaccacgaacctcctaccaataaaccacacgcctaacagtggagttgaggacncctgacatcagacgcacggctactacttcngtcgacgtagacgtcccaggtactcccggganaccgtccgtacggcacggccggtcctttggaccttggtcggggg

SEQ ID NO: 208187 - DNA, 519 bp, Homo sapiens
  misc_feature: GYAE6OF02F7V9I.17.25.C03.1.454.CMB.1.raw
  modified_base (279)..(279): a, c, t, g, unknown or other
  misc_feature (279)..(279): n is a, c, g, or t
  modified_base (290)..(290): a, c, t, g, unknown or other
  misc_feature (290)..(290): n is a, c, g, or t
  modified_base (329)..(329): a, c, t, g, unknown or other
  misc_feature (329)..(329): n is a, c, g, or t
  modified_base (337)..(337): a, c, t, g, unknown or other
  misc_feature (337)..(337): n is a, c, g, or t
  modified_base (404)..(404): a, c, t, g, unknown or other
  misc_feature (404)..(404): n is a, c, g, or t
  modified_base (427)..(427): a, c, t, g, unknown or other
  misc_feature (427)..(427): n is a, c, g, or t
  modified_base (462)..(462): a, c, t, g, unknown or other
  misc_feature (462)..(462): n is a, c, g, or t
  modified_base (485)..(485): a, c, t, g, unknown or other
  misc_feature (485)..(485): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtncgccaggccgntggaccaacgacctgagtggatgggatgggcaacctaanacgtggtntcacagtgtccttcacccatccaccgggacagacttaccatcgaccacgaactcctaccaataaacncagcctacatggagttgaggacncctagacatctagacacgacggccgtctattaccngtgcgagcgtcccagactcggtnacgtcctacggcaggccgtctttgcttcgcgggg

SEQ ID NO: 208188 - DNA, 524 bp, Homo sapiens
  misc_feature: GYAE6OF02HB02F.17.25.C03.1.454.CMB.1.raw
  modified_base (331)..(331): a, c, t, g, unknown or other
  misc_feature (331)..(331): n is a, c, g, or t
  modified_base (355)..(355): a, c, t, g, unknown or other
  misc_feature (355)..(355): n is a, c, g, or t
  modified_base (366)..(366): a, c, t, g, unknown or other
  misc_feature (366)..(366): n is a, c, g, or t
  modified_base (403)..(403): a, c, t, g, unknown or other
  misc_feature (403)..(403): n is a, c, g, or t
  modified_base (448)..(448): a, c, t, g, unknown or other
  misc_feature (448)..(448): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggacaaccctaanctggtgtcacagtgtcttcacccntcctccggganagacttacatcgaccacgacctcctaccaataaaccncaacgacctaacagtggtagttggagacgcctgacatcagacacncggctactattctgtgcgagctccacgactccggtagacgccgtacggcacggccgtctttgaccttcgtacgggg

SEQ ID NO: 208189 - DNA, 533 bp, Homo sapiens
  misc_feature: GYAE6OF02GE0KN.17.25.C03.1.454.CMB.1.raw
  modified_base (278)..(278): a, c, t, g, unknown or other
  misc_feature (278)..(278): n is a, c, g, or t
  modified_base (402)..(402): a, c, t, g, unknown or other
  misc_feature (402)..(402): n is a, c, g, or t
  modified_base (423)..(423): a, c, t, g, unknown or other
  misc_feature (423)..(423): n is a, c, g, or t
  modified_base (440)..(440): a, c, t, g, unknown or other
  misc_feature (440)..(440): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctctatagtatcaactgggtncgccaggccgctggacaacgacctgagtggatggggatgggcgaacctaacacgtggtgtcacagtgtcttcacccatcctccgggacagacttaccatcgaccacgaactcctaccataaacncacgcctacatggattgaggncctgacatcagacgacncgccgttctattactgtgcgagtacgtcccaggtactccggtgaacgtccgtaacgggccaggtccggtccttttcggaccttggtacggggg

SEQ ID NO: 208190 - DNA, 513 bp, Homo sapiens
  misc_feature: GYAE6OF02FIII5.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggggcctcagtgaaggtctcctgcaaggcttctggattcacgtttacctcctatagtattcaactgggtgcgccaggccgctggacaacgacctgagtggatgggatggggcgaaccctaacactggtgtcacagtgtcttcacccatcctccaggacagacttaccatgaccacgaactcctccataaacacagcctacatggagttgaggagctgacatctgacgacacggccgtctattactgtgcgtagagtcccaacgatccggtgacgcctacggcacgcggcctttgacttcgg

SEQ ID NO: 208191 - DNA, 544 bp, Homo sapiens
  misc_feature: GYAE6OF02GLPC3.17.25.C03.1.454.CMB.1.raw
  modified_base (280)..(280): a, c, t, g, unknown or other
  misc_feature (280)..(280): n is a, c, g, or t
  modified_base (290)..(290): a, c, t, g, unknown or other
  misc_feature (290)..(290): n is a, c, g, or t
  modified_base (330)..(330): a, c, t, g, unknown or other
  misc_feature (330)..(330): n is a, c, g, or t
  modified_base (475)..(475): a, c, t, g, unknown or other
  misc_feature (475)..(475): n is a, c, g, or t
  modified_base (500)..(500): a, c, t, g, unknown or other
  misc_feature (500)..(500): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgcaggccgntggacaacgacctgagtggatgggatgggcgaaccctaanactggtgtcacagtgtcttcacccatcccgtcgggacagacttaccatcgaaccacgaactcctaccataaaccacacgcctaacatgggaagttgaaggagcctgaccatcctggaaccgacgacggccgttacttacgttacngtgcgagacgtcccagattcccggngacgccgtacggcacggtccggtacctttggaccttgtacgggg

SEQ ID NO: 208192 - DNA, 545 bp, Homo sapiens
  misc_feature: GYAE6OF02JDFII.17.25.C03.1.454.CMB.1.raw
  modified_base (280)..(280): a, c, t, g, unknown or other
  misc_feature (280)..(280): n is a, c, g, or t
  modified_base (337)..(337): a, c, t, g, unknown or other
  misc_feature (337)..(337): n is a, c, g, or t
  modified_base (374)..(374): a, c, t, g, unknown or other
  misc_feature (374)..(374): n is a, c, g, or t
  modified_base (436)..(436): a, c, t, g, unknown or other
  misc_feature (436)..(436): n is a, c, g, or t
  modified_base (473)..(473): a, c, t, g, unknown or other
  misc_feature (473)..(473): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggcccgctgggaccaacgacctggagtggatggggatggggcgaaccctaanctggtgtcacagtgtcttcacccatccgtccgggacngacttaccatcgaccacgaacctccctacaataaaccacacgcctacatggagttgaggacncctgactagtctgaccgacacggccttactattacgngtagcgagcgtcccaggtactccgggtagacgccgtacggcacggtccggtctttgaccgttcggtacgggg

SEQ ID NO: 208193 - DNA, 535 bp, Homo sapiens
  misc_feature: GYAE6OF02FGMYV.17.25.C03.1.454.CMB.1.raw
  modified_base (280)..(280): a, c, t, g, unknown or other
  misc_feature (280)..(280): n is a, c, g, or t
  modified_base (290)..(290): a, c, t, g, unknown or other
  misc_feature (290)..(290): n is a, c, g, or t
  modified_base (337)..(337): a, c, t, g, unknown or other
  misc_feature (337)..(337): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccagccgntggacaacgacctgagtggatgggatggggcaaccctaacactggtntcacagtgtccttcacccatcctccggggacagacttaccatcgaccacgaactcctccaataaaccacacgcctacatggagttgaggagcctgacatctgacgacgacggccgtcttatactgtcgcgagacgtcccacgtactccgggtagacgccgtacggccacggccggttcctttcgaccttcgtacgggg

SEQ ID NO: 208194 - DNA, 518 bp, Homo sapiens
  misc_feature: GYAE6OF02FIWLJ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatggggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccagctccggtgacgcctacggcacgccggtcctttcgacttcgtcgggg

SEQ ID NO: 208195 - DNA, 542 bp, Homo sapiens
  misc_feature: GYAE6OF02HKROQ.17.25.C03.1.454.CMB.1.raw
  modified_base (297)..(297): a, c, t, g, unknown or other
  misc_feature (297)..(297): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtncatccactctgcgaagtggcgtcccatcgaggttcagtggcagtggatcgtgggacagatttcaatctcaccatacaccactctgacaaccgtgaggattgtagctaatctaactactgtacaacagtagttaccacgttcccctacgtaccttacgttttcggccgtaaggggacctaaggttggaacgtaactacaaaccggtaacgttagtcggacttacggcaccgtacttcgtcgttacc

SEQ ID NO: 208196 - DNA, 543 bp, Homo sapiens
  misc_feature: GYAE6OF02I8MJO.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctggagtggatgggatggggaccgaaccctaacacgtggtcgtcacagtcgtcttcacccatccgtccgggacagacttaccatcgaccacgaactcctaccaataaacacacgcctacatggagttgaggacgctgaccatcagaccgacacggccgtctattacgtgtcgacgagacgtcccacggtctccggtagacgcctacggcacggtccggtctttacggaccgttgtccgggg

SEQ ID NO: 208197 - DNA, 554 bp, Homo sapiens
  misc_feature: GYAE6OF02JBIVN.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaacctatttaaattggtatcagcagaaacctggaaaacgcccccagacctcctgatctctggtgcatccactctgcgaagtcggcctcccatcgaggttcaggtggcaggtggatcgtgggacagtatttcaatctacacatccaccactctgcctaaccgtgaggtattgtcgacaattcctactactgtacaactagacgtttacacgttcccctgtccttacgtttcggaccgtaaggggtaacctaaggttcgaacgtaactaaccgaaaacgtacgtcggtcggaccgtacgacccactacttcgtcgttacc

SEQ ID NO: 208198 - DNA, 562 bp, Homo sapiens
  misc_feature: GYAE6OF02G8L3U.17.25.C03.1.454.CMB.1.raw
  modified_base (334)..(334): a, c, t, g, unknown or other
  misc_feature (334)..(334): n is a, c, g, or t
  modified_base (477)..(477): a, c, t, g, unknown or other
  misc_feature (477)..(477): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttcgtggattcacgtttacctcctatagtatcaactgggtgcgccaggccgctggaacaacgacctggagtggatgggatggggacaaccctaanacgtggtgtcaacagtgtccttcgaccctagtccgtccgggacagtacttaccatcgaccacgaactccaccaataaacacacgacctacaagtggagttggagacgctgacatcgtagacgacaccggccgtactattacgngtacgcgagacgtcccgacggtactcccgggtagacgtacccgtacggcacggtccggtccgtttggtaccgttcggtccggggg

SEQ ID NO: 208199 - DNA, 532 bp, Homo sapiens
  misc_feature: GYAE6OF02G85GY.17.25.C03.1.454.CMB.1.raw
  modified_base (279)..(279): a, c, t, g, unknown or other
  misc_feature (279)..(279): n is a, c, g, or t
  modified_base (336)..(336): a, c, t, g, unknown or other
  misc_feature (336)..(336): n is a, c, g, or t
  modified_base (366)..(366): a, c, t, g, unknown or other
  misc_feature (366)..(366): n is a, c, g, or t
  modified_base (401)..(401): a, c, t, g, unknown or other
  misc_feature (401)..(401): n is a, c, g, or t
  modified_base (409)..(409): a, c, t, g, unknown or other
  misc_feature (409)..(409): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgagaagcctggggcctcagtgaaggtctcctgcaaggcttctggattcacgtttacctcctatagtatcaactgggtncgccaggccgctggacaacgacctgagtggatgggatgggcaaccctaacactggtncacagtgtcttcacccatcccgtcgggacngactaccatcgaccacgaacctcctccaataaacncagcctanatggagttgaggcgcctagaccatctgacgaccacggcccgtatacttacgtgtcgcgagacgtcccacgtagtcccggtagacgccgtacggcacggccggtcctttcggacttcgtcgggg

SEQ ID NO: 208200 - DNA, 593 bp, Homo sapiens
  misc_feature: GYAE6OF02G1LH1.17.25.C03.1.454.CMB.1.raw
  modified_base (337)..(337): a, c, t, g, unknown or other
  misc_feature (337)..(337): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgcctgagtggatgggatgggacaaccctaagactggtntcacagtgtcttcacccatcctaccgggacagacttacatcgaccacgaacctcctaccaataaaccacagccctaacagtggtagttggaggacgcccttaggaacctagtccgtaggaaccgacgtaccggcccgttactagtttaccgtggtacgtccggtaagccgttacccgaacgtacggtacccgggtagaccggtacccgttacgggctacggcccggttaccttttggtacccttccggtacggggg

SEQ ID NO: 208201 - DNA, 609 bp, Homo sapiens
  misc_feature: GYAE6OF02G2S7I.17.25.C03.1.454.CMB.1.raw
  modified_base (329)..(329): a, c, t, g, unknown or other
  misc_feature (329)..(329): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtgcgccaggccgctggacaacgacctgagtggatgggatgggcaaccctaanacgtggtcgtcacgagtgtcttcacccatcccgtaccgggacacgacttaccatcgaccacgaacctccctaccaataaaccactacgccctaacagtacggagttcggaaggtacgtccctagaactacttcgtacggaaccgaccgaccgggtccgttacttaagttaccgtggtacgacggtaacgtacgtaccccgaaggtaccgttacccgggtagaacgtcccgtacgggcctacgggccggttccgttttacggaccgtttcggtaccggggg

SEQ ID NO: 208202 - DNA, 580 bp, Homo sapiens
  misc_feature: GYAE6OF02I87ZV.17.25.C03.1.454.CMB.1.raw
  modified_base (283)..(283): a, c, t, g, unknown or other
  misc_feature (283)..(283): n is a, c, g, or t
  modified_base (295)..(295): a, c, t, g, unknown or other
  misc_feature (295)..(295): n is a, c, g, or t
  modified_base (336)..(336): a, c, t, g, unknown or other
  misc_feature (336)..(336): n is a, c, g, or t
  modified_base (347)..(347): a, c, t, g, unknown or other
  misc_feature (347)..(347): n is a, c, g, or t
  modified_base (381)..(381): a, c, t, g, unknown or other
  misc_feature (381)..(381): n is a, c, g, or t
  modified_base (417)..(417): a, c, t, g, unknown or other
  misc_feature (417)..(417): n is a, c, g, or t
tcagcgtagactagcacgaccggtgctcgatttagtagtgtagatttgggtttggggactcaactaaccacatctgttcctctagagaaaaccctgtgagcacagctcctcaccatggactggacctggaggatcctcttcttggtggcagcagctacaagtgcccactcccaggtgcagctggtgcagtctgggctggaggtgaagaagcctggggcctcagtgaaggtctcctgcaaggcttctggattcacgtttacctcctaatagtatcaactgggtncgccgaggccgntcggacaacgacctggagtggatgggatgggacaaccctanactggtgtcanagtgtctcaccatcctcgggacagaccttacatnacctacgaactcctacgaactaaacacgagccctanagtcggagttggagacgcctgaacagttctcggaaccgaccgacgggccttactaacttcgtagtcgacgtagtaccgtacccaaccggtaacgtcccgggtaggacccgtcccgtaacgggccacgggtccgtccttttacggacctttccggtaccggggg

SEQ ID NO: 208203 - DNA, 611 bp, Homo sapiens
  misc_feature: GYAE6OF02F7QFX.17.25.C03.1.454.CMB.1.raw
  modified_base (430)..(430): a, c, t, g, unknown or other
  misc_feature (430)..(430): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggggcctcagtgaaggtctcctgcaaggcttctggattcacgtttacctcctatagtatcaactgggtgcgccaggccgctggacaacgacctgagtggatggggatcggggacgaaccctaacacgtggtgtcacagtgtcttcaccctactccgtaccgggacacgacttaccatcgaccacgaacctcctaccaataaaccacacgaccctaacngtaggagttggacggacgcccttagactactcgtacgaaccgaccgaccggtccgtacttaagttacctggtagaccgacgtacgtacccgaaggtacctcccgggtagaccggtcccgttaaccgggccgtacggtcccgggttaccgttttacggtacccgtttcggtaacccgggggg

SEQ ID NO: 208204 - DNA, 819 bp, Homo sapiens
  misc_feature: GYAE6OF02GC1HD.17.25.C03.1.454.CMB.1.raw
tcagcgtagactagcacgaccggtgctcgatttagtagtgtagatttgggtttggggtacggtccaacaaccaccagtcttcgtcctctagtagaaaaccctgtgagcaacagctcctcaccatggactggacctggaggatcctcgttcttggtggcagcagtcgttacaagttgccctacttacccgaggtgcagctggtgcagtctgggctggaggtgaagagcctggggcctcagtgaaggtctcctgcgaaggcttctggattacacgtttacctcctatacgttatcgaaactgggtacgcgtcccgtacggcccgacgtcgggaacgtaaccggacccttggtaggttcgggaattcgggggaaacttcgggggaccgtaaaacccccgttaaacgaccgttgggttacggttacccgaaacgtaacggtttagtttaaccttttccgaaacccccgtagttaccccgttacccgggggtaactaacggggtaaccctttaaccgaacttacgggaaccccaaccggtaaacccttccccgtaccgaaacttaaaaacccgaaaccgaacggacccttaaacaacgttacgggtaagtttacgggaagggtaacggtaacccgttaggaaacctacgttaccgttagggaaccgtaaccgaaccggggtacccgttacgttaacgtttaccgtggttacgacgtaaggtacgttacccgtaggtaacgttccgggttaggacccgttcccggttaaccgggccgtaacggttcccggtaccgtttacggtacccgtttcggttacccggggg

SEQ ID NO: 208205 - DNA, 660 bp, Homo sapiens
  misc_feature: GYAE6OF02J0OA5.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagccgtggggcctcagtgaaggtctcctgcaaggcttctggattcacgtttacctcctatagtactcaacgtgggtgccgcaggccgcgtgggaccaacgacctggagtggagtgggagtgggaccgaaccctaacgacgtggtgtacacgagttcgtcttccaccctacgtcccgtaccggggaacacgtaccttaccgactacgaccgacgtaaacctccctaaccaaagtaaaacccacgtaacgtaccctaaacgagttacgggaagtttacggaacgggtacgtcccttaaggacctagtccgtaggaacccgtaccgaaccggggtcccttacgttaacttaccgtggtacggacgacggtacgtaccccgaacggtaccgtccgggtagtaccgccggtaacggccacgggtccgttaccggttttcgaccggtttccgtacggggg

SEQ ID NO: 208206 - DNA, 658 bp, Homo sapiens
  misc_feature: GYAE6OF02F0226.17.25.C03.1.454.CMB.1.raw
  modified_base (372)..(372): a, c, t, g, unknown or other
  misc_feature (372)..(372): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtagaagaagccgtggggcctcgagtaggaaggtcctccgtgcgaaggccttcgtaggtattcctacgtttaccctcctatagtatcaacgtgggtgcgccgaggccgcgtggaaccaacgacctggaggtggagtgggagtggggaccgaaacccgtaacacgttgggtntaccacgtagttcgttccttaccaccctatcccgtcgggaacagtaccttacagtcgaaccacgtaacctccctacaaactaaaccacacgtaccctaacagtacgggtagttacggagggtacgtccgtagaacctactacgtacggaccgaccgaccgggtccttacgttaacttacgtcgtcgacgacgtaccgtacccacggtaacgtccgggtagaaccggtacccgtacggaccgtacgggtcccggttaccgtttacggtacctttccgggtaccgggg

SEQ ID NO: 208207 - DNA, 553 bp, Homo sapiens
  misc_feature: GYAE6OF02GUEUT.17.25.C03.1.454.CMB.1.raw
  modified_base (382)..(382): a, c, t, g, unknown or other
  misc_feature (382)..(382): n is a, c, g, or t
  modified_base (430)..(430): a, c, t, g, unknown or other
  misc_feature (430)..(430): n is a, c, g, or t
tcagcgtagactagcacgaccggtgctcgatttagtagtgtagatttgggtttggggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaatggtatcagcagaaacctggaaaacgccccagaccctcctgactctctggtgcatccactctgcgaagtcggccgtccagtcgaggttcagtggcaggtggatcgtgggacagtactttcaatctacaccanccaccactctcgacaactgagtatgtgacaactctactactgtacaanagtacgttactaccgttcccctcgtcttacgttttcggaccgtacggggtaacctaagttacgaagtactaaccgaaacgtaacgttacggtacggtcgtacgacctaacctatcttgttacc

SEQ ID NO: 208208 - DNA, 603 bp, Homo sapiens
  misc_feature: GYAE6OF02JAFA9.17.25.C03.1.454.CMB.1.raw
  modified_base (280)..(280): a, c, t, g, unknown or other
  misc_feature (280)..(280): n is a, c, g, or t
  modified_base (290)..(290): a, c, t, g, unknown or other
  misc_feature (290)..(290): n is a, c, g, or t
  modified_base (329)..(329): a, c, t, g, unknown or other
  misc_feature (329)..(329): n is a, c, g, or t
  modified_base (337)..(337): a, c, t, g, unknown or other
  misc_feature (337)..(337): n is a, c, g, or t
  modified_base (455)..(455): a, c, t, g, unknown or other
  misc_feature (455)..(455): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccntggacaacgacctgagtggatgggatgggcgaacctaanacgtggtntcacagtgtcttcacccatccgtaccgggactagaccttaccagtagacccagaacctcctaccaaactaaaccactacgcccttaaacgagttcgggaagtttcggaagggtaaccnccgtagactagttacgtacggaccgaccgaccggtaccgttacgttaacttacgtgtacgacgtaacgccgtacccgacggtcgtaccggtagaccgtaccgtaccgggcgtacggtcccggttccgtttaggaccgttccggcgggg

SEQ ID NO: 208209 - DNA, 579 bp, Homo sapiens
  misc_feature: GYAE6OF02I4JSJ.17.25.C03.1.454.CMB.1.raw
  modified_base (280)..(280): a, c, t, g, unknown or other
  misc_feature (280)..(280): n is a, c, g, or t
  modified_base (290)..(290): a, c, t, g, unknown or other
  misc_feature (290)..(290): n is a, c, g, or t
  modified_base (485)..(485): a, c, t, g, unknown or other
  misc_feature (485)..(485): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccnctggacaacgacctggagtggatgggatgggcgaaccctaagactggtgtcacagtgtcttcacccatcccgtccgggacacgacctttaaccatcgaacccacgaaacctccgtaccaataaaccacacgcctacagtggagttgaggagccctagaccatcgagacgaccgacgggccgttctaacgtttacnggttacgccgaagacgtacccgacggtagtcccgggtagaccgtcccgtacggaccgaggcccggttcctttaggtacccttcggtaccggggg

SEQ ID NO: 208210 - DNA, 602 bp, Homo sapiens
  misc_feature: GYAE6OF02JQN4X.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggtacgttaaaacctatttaaaattggtatcagcaagaaacctaggaaaacgccccagtacctcctgactctctggtgacatccactctgacgaagtggctcccagtcgaggtcagtggcagtgatcgtgggacagtattcaactctacactatcaaccctatccgtagaccaaccgtggacggtattgtagtacgtaaacttcctaacttactacgtaacctaaacgtagtaactttacccgacgtttccccacgtacctttacgtttcggaaccgtaacggggtaacctaaggttcgaaacgtacgtaaccgtaaaacggtacttacgggtcggtaaccgtcggacctaaccgacgtttccgttatttacccg

SEQ ID NO: 208211 - DNA, 639 bp, Homo sapiens
  misc_feature: GYAE6OF02FLQ2O.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgttacctcctatgatcaactgggtgcgccagccgctggacaacgactgagtggatgggatgggccgaaccctaacactggtgtcacagtgtcttcacccatccgtccggggacagaccttaccgatcgacccacgtaacctcctaccaactaaaccacacgacccttacactgggaagttgaacgggtacgcctagaccacttcgtacggaacccggaaccgaacccggttcccgttaaccttaacgtttaacctcggtacggaccggtaacggtacccgtaccccgaacggttaacggtcccgggtacgtaaccggtaccccggttaacggccgtaacgggtcccgggttacccgttttacggtaccgtttccgggtacccggggg

SEQ ID NO: 208212 - DNA, 850 bp, Homo sapiens
  misc_feature: GYAE6OF02FZ8GG.17.25.C03.1.454.CMB.1.raw
tcagcgtagactagcacgaccggtgctcgatttagtagtgtagatttggtttggggacctcaacaaccacactctgtcctctacgagaaaaccctgtgagccaccagctccctcgacccagtggactggaccttggaggatcctcttcttggtggcgagccagcctacgaagtgcccactcccaggtgcagctggtgcagtcgtgggcgtgagtgagaagtcctgggcctcgagtgaaggtctcgtgcaaggtcttctggtattctacgtttacctccgtatagtactcgaccgtggtgcgtccgaggccgcgtggacaacgaccgtgacggtggagtcgggaagttcgggaccgaaaccccgttaaaacgtaccgttaggtacgttacgaaccgtaacggttacgttaccgtttaccgaacccctaacgttcccgtacccggggtaacaacgtaaccctttaacccgaacgtttacggaaccctaaccggtaaacttccccgttacccgaaacttaaaacccgaccgtaacggtaccccttaaacgtacgttacgggtaaacggtttaggaaaccggggtaaccgtaccccgttaaccgggtaaccttaaacgtttccgtttaacgggtaaccgtaacccgtaacccggggttaccccgttttaaccgtttaaacgtttttaccgtggttttcgaacccgggttaacggtaccgtttacccccgaaacggttaaccggttttacccgggtaacgttaccccggttaccccggttaaccggggtaccctaccgggttacccggttcccccggttttttacggacccgttttttccgggaaccccgggggg

SEQ ID NO: 208213 - DNA, 531 bp, Homo sapiens
  misc_feature: GYAE6OF02J15SY.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgagttcagtggcagtgatcgtgggacagtatttcaatctcacatcaccactctgcactgagtattgtgcatctactactgtacaacagtacgttactacgttcccctcgtacctacgttttacggcccgtaaggggaccctaaaggttgaacggtaactacgaaacgaacttggtacgcgttcgaccacctactccttagttcc

SEQ ID NO: 208214 - DNA, 537 bp, Homo sapiens
  misc_feature: GYAE6OF02GGRIJ.17.25.C03.1.454.CMB.1.raw
  modified_base (280)..(280): a, c, t, g, unknown or other
  misc_feature (280)..(280): n is a, c, g, or t
  modified_base (417)..(417): a, c, t, g, unknown or other
  misc_feature (417)..(417): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatggggcgaaccctaacactggtgtcacagtgtcttcacccatcctccgggacagacttaccatcgaccacgaacctcctaccaataaacacacgccctaanagggtgagttgaggacgcctgacatctgaaccgacacggtcctctaattactgtgcgagacgtcccaggtctccggtgacgtccgtacggcaggtccggtcctttagaccgttgtcgggg

SEQ ID NO: 208215 - DNA, 548 bp, Homo sapiens
  misc_feature: GYAE6OF02HFGG3.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaacgccccagacctcctgatctctggtgcatccactctgcgaagtgccgtcccatcgaggttcagtggcagtggatcgtgggacagtatttcaatctacaccatccaccactctgaccaaccgtgagtacttgtgacaatctactactagtacaactagtacgttacaccgttccctcgaccttacgtttcggacgtacggggaacctaaggttgaacgtacgtaaccaaacggtaactaggtcggtactacgacccgtaacacttcctagttacc

SEQ ID NO: 208216 - DNA, 609 bp, Homo sapiens
  misc_feature: GYAE6OF02GWG99.17.25.C03.1.454.CMB.1.raw
  modified_base (344)..(344): a, c, t, g, unknown or other
  misc_feature (344)..(344): n is a, c, g, or t
  modified_base (425)..(425): a, c, t, g, unknown or other
  misc_feature (425)..(425): n is a, c, g, or t
  modified_base (544)..(544): a, c, t, g, unknown or other
  misc_feature (544)..(544): n is a, c, g, or t
tcagcgtagactagcacgaccggtgctcgatttagtagtgtagatttgggtttgggggacgtcaacaaccacatctgtcctctagacgaaaaccctgtgagcacagctcctcaccatggactggacctggaggatcctcttcttggtggcagcagctacaagtgcccactcccaggtgcagctggtgcagtctgggctgaggtgaagagcctggggcctcgagtgaaggtctcctgcaaggcttctggattcacgtttacctcctatagtatcaacgtgggtgcgccaggccgcgtggacaacgacctggagtggatgggatgggacaaccctaacacgtggtntcacgagtcgtcttcaccctatccgtccggacagacctaccatacgaccacgaactcctacgaactaaacacagccctaanacgtggtagttagacggacgtccgtgaacctatccgttagaaccggtaccgaacgggtcccgtaacttacttaacgtggttacgacgacgtaccgtcccgaacggtacttcccgggtanaccggtccgttacgggacctacgggtcccggttacccgtttacggtacccgttacggtccggggg

SEQ ID NO: 208217 - DNA, 530 bp, Homo sapiens
  misc_feature: GYAE6OF02G18VZ.17.25.C03.1.454.CMB.1.raw
  modified_base (297)..(297): a, c, t, g, unknown or other
  misc_feature (297)..(297): n is a, c, g, or t
  modified_base (397)..(397): a, c, t, g, unknown or other
  misc_feature (397)..(397): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaacgccccagacctctgatctctggtncatccactctgcgaagtggcgtcccatcgagttcagtggcagtggatcgtgggacagtatttcaatctcacatcaccactctcgcaacctgagtattgtnacaatctactactgtacaacagtacttactacgttcccctcgccttacgtttcggaccgtaggggtaaccctaagttgaacgtactaaccgaaacgtaacgttggtacggactcgaccactacttcgtgttcc

SEQ ID NO: 208218 - DNA, 524 bp, Homo sapiens
  misc_feature: GYAE6OF02IQ09A.17.25.C03.1.454.CMB.1.raw
  modified_base (332)..(332): a, c, t, g, unknown or other
  misc_feature (332)..(332): n is a, c, g, or t
  modified_base (466)..(466): a, c, t, g, unknown or other
  misc_feature (466)..(466): n is a, c, g, or t
  modified_base (483)..(483): a, c, t, g, unknown or other
  misc_feature (483)..(483): n is a, c, g, or t
  modified_base (491)..(491): a, c, t, g, unknown or other
  misc_feature (491)..(491): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaanacgtggtgtcacgagtgtcttcacccatcctccgggacagaccttaccatcgaccacgaactcctaccaataaaccacagcctacagtggagttgaggacgcctagacatctgacgacgacggcctactattcngtgcgagacgtccacgntccggtanacgtcgtacggcaggccgtcttgacttgtcggg

SEQ ID NO: 208219 - DNA, 558 bp, Homo sapiens
  misc_feature: GYAE6OF02JPO6Y.17.25.C03.1.454.CMB.1.raw
  modified_base (277)..(277): a, c, t, g, unknown or other
  misc_feature (277)..(277): n is a, c, g, or t
  modified_base (412)..(412): a, c, t, g, unknown or other
  misc_feature (412)..(412): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctaggaaaacnccccagacctcctgactctcgtggtgcatccactctgcgaagtcggcctccatcgagttcagtgcagtgatcgtgggacagtactttacattcacaccataccaccactctacgacctaaccgtagaggtattgngactaatctactactgacaacgagtacttacacgttccctcgtaccttacgtttcggaacccgtagggtaacctaagttacgtaacggtaactaacgaaacgtaacgttcgtacggctacgcctaaccgtacttccgtacgttacc

SEQ ID NO: 208220 - DNA, 569 bp, Homo sapiens
  misc_feature: GYAE6OF02GGDWJ.17.25.C03.1.454.CMB.1.raw
  modified_base (298)..(298): a, c, t, g, unknown or other
  misc_feature (298)..(298): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctcctgtctgcctctgtgggggtcagagtcaccatcacttgccggacaagtcacggcgttaaaacctatttaaatggtatcagcagaaacctggaaaacgccccagacctcctgatctctggtncatccactctgcgaagtggcgtcccatcgaggttcagtggcagtggatcgtgggacagtatttacaattcctacaccatccaccactctcgacaacctgagtattgtgactaatctactactgtacaactagtacgttacctacgtttcccctacgtccttacgttttcggaccgtaacggggtaacctaaggttacgacgtaactaccgtaaaacggtaacgttcggttacggtaccgtcgaaccctaccgtacttccgttacgttaccg

SEQ ID NO: 208221 - DNA, 587 bp, Homo sapiens
  misc_feature: GYAE6OF02IQKQS.17.25.C03.1.454.CMB.1.raw
  modified_base (277)..(277): a, c, t, g, unknown or other
  misc_feature (277)..(277): n is a, c, g, or t
  modified_base (327)..(327): a, c, t, g, unknown or other
  misc_feature (327)..(327): n is a, c, g, or t
  modified_base (416)..(416): a, c, t, g, unknown or other
  misc_feature (416)..(416): n is a, c, g, or t
  modified_base (462)..(462): a, c, t, g, unknown or other
  misc_feature (462)..(462): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggctcagtgaaggtctcctgcaaggcttctggattcacgtttacctcctatagtatcaactgggtncgccaggccgctggacaacgactgagtggatgggatgggcgaaccctaanacgtggtcgtcacagttctcgttaccacccatcccgtccgggaactagaccttaccatcgaacccacgtaacctcccacaataaaaccncaacgacctaacagtcggtaagttgaggacgtcctagacatcgtanacgacgaccgtccgtacttagttacctggacgtacgacgacgttccccgacggtcgttccggtaggaccgtacccgtacggacgacggtccgggtacccttttcggacctttcggtaaccggggg

SEQ ID NO: 208222 - DNA, 553 bp, Homo sapiens
  misc_feature: GYAE6OF02I4IOO.17.25.C03.1.454.CMB.1.raw
  modified_base (328)..(328): a, c, t, g, unknown or other
  misc_feature (328)..(328): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctgggcctcagtgaaggtctcctgcaaggcttctggattcacgtttacctcctatagtatcaactgggtgcgccaggccgctggacaacgacctgagtggatgggatgggacaaccctanactggtgtcacagtgtcttacaccctatcccgtacgggacagtacttaccatcgaccacgaactcctacaataaaccacacgccctaacatggagttagaggacgtccgtgactatcagaccgactacggccgttactacttactgtacgacgtagacgtacccgagtcgtccggtagacgtcccgtacggcacggtccggtacctttggtaccgttcgtcgggg

SEQ ID NO: 208223 - DNA, 524 bp, Homo sapiens
  misc_feature: GYAE6OF02I0AGD.17.25.C03.1.454.CMB.1.raw
  modified_base (333)..(333): a, c, t, g, unknown or other
  misc_feature (333)..(333): n is a, c, g, or t
  modified_base (340)..(340): a, c, t, g, unknown or other
  misc_feature (340)..(340): n is a, c, g, or t
  modified_base (396)..(396): a, c, t, g, unknown or other
  misc_feature (396)..(396): n is a, c, g, or t
  modified_base (404)..(404): a, c, t, g, unknown or other
  misc_feature (404)..(404): n is a, c, g, or t
  modified_base (413)..(413): a, c, t, g, unknown or other
  misc_feature (413)..(413): n is a, c, g, or t
  modified_base (452)..(452): a, c, t, g, unknown or other
  misc_feature (452)..(452): n is a, c, g, or t
  modified_base (485)..(485): a, c, t, g, unknown or other
  misc_feature (485)..(485): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctgggacaacgacctggagtggatggggatgggcaaccctaancgtggtntcacagtgtcttcacccatccctcgggacagaccttaccatcgaccacgaactccncataaacncagcctaanatggagttgaggagcctgacagtctgacgacacggcctntattacgtgtagcgagcgtcccagactccggtnacgcctacggcacggccgtctttcgacttcggtacgggg

SEQ ID NO: 208224 - DNA, 626 bp, Homo sapiens
  misc_feature: GYAE6OF02IJJXS.17.25.C03.1.454.CMB.1.raw
  modified_base (245)..(245): a, c, t, g, unknown or other
  misc_feature (245)..(245): n is a, c, g, or t
  modified_base (261)..(261): a, c, t, g, unknown or other
  misc_feature (261)..(261): n is a, c, g, or t
  modified_base (335)..(335): a, c, t, g, unknown or other
  misc_feature (335)..(335): n is a, c, g, or t
tcagcgtagactagcacgaccggtgctcgatttagtagtgtagatttgggtttggggtacgtcaacaaccacatctgtcctctagagaaaaccctgtgagcacagctcctcaccatggactggacctgggaggatcctcttcttggtggcagcagctacaagtgcccactcccaggtgcagctggtgcagtctggggctgaggtgaagagcctggggctcagtgaaggtctcctgcaaggcttcnggattcacgtttaccncctatagtactcaacgttggggtgccgaccagggcccgtctgggaaccaacgacctgagttggaagtggggtancgggggaccgaaaaccctaacgacgtgggttacgtctacgtaaggtgtactttaccaaccctatcccgtacggggacaaggtaccttaccgatcgaaccacgaactcctaccataaacactacgcctacagtcggagttacggaggactccagacacgtcgtgaaccgacgaccggtccgtacttacgttaacctggtccgtaggactaacggtcccctaaggccgttaccggtacgagtcccgtaacggccacggtcccggtaccttttcgtacgtcggttaccgggggg

SEQ ID NO: 208225 - DNA, 624 bp, Homo sapiens
  misc_feature: GYAE6OF02GLR3T.17.25.C03.1.454.CMB.1.raw
  modified_base (280)..(280): a, c, t, g, unknown or other
  misc_feature (280)..(280): n is a, c, g, or t
  modified_base (332)..(332): a, c, t, g, unknown or other
  misc_feature (332)..(332): n is a, c, g, or t
  modified_base (348)..(348): a, c, t, g, unknown or other
  misc_feature (348)..(348): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgcgtggacaacgacctgagtggatgggatgggcgaaccctaanacgtggtgtcacagtntcttcacccatccgtccgggacgacttaccatcgaccacgaactccctaccaataaaccacacgcctaacagtcgggagttggaacgggtacgtcccgtagaaccattccgtaggaacccgacgacccgggtcccgttacttaagtttaccgtggtacggccggtaagtaccggtaccccaacggtacgttcccggggtagaccggtcccggttaaccggccgaacgggtcccgggttaccttttggacccgttttccggtcggggggaaccccgg

SEQ ID NO: 208226 - DNA, 542 bp, Homo sapiens
  misc_feature: GYAE6OF02IY6KN.17.25.C03.1.454.CMB.1.raw
  modified_base (277)..(277): a, c, t, g, unknown or other
  misc_feature (277)..(277): n is a, c, g, or t
  modified_base (361)..(361): a, c, t, g, unknown or other
  misc_feature (361)..(361): n is a, c, g, or t
  modified_base (387)..(387): a, c, t, g, unknown or other
  misc_feature (387)..(387): n is a, c, g, or t
  modified_base (401)..(401): a, c, t, g, unknown or other
  misc_feature (401)..(401): n is a, c, g, or t
  modified_base (416)..(416): a, c, t, g, unknown or other
  misc_feature (416)..(416): n is a, c, g, or t
  modified_base (439)..(439): a, c, t, g, unknown or other
  misc_feature (439)..(439): n is a, c, g, or t
tcagcgtagactagcacgaccggtgctcgatttagtagtgtagatttgggtttgggggagtcagtctcagtcaggacacagcatggacatgagggtccccgctcagctcctgggctcctgctactctggctcgagctgccagatgtgacatccagatgacccagtctccatcctccctgtctgcctctggtgggggtcagagtcaccatcacttgccggacaagtcacggacgttaaaacctatttaaattggtatcagcaagaaacctggaaaacnccccagacctctagactctctggtgcatccactctcgagaagtggcctcccatcggaggttcaggtgcagtggatcgtgggacngtattcaatctacacatcaccactcngcactgagtattgngacactctactactntacaacagtatactacgttcccncgttctacgtttcggaccgtaaggggtaacctaggttacgaagtaacgtaacgaaacgtaacgttaggtacggacgtacgactaaccgtactcgtagttaccg

SEQ ID NO: 208227 - DNA, 584 bp, Homo sapiens
  misc_feature: GYAE6OF02IU29X.17.25.C03.1.454.CMB.1.raw
  modified_base (244)..(244): a, c, t, g, unknown or other
  misc_feature (244)..(244): n is a, c, g, or t
  modified_base (275)..(275): a, c, t, g, unknown or other
  misc_feature (275)..(275): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaaacctnttaaattggtatcagcagaaacctggaaaanccccagacctctgatctctggtgcatccatctgcgaagtggctccatcgagttcagtgcagtgatcgtgggacagtatttcaatctcacatccacactctgacaactgagtattgtgactaatctaactactctacaactagtacgttacgacgtttcccctcgtccgttaacttttcgggaccgtaacgggggtaaccctaaagggtttcggaaacggtaacgttaacccgtaaaaccggtaaaccgttacgggtacgggtaccgtacggtaacccgtaaccgtaacgtttcccgttaggtttacccg

SEQ ID NO: 208228 - DNA, 724 bp, Homo sapiens
  misc_feature: GYAE6OF02ICF0S.17.25.C03.1.454.CMB.1.raw
tcagcgtagactagcacgaccggtgctcgatttagtagtgtagatttgggtttggggacgtcaacaaccacatctgtcctctagagaaaaccctgtgagcacagctcctcaccatggactggacctggaggatcctcttcttggtggcagcagctacaagtcgcccactcccaggtgcagctggtgcagtcgtggggctgaggtgaagagccgtgggctcaggtgaaggtctcctgacgaaggtcttcgtggattccgtaccgtttacctccttaatagttactacgtaacgttggggtcgccggccgacgggcccgcgtacggaaccaaaccggtaccgtaggacggttagggagttacggggagtcggggacccgtaaaccctaacgtacgtggtcgtaccgacgtagtcgttactacccaacctacgtcccgtaccgggactacggtaaccttaccagtccgaacccgagtaacccttcctaacctaaactaaaccacgtaaccgcctaacgagtacgggtaggttacggaaggaccgtccgtacgaacacgttcgtaacggaccggtacccgaccgggtaccttacttacgttacgtggtaccgacggtaactaccgtaccccgtacggtaacgttccccggggttagaacccggttaccccggacggcccgtaacgggtcccggttaccgttttacggaccggtttcccgggagggggg

SEQ ID NO: 208229 - DNA, 615 bp, Homo sapiens
  misc_feature: GYAE6OF02H06R0.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagaagccgtggggcctcgaggtgaaggtctccgtgcaaggtcttctggattctacgtttacctctatagtatcaacgtgggtgcgccgaggccgctacggaccaaccgccgtggagtggagtggggatcgggggaccgaaaccccgtaacgacgtgggtcgtacgacgtaggttcgtccttaccacccactccgtccgggaacacgtacttaccatcgaccacgaacctccctaccaactaaacacacgcctacagtggtagttaggaggacgccgtagactacgtcgtacgaccgaccgaccggtcccgtacttacttaccgtgtacgcgagtaccgtcccgacgacgttcccggagaccgtaccgtacggccgaggtcccggttcctttcggtaccgtttcggtccggg

SEQ ID NO: 208230 - DNA, 550 bp, Homo sapiens
  misc_feature: GYAE6OF02ITGAR.17.25.C03.1.454.CMB.1.raw
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgcctgagtggatgggatcggggcaaccctaacactggtgtcacgagtcgtcttccacccatcccgtccgggacacgacttaccatcgaccacgaacctccctacaataaacacacgacctacataggagttggaggacgcctagacatctagaccgacgacggccgttctacttactgtcgcgagacgtcccacggtactccggtgacgccgtacggcgaggtccggtcctttcgtacgttcgtacgggg

SEQ ID NO: 208231 - DNA, 579 bp, Homo sapiens
  misc_feature: GYAE6OF02GKUHI.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattcacgtttacctctatagtatcaacgtgggtgcgccaggccgcgtggacacgacctgagtggatggggatcgggccgaaccctaagacgtggtgtaccacgtagtcgtcttacaccctagtcccgtacgggacacgacctttacccatacgacccacgaacctccctaccaaactaaaccacacgccctaacagtacggtagttgaggacgccgtgacattccgtagaccgacgaccggtccgttacttagttactggtgacgagacgtcccacggacgtccgggtgacgaccgtacggcacggccggttccgtttgccgttcggtcggg

SEQ ID NO: 208232 - DNA, 532 bp, Homo sapiens
  misc_feature: GYAE6OF02GSEZF.17.25.C03.1.454.CMB.1.raw
  modified_base (290)..(290): a, c, t, g, unknown or other
  misc_feature (290)..(290): n is a, c, g, or t
  modified_base (400)..(400): a, c, t, g, unknown or other
  misc_feature (400)..(400): n is a, c, g, or t
  modified_base (523)..(523): a, c, t, g, unknown or other
  misc_feature (523)..(523): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccgggccnctggacaacgacctgagtggatgggatgggcgaaccctaacactggtgtcacagtgtcttcacccatcctccgggacagacttaccatcgaccacgactcctcataaacncagcctacatggagttgagagcctgacatctgacgacacggcctctacttactgtcgcgagacgtcccacgtacgtcccgggtagacgcccgtacggcaggccggtacctttggactttccgnggggtaccg

SEQ ID NO: 208233 - DNA, 625 bp, Homo sapiens
  misc_feature: GYAE6OF02HQSWJ.17.25.C03.1.454.CMB.1.raw
  modified_base (280)..(280): a, c, t, g, unknown or other
  misc_feature (280)..(280): n is a, c, g, or t
  modified_base (335)..(335): a, c, t, g, unknown or other
  misc_feature (335)..(335): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgcaggccgctggacaacgcctgagtggatgggatgggcgaaccctaacactggngtcacagtgtcttcacccatcctccgggacagacttaccatcgaccacgaacctcctacccaataaaccacacgcctacactggagttgaggagaccctgactactcgtacgaaccgacgaccgggtcccgtacttaacgttaccgtgtacggtaccgaggtaccgggttaccccaaccggtaacgttcccccggggttaggaaccggtacccccggttaacgggccgtaacgggtcccgggttacccccggtttttacgggtacccgttttccgggtacccgggggggg

SEQ ID NO: 208234 - DNA, 555 bp, Homo sapiens
  misc_feature: GYAE6OF02IYNYR.17.25.C03.1.454.CMB.1.raw
  modified_base (329)..(329): a, c, t, g, unknown or other
  misc_feature (329)..(329): n is a, c, g, or t
  modified_base (337)..(337): a, c, t, g, unknown or other
  misc_feature (337)..(337): n is a, c, g, or t
  modified_base (434)..(434): a, c, t, g, unknown or other
  misc_feature (434)..(434): n is a, c, g, or t
  modified_base (473)..(473): a, c, t, g, unknown or other
  misc_feature (473)..(473): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcaacctaanacgtggtntcacgagtgtccttcaccctatcctccgggacagacttaccatcgaaccacgaacctcctaccaataaacacacgcctacacgtaggagttgagganccgtagactatctaggaccacgaccgcttactattacgngtcgacgtagaccgtacccgacgcgttccggagacgtcccgtacggcgacggccgttacgtttcggaccgttcgtaccgggg

SEQ ID NO: 208235 - DNA, 560 bp, Homo sapiens
  misc_feature: GYAE6OF02JFMWU.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcaacctacactggtgtcacagtgtcttcaccctatcctcgggacagtacttaccatcgaccacgaacctcctacaataaacacagcctacatggagttgaggacgcctgacatcgtgaccgacaccggtcctctaacttactggtcgcgacgtcgtacccacggtacttccgggtagacgtacccgttacgggcctacgggtcccggtaccgttttacggaccgtttccggtaccggggg

SEQ ID NO: 208236 - DNA, 542 bp, Homo sapiens
  misc_feature: GYAE6OF02HIILA.17.25.C03.1.454.CMB.1.raw
  modified_base (409)..(409): a, c, t, g, unknown or other
  misc_feature (409)..(409): n is a, c, g, or t
  modified_base (432)..(432): a, c, t, g, unknown or other
  misc_feature (432)..(432): n is a, c, g, or t
  modified_base (442)..(442): a, c, t, g, unknown or other
  misc_feature (442)..(442): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggaccgaaaccctaacacgtggtgtccacagtgtccttccacccatccgtccgggacagacttaccatcgaccacgactcctacataaacncagcctaacatggagttgaggancctgacatcngacgacgacggccgtacttattactgtcgcgagacgtcccaggtactccggtgacgtaccgtacggcacggtccggtacctttggaccgttcggacgggg

SEQ ID NO: 208237 - DNA, 532 bp, Homo sapiens
  misc_feature: GYAE6OF02JJIHK.17.25.C03.1.454.CMB.1.raw
  modified_base (330)..(330): a, c, t, g, unknown or other
  misc_feature (330)..(330): n is a, c, g, or t
  modified_base (338)..(338): a, c, t, g, unknown or other
  misc_feature (338)..(338): n is a, c, g, or t
  modified_base (342)..(342): a, c, t, g, unknown or other
  misc_feature (342)..(342): n is a, c, g, or t
  modified_base (456)..(456): a, c, t, g, unknown or other
  misc_feature (456)..(456): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcaaccctanacgtggtntcanagtgtcttacacccatccgtccgggacagacttaccatcgaccacgaactcctaccaataaacacagacctacatggagttgacggagcctgacatctgacgacgacggccgtntattactgtacgcgagcgtcccaggtactccggagacgccgtacggcacggccggtcctttcggacttcgtcgggg

SEQ ID NO: 208238 - DNA, 656 bp, Homo sapiens
  misc_feature: GYAE6OF02JM2AS.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaacgtgggtgcgccaggccgcgtggacaacgacctggagtggagtgggatcggggaccgaacccgtaacgacgtgggtctacgacagttgtccttacgacccatcccgtccgggactacgtacttaccagtcgaccaacgtaacctccctaccaactaaaaccacacgaccctaacgacgtggtaacgttcggaaggacgtccgtagaacctagttcgtacggaaccgtaccgaccgggtcccgttacgttaacgtttaccgtaggttcgaccggtaagtacccgttaccccgaacggtacgtcccgggtacgaaccggtccccgttaacgggaccgtacgggtcccggttacccgttttacggtaccgtttcccggtacggggg

SEQ ID NO: 208239 - DNA, 534 bp, Homo sapiens
  misc_feature: GYAE6OF02GXK8U.17.25.C03.1.454.CMB.1.raw
  modified_base (332)..(332): a, c, t, g, unknown or other
  misc_feature (332)..(332): n is a, c, g, or t
  modified_base (448)..(448): a, c, t, g, unknown or other
  misc_feature (448)..(448): n is a, c, g, or t
  modified_base (510)..(510): a, c, t, g, unknown or other
  misc_feature (510)..(510): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggacgaaccctaanacgtggtgtcacagtgtcttcacccatccgtccgggacaggacttaccatacgacccaacgaacctccctaccaataaaccacacgacctacatggagttgaggagcctgacatcngacgacacggcgtctattctgtgcgagtacgtcccacgacgtccggtgacgtccgtacggcnggccgtcctttgccgttgtcgggg

SEQ ID NO: 208240 - DNA, 572 bp, Homo sapiens
  misc_feature: GYAE6OF02F38G6.17.25.C03.1.454.CMB.1.raw
  modified_base (341)..(341): a, c, t, g, unknown or other
  misc_feature (341)..(341): n is a, c, g, or t
  modified_base (443)..(443): a, c, t, g, unknown or other
  misc_feature (443)..(443): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattcacgtttacctctatagtatcaactgggtgcgccaggccgcgtggacaacgacctgagtggatgggatgtgacgaaccctaacacgtggtntcacagttcgtcttccacccatcccgtccgggacacgtacttaccatcgaccacgaacctcctaccaataaaccacacgacctacagtaggattagaggacnccgtagactactcgtacggaccgtacgaccggtccgttataacttacgtgtacgcgagtaccgtacccaggtacttccgggtagaccgtcccgtaacgggcaaggcccggtactttgaccgtttccggg

SEQ ID NO: 208241 - DNA, 540 bp, Homo sapiens
  misc_feature: GYAE6OF02GDDSA.17.25.C03.1.454.CMB.1.raw
  modified_base (466)..(466): a, c, t, g, unknown or other
  misc_feature (466)..(466): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaacctcctccataaaccacacgcctacagtggagttgaggagcctagaccatctgaccgacaccggccgttctatttctgtnaccgagacgtcccacggtacgtcccggtagaccgccgtacggcacggccggtcctttggaccgttgtaccgggg

SEQ ID NO: 208242 - DNA, 548 bp, Homo sapiens
  misc_feature: GYAE6OF02GR0HS.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctgggacaacgacctgagtggatggggatgggcgaaccctaacactggtgtcacagtcgtcttcacccatcctccgggacagacttaccatcgaccacgaactcctaccaataaaccacacgcctacatggagttgaggacgcctgacatctagacgacgacgggcctctattactgtcgcgagtacgtcccgacggtacgtccgggtgaccgtccgtaacggcacggccggtccgttttggtaccgttcgtcggggg

SEQ ID NO: 208243 - DNA, 540 bp, Homo sapiens
  misc_feature: GYAE6OF02IZBBE.17.25.C03.1.454.CMB.1.raw
  modified_base (411)..(411): a, c, t, g, unknown or other
  misc_feature (411)..(411): n is a, c, g, or t
  modified_base (433)..(433): a, c, t, g, unknown or other
  misc_feature (433)..(433): n is a, c, g, or t
  modified_base (440)..(440): a, c, t, g, unknown or other
  misc_feature (440)..(440): n is a, c, g, or t
  modified_base (444)..(444): a, c, t, g, unknown or other
  misc_feature (444)..(444): n is a, c, g, or t
  modified_base (452)..(452): a, c, t, g, unknown or other
  misc_feature (452)..(452): n is a, c, g, or t
  modified_base (467)..(467): a, c, t, g, unknown or other
  misc_feature (467)..(467): n is a, c, g, or t
  modified_base (495)..(495): a, c, t, g, unknown or other
  misc_feature (495)..(495): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaacgtgggtgcgccaggccgctggacaacgacctggagtggatgggagtggggacgaaccctaacacgtggtgtcacagttgtcttcaccctatccgtcgggacagaccttaccatcgaccacgaactcctacataaacncagcctacatggagttgaggancctgacntcgngaccgacncggcctatattacgngtgcgagtacgtacccagtcgtaccggngaacgtcccgtaggccacggccggtcctttggaccgttgtcgggg

SEQ ID NO: 208244 - DNA, 541 bp, Homo sapiens
  misc_feature: GYAE6OF02GXW34.17.25.C03.1.454.CMB.1.raw
  modified_base (359)..(359): a, c, t, g, unknown or other
  misc_feature (359)..(359): n is a, c, g, or t
  modified_base (407)..(407): a, c, t, g, unknown or other
  misc_feature (407)..(407): n is a, c, g, or t
  modified_base (429)..(429): a, c, t, g, unknown or other
  misc_feature (429)..(429): n is a, c, g, or t
  modified_base (436)..(436): a, c, t, g, unknown or other
  misc_feature (436)..(436): n is a, c, g, or t
  modified_base (470)..(470): a, c, t, g, unknown or other
  misc_feature (470)..(470): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaagggcttctggattcacgtttacctcctatagtatcaactgggtgcgccaggccgctggacaacgacctgagtggatgggatggggcgaaccctaacactggtgtcacagtgtcttcaccctntccgtccgggacagacttaccatcgaccacgaacctctaccataaacncagcctacatggagttgaggancctgacntctgacacgacggcctactacttacgtgtgacgngtacgtcccagtcgtaccggtgacgtcccgtaggccgacggccggttcctttaggaccttcggtacggggg

SEQ ID NO: 208245 - DNA, 517 bp, Homo sapiens
  misc_feature: GYAE6OF02GIR97.17.25.C03.1.454.CMB.1.raw
  modified_base (331)..(331): a, c, t, g, unknown or other
  misc_feature (331)..(331): n is a, c, g, or t
  modified_base (432)..(432): a, c, t, g, unknown or other
  misc_feature (432)..(432): n is a, c, g, or t
  modified_base (435)..(435): a, c, t, g, unknown or other
  misc_feature (435)..(435): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaanactggtgtcacagtgtcttcacccatcctccgggacacgacttacatcgaccacgaactcctccaataaacacacgcctacatggagttgagagcctgacntcngacgagtacggcctctatctgtcgcgagacgtcccagctccggtgacgcctacggcaggccgtctttgaccttcgtacgggg

SEQ ID NO: 208246 - DNA, 584 bp, Homo sapiens
  misc_feature: GYAE6OF02IQFOQ.17.25.C03.1.454.CMB.1.raw
  modified_base (332)..(332): a, c, t, g, unknown or other
  misc_feature (332)..(332): n is a, c, g, or t
  modified_base (476)..(476): a, c, t, g, unknown or other
  misc_feature (476)..(476): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatggggcaaccctaanactggtgtcacagtgtcttcacccatccctccgggacagacttaccatcgaccacgaacctccctaccaataaaccacacgcctaacagtggagttgaggacgcctagacatctagacgacgaccggtccgtacttaattacgngtcgacgtaagacgtaccccgacggacgttcccgggtagaaccggtaccccgttagggccaacgggtcccggtacccgtttttacggacccgtttcggtaccgggggg

SEQ ID NO: 208247 - DNA, 546 bp, Homo sapiens
  misc_feature: GYAE6OF02G1MNG.17.25.C03.1.454.CMB.1.raw
  modified_base (329)..(329): a, c, t, g, unknown or other
  misc_feature (329)..(329): n is a, c, g, or t
  modified_base (336)..(336): a, c, t, g, unknown or other
  misc_feature (336)..(336): n is a, c, g, or t
  modified_base (340)..(340): a, c, t, g, unknown or other
  misc_feature (340)..(340): n is a, c, g, or t
  modified_base (344)..(344): a, c, t, g, unknown or other
  misc_feature (344)..(344): n is a, c, g, or t
  modified_base (430)..(430): a, c, t, g, unknown or other
  misc_feature (430)..(430): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcaaccctanactggtntcanagtntcttcacccatccgtccgggacagtacttaccatcgaccacgaacctcctaccaataaacacagccctaacatggagttgaggacncctgactatctggacgacgaccggtccgttactattacgtgtgcgagtacgtcccgaacgtcgttccggtgacgcccgtacggcacggccggtccttttggaccgttgtccggggg

SEQ ID NO: 208248 - DNA, 529 bp, Homo sapiens
  misc_feature: GYAE6OF02FN3JR.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatccctccgggacagaccttaccatcgaccacgaactcctaccaataaacacagcctaacatgggagttgaggacgcctgacatctgacgacacggccgtactattactgtgcgagcgtcccaggactccggtgacgtcctacggcaggccggtcctttggaccttgtacgggg

SEQ ID NO: 208249 - DNA, 617 bp, Homo sapiens
  misc_feature: GYAE6OF02GBJCV.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgcctgagtggatgggatgggaccgaaccctaacacgtggtcgtcactagtgtcttcacccatcctcgggacagacttgccatcgacccacgaacctcctaccaataaaccacacgccctaacagtggagttgacggacgccgtgacctagtcgtaggaccgaccgaccgggtcccgttacttaacttacgtggtacgaccggtacgtaccggtacccccgaacggtaaccgttcccggggtagaacccggtccccgttaaccggggcctaacggggtccccgggtttacccgtttttacgggacccgttttcccgggg

SEQ ID NO: 208250 - DNA, 546 bp, Homo sapiens
  misc_feature: GYAE6OF02I6Q2Z.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagaccttacatcgaccacgaactcctaccaataaacacagacctacactggagttgaggagcctgacatctgacgacacggcctctaattctgtgacgagacgtacccacggtactcccgggtagacggacccgttacgggcacggccggtacccttttggacccgtttcgtacggggg

SEQ ID NO: 208251 - DNA, 611 bp, Homo sapiens
  misc_feature: GYAE6OF02HPG0W.17.25.C03.1.454.CMB.1.raw
  modified_base (432)..(432): a, c, t, g, unknown or other
  misc_feature (432)..(432): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgcaggccgctggacaacgcctgagtggatgggatgggcgaaccctaacacgtggtgtcacagtgtcttcacccatcccgtcgggacacgacttaccatcgaccacgaacctcctaccaataaaccacacgcctacagtggagttgaggacncctagactatcgtaggaaccgacaccgggcccgttacttaatttaccgtgtacggcgtaacggaccgttcccccgaacggtaacgttccccggggtagtaacccgggtcccgttaaccggggcctaacgggacccgggtttccccgtttttaggaccccgttttcggtacccggggggg

SEQ ID NO: 208252 - DNA, 651 bp, Homo sapiens
  misc_feature: GYAE6OF02H7WOG.17.25.C03.1.454.CMB.1.raw
tcagcgtagactagcacgaccggtgctcgatttagtagtgtagatttgggtttggggactcaacaaccacatctgtcctctagaagaaaaccctgtgagcacagctcctcaccatggactggacctggaggatcctcttcttggtggcagcagctacaagtcgcccactcccaggtgcagctggtgcagtcgtggggctggaggtgaagaagccgtgggcctcgagtgaaggtcctcctgacaaggcttctggattctaccgtttacctcctatagtatctaacgtgggtgccgccgacggccgcgtaggaaccaacgacctggagtggagtgggagtggggaccaaaccctaacgcgtggtctacacgtagtgtcttaccaccctactcccgtacccgggacacgtaccttaccagtcgacccacgtaacctccctactaaactaaaccacacgtacctaacagtaggtagtggacgacgtcctagactacgttcgtacgaaccggacaaccggtcccgttactttaacttaccgtggtaccgacgtacggtacgtaccccgtaaggtccgttacccggggtagaccgtacccggtaaccggcgaccgggtcccggtcccgttttaggtacccgttgggtaccccggggg

SEQ ID NO: 208253 - DNA, 517 bp, Homo sapiens
  misc_feature: GYAE6OF02GMH7N.17.25.C03.1.454.CMB.1.raw
  modified_base (333)..(333): a, c, t, g, unknown or other
  misc_feature (333)..(333): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatggggcgaaccctaanactggtgtcacagtgtcttcacccatcctccgggacagacttaccatgaccacgaactcctccataaacacagcctacatggagttgaggagcctgacatctgacgacgacggccgtctaattacgtgtgcgagacgtcccagctccggtgacgcctaggcaggccgtctttgacttgtcgggg

SEQ ID NO: 208254 - DNA, 558 bp, Homo sapiens
  misc_feature: GYAE6OF02JHGXS.17.25.C03.1.454.CMB.1.raw
  modified_base (344)..(344): a, c, t, g, unknown or other
  misc_feature (344)..(344): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggcgaaccctaacactggtgtcacngtgtcttcacccatcctccgggacaggacttaccatcgaccacgaactcctaccaataaaccacacgacctacagtaggaagttggaggacgcctagacatctggaaccgacacggcccgttactattaccgtagtcgacgagacgttacccgacgtacgtccgggtagacgtccgtacggcacggccggtcctttacggacttcgtaccgggg

SEQ ID NO: 208255 - DNA, 599 bp, Homo sapiens
  misc_feature: GYAE6OF02HO0BA.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatccctccctgtctgcctctggtgggggtcagagtcaccatcacttgccggacaagtcacggacgttaaaacctatttaaattggtatcagcagaaacctggaaaacgccccagaccctcctagactctctggtgcactccactctgacgaagtcggccgtcccagtcgaggttcaggtggcaggtggatcgtagggactagtatttacaattcctacaccatccaacctactctcgactaaaccgtcggaagtacttgtacgactaacttcttaacctactacgtacaaacgtacgtaacgtttacctaccgttcccctacgtcctttaccggtttcggacccggtacggggtaacctaaggtttcggaactaacgtaaccgaaacgtacgttggtagtcctcggacctacctacgtcttgttaccc

SEQ ID NO: 208256 - DNA, 851 bp, Homo sapiens
  misc_feature: GYAE6OF02HD8UP.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaaatgggtgcgccaggccgctggacaacgacctggacgtggagtggggatggggaccgtaacccctaacgaccgtgggtacgtaccaacgtaggttcgttcctttaccgaacccctaacgtttccccgtacccgggggaacctaaacggtaaccctttaacccgaagtttacggaacccctaacggtaaaaccccttcccttaaccccaaagttaaaaacccaaccgtaaccgggtacccctttaaaccgaacgtttacggggtaaacggttttacgggaaacgggtaaccggttacccttagggtaaccctaaacgttacccgttacgggaaacccggtaccccggtaaaccgggggttcccccggtttaacgtttaaacccgttttaaaccggtacggtttaaccgggacccgggttaaaccggggtaacggtttaccccccgaaaccgggttaaccggtttaccccgggggttaacggtaaaccgggtccccccgtttaaacgggggccccgtaacggggtaccccggggttaccccttttttagggaccccgtttttacccgggacccgggggggg

SEQ ID NO: 208257 - DNA, 672 bp, Homo sapiens
  misc_feature: GYAE6OF02H16IJ.17.25.C03.1.454.CMB.1.raw
tcagcgtagactagcacgaccggtgctcgatttagtagtgtagatttgggtttgggggacgtcaacaaccacatctgtcctctagagaaaaccctagtgagcacagctcctcaccatggacgtggacctggaggatcctcttcttggtggcagcagctacaagtgcccactcccaggtgcagctggtgcagtcgtggggctggaggtgaagaagccgtggggctcagtgaaggtctcctgcgaaggtcttcgtggtattctacgtttacctctatagtactcaacgtgggtgcgcacggccgctaggaccaacgtcctgaggtggagtggggatcggggaccgaaacccctaacgacgtgggtacgtaccacgtagtcgtccttaccacccgtagtcccgtccggggaactacggtaacctttacccgagtccgtaacccaacgtaacccttacccgtaccaaactaaaacccgacgacgtaccctaacagttacgggagtttaggaacggtacgacccttagactacttcgtaacggaccgtaccgaccggttccgttacttattacggtgtacggacgtacgaccgttaccccgaggtacgtcccgggttagaccggttaccctagggccgtacggtccggttcccttttaggcccgttcgggtacgggg

SEQ ID NO: 208258 - DNA, 627 bp, Homo sapiens
  misc_feature: GYAE6OF02FENOX.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtcggatgggactaggggccgaaccctaagtacgtggtgtcacagtgtcgttcacccatccgtccgggacacgtacttaccgatcgaccacgaactcctacaaataaaccacacgtacccttaagacttgggtagttgaacgggtactccgtagaaccagttcgtacgaaccggaccgtaacggggcccttattaacttaccgtggtacgaccggtaaggtacgtaccccacgggttaaccgtccggggtacgaaccggtacccgtacgggcctaacgggtcccgggttcctttttacgggacccgtttcggaccgggggg

SEQ ID NO: 208259 - DNA, 564 bp, Homo sapiens
  misc_feature: GYAE6OF02F49QW.17.25.C03.1.454.CMB.1.raw
  modified_base (246)..(246): a, c, t, g, unknown or other
  misc_feature (246)..(246): n is a, c, g, or t
  modified_base (364)..(364): a, c, t, g, unknown or other
  misc_feature (364)..(364): n is a, c, g, or t
tcagcgtagactagcacgaccggtgctcgatttagtagtgtagatttgggtttgggggacgtcaacaaccacatctgtcctactagacgaaaaccctgtgagcacagctcctcaccatggactggacctggaggattcctcttcttggtggcagcagctacaagtgcccactcccaggtgcagctggtgcagtcgtggggctgaggtgaagagcctggggcctcagtgaggtctctgcaggcttcnggattcacgtttacctctatagtatcaacgtgggtgcgccaggcccgcgtggacaacgccgtgagtggatgggatgggacaacctacacgtggtgtcacagtgtcttacaccactccnccgggacacgaccttaccatacgaccacgaactcctacataaacacacgacctacactaggtacgttagacggtagcctagacctattcgtagacgacgacgtccgtacttattactgtacgacgagtacgtacccgacgtacgtccggtcgacgtccgtacggcgtacggtcggtcccgtttcgtaccgttcgtccggg

SEQ ID NO: 208260 - DNA, 565 bp, Homo sapiens
  misc_feature: GYAE6OF02H7BZ3.17.25.C03.1.454.CMB.1.raw
  modified_base (330)..(330): a, c, t, g, unknown or other
  misc_feature (330)..(330): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggcaacctaanactggtgtcacagtgtcttcacccatccgtccggacagaccttaccatcgaccacgaactcctccataaacacagcctacatgagttgagagcctagacatctagaccacgacggccgttactacgtttaacctgtagtacgaggtacgtccccgaagtaaccgtccgggtacgacgacccgttacgggcgtaacggccggttcccgttttacggtaccgtttcggtaccggggg

SEQ ID NO: 208261 - DNA, 530 bp, Homo sapiens
  misc_feature: GYAE6OF02FSFT5.17.25.C03.1.454.CMB.1.raw
  modified_base (280)..(280): a, c, t, g, unknown or other
  misc_feature (280)..(280): n is a, c, g, or t
  modified_base (331)..(331): a, c, t, g, unknown or other
  misc_feature (331)..(331): n is a, c, g, or t
  modified_base (428)..(428): a, c, t, g, unknown or other
  misc_feature (428)..(428): n is a, c, g, or t
  modified_base (460)..(460): a, c, t, g, unknown or other
  misc_feature (460)..(460): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggcgaaccctaanacgtggtgtcacagtgtcttcacccatccgtcgggacagacttaccatcgaccacgaactcctacataaacacacgcctacatggtagttgaggacncctgactatctgacgacacggcctctattacngtgcgagcgtcccacgtctccggtgacgcccgtacggcacggccggtccttttggaccttcgtacggggg

SEQ ID NO: 208262 - DNA, 379 bp, Homo sapiens
  misc_feature: GYAE6OF02IUCH6.17.25.C03.1.454.CMB.1.raw
  modified_base (244)..(244): a, c, t, g, unknown or other
  misc_feature (244)..(244): n is a, c, g, or t
  modified_base (335)..(379): a, c, t, g, unknown or other
  misc_feature (335)..(379): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgcaaggcttntggattcacgtttacctcctatagtatcaacgtggtgcgccaggccgcgtggaaccaacgacctggacgcggctgggcaggcgacatacgnnnnnnnnnnnnnnnnnnnnnnnnnnnnnnnnnnnnnnnnnnnnn

SEQ ID NO: 208263 - DNA, 557 bp, Homo sapiens
  misc_feature: GYAE6OF02HBPR4.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctaatagtatcaactgggtgcgccaggccgctggacaacgacctggagtggatgggatggggcgaaccctaacactggtgtcacgagtgtcttcacccagtcctccgggacagaccttaccatcgacccacgaacctccctaccaataaaccacacgaccctacacgtggagtttggaggtacgcctaggacctatcgtagaccgacaccgggccgttcttattacgtgtgcgagcgtcccacggtctccggtgtacggccctacggcacggtccgtcctttacgcgttcgtcgggg

SEQ ID NO: 208264 - DNA, 524 bp, Homo sapiens
  misc_feature: GYAE6OF02I9SBH.17.25.C03.1.454.CMB.1.raw
  modified_base (481)..(481): a, c, t, g, unknown or other
  misc_feature (481)..(481): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggccgaaccctaacacgtggtgtcacagtgtccttcacccagtcctcggggacagacttaccatgaccacgaactcctcataaacacagcctacatggagttgagcgcctgacatctgacgacacggccgtctattactgtgcgagcgtaccaggcttccggngtacgccgtacggccaggcccgtctttagaccgttcgtcgggg

SEQ ID NO: 208265 - DNA, 521 bp, Homo sapiens
  misc_feature: GYAE6OF02FGFQR.17.25.C03.1.454.CMB.1.raw
  modified_base (280)..(280): a, c, t, g, unknown or other
  misc_feature (280)..(280): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgcctgagtggatggggatggggcgaaccctaacactggtgtcacagtgtcttcacccatcctccgggacagacttaccatgaccacgaactcctcataaacacagcctacatggagttgaggagcctgacatctgacgacacggccgtctattactgtgcgagacgtcccacgactccggtgacgcctacggcacggccggcctttgacctttgtaccgggg

SEQ ID NO: 208266 - DNA, 765 bp, Homo sapiens
  misc_feature: GYAE6OF02H7P0H.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtagaaggaacgccggtcgggcctcgtaggtaggtaacggtcctccgtgacgaacggtccttcgtaggtactttccgtaaccgttttacctaccttaagtaagttactaccgaacgttggggtcgccgccggacggccgtcgtacggaaccaaccggaccgtggtaggtacggaggtaggggacggtacggggaacccgtaaacccgtaacgtacggtaggttcgtaccgacgttaggtttcgttaccttacccgaacccgtacgtccccggtaccgggaactacgttacccttaccagtacccgaacccaacgtaacccttcccctaaaccaaactaaaacccacgtaactacccctaactaggtacgggtaacgttaggaacgggtactccgtagaactaaccgttcgaaccgaaccggaccgtacccgggttccgttactttaacgttcgtggaccgtacgtaacgacccgtacccgacggtcgttccgggagacccggttaccgtaccgggcgtaccgggtcccggtttaccctttggttaccccgttgggtacccgggg

SEQ ID NO: 208267 - DNA, 633 bp, Homo sapiens
  misc_feature: GYAE6OF02GTCQH.17.25.C03.1.454.CMB.1.raw
  modified_base (279)..(279): a, c, t, g, unknown or other
  misc_feature (279)..(279): n is a, c, g, or t
  modified_base (330)..(330): a, c, t, g, unknown or other
  misc_feature (330)..(330): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtncgccaggccgctggacaacgacctgagtggatgggatgggctaaccctaanacgtggtcgtcacgagttgtcttaccaccctattcccgtaccggggactacgaccttaccgatacgacccacgaaccttccctaccaataaaccacacgacctaacagtgggaagttgaggtacgcctagactattcgtaggaaccgaacgaccggtcccgttacttacttaacgtggtcgaccggacggtacgttaccccgaacggtaaccggttcccgggtaacggaccgtacccggttaaccgggacgtaacgggtccccgggttaccctttttcgggacccgttttcgggtaccggggg

SEQ ID NO: 208268 - DNA, 540 bp, Homo sapiens
  misc_feature: GYAE6OF02GL4ZN.17.25.C03.1.454.CMB.1.raw
  modified_base (274)..(274): a, c, t, g, unknown or other
  misc_feature (274)..(274): n is a, c, g, or t
  modified_base (298)..(298): a, c, t, g, unknown or other
  misc_feature (298)..(298): n is a, c, g, or t
  modified_base (417)..(417): a, c, t, g, unknown or other
  misc_feature (417)..(417): n is a, c, g, or t
  modified_base (534)..(534): a, c, t, g, unknown or other
  misc_feature (534)..(534): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtggggtcagagtcaccatcacttgccggacaagtcacggacgttaaaacctatttaaattggtatcagcagaaacctggaaaacnccccagacctcctgatctctggtncatccactctgcgaagtggcctccatcgaggttcagtgcagtggatcgtgggacagtatttcaatctacacactccaccactctagcctaactgagtattgtgtacaattctactactntacaacagtacgttactacgttccctacgtacttacgtttcggaccgtaacggggacctaagttgagtaactacgaaacgtaacgttcgtaggacctcggaccaaccgtattccgtnttaccg

SEQ ID NO: 208269 - DNA, 681 bp, Homo sapiens
  misc_feature: GYAE6OF02J0RBG.17.25.C03.1.454.CMB.1.raw
  modified_base (238)..(238): a, c, t, g, unknown or other
  misc_feature (238)..(238): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagcctgggcctcagtgaggtctctgcaggctntgattcacgtttacctctatagtatcaacgtgggtgccgccaggcccgtcgtcgggaaccaaccggacctggaggtaggtagtggggagtcggggacctaaaccccgtaactaccgtgggtacgtcacgtagtcgttacttaccacccactcccgtaccgggactacggtaccttaccagttacgaccctacgaaccctcccgtaaccaacgtaaaccaccgaacgcccttaaacgagttacggggagttacggagggtactacccgttagacctacgttccgtacggaacccggaacgacccggttcccgttactttaacgttacgtcggtacgtaccgtaacgacggtaccccctagggtaccttcccggggtagaaccggtccccggtaaggccgtacgggcccggtttaccggttttacggaccgtttccgggaccggg

SEQ ID NO: 208270 - DNA, 536 bp, Homo sapiens
  misc_feature: GYAE6OF02JG9OE.17.25.C03.1.454.CMB.1.raw
  modified_base (244)..(244): a, c, t, g, unknown or other
  misc_feature (244)..(244): n is a, c, g, or t
  modified_base (260)..(260): a, c, t, g, unknown or other
  misc_feature (260)..(260): n is a, c, g, or t
  modified_base (280)..(280): a, c, t, g, unknown or other
  misc_feature (280)..(280): n is a, c, g, or t
  modified_base (367)..(367): a, c, t, g, unknown or other
  misc_feature (367)..(367): n is a, c, g, or t
  modified_base (435)..(435): a, c, t, g, unknown or other
  misc_feature (435)..(435): n is a, c, g, or t
  modified_base (470)..(470): a, c, t, g, unknown or other
  misc_feature (470)..(470): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcnggattcacgtttaccncctatagtatcaactgggtncgccaggccgcgtggacaacgacctgagtggatgggagtcgggacaacctacacgtggtgtcacagtgtctcaccatccgtcggganacgtactacagtcgaaccacgaactccaccaataaaccacacgtcctacgagtggagttagacggacncctagactatcgtagacgacgacgcctactattcngtagcgagacgtcccagcgtccggtagaccgccgtacggcacggccgttcttgtacgttcgtcggg

SEQ ID NO: 208271 - DNA, 686 bp, Homo sapiens
  misc_feature: GYAE6OF02I7ZMJ.17.25.C03.1.454.CMB.1.raw
  modified_base (552)..(552): a, c, t, g, unknown or other
  misc_feature (552)..(552): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcaccgtttacctcctatagtatcaacgttgggtgcgccagggccgcgtggaccaacgacctggagtggagtgggatggggaccgaaaccctaagacgtggtctcacagtgtcttccacccattcccgtaccgggacacgtaccttaccgactacgaacctaaccgtaacctccctaacccgaaactaaaaccaccgaacgtaccctaacaacgtgggtaacgttacggaacggacgcccgttagaacctacgttctacggaaccggtaacccgacgggtcccgttacttaaacgttttaccgngggttaccgaccgggaagttacccggacccctacgggtaaccgttacccggttaggaacccggtacccgtaacccggggacgttaccggcccggtttacccggtttacggttacccgttcggttacccgggggg

SEQ ID NO: 208272 - DNA, 552 bp, Homo sapiens
  misc_feature: GYAE6OF02IORUX.17.25.C03.1.454.CMB.1.raw
  modified_base (298)..(298): a, c, t, g, unknown or other
  misc_feature (298)..(298): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgactgtctcctgcaaggccagtggatatatcttcaacaaaatatggtatgaattgggtgcgacaggcccccgganaagggcttggaggtgggtggggtgggtcaggcggtctttggacggtaaggcagagtatgacacgaagatggaagggcagagtcaacgactaccgacggaccaacccccgaagaaccacgaacgtctaacatcgacaaacgtcgaaccgagcctaggacgagcgtagacgacgaccggtccgtacttaacgttacgtgtgacgagtaacttgttttctgtctagttcgtaactatttgataggtctcgtagtcgg

SEQ ID NO: 208273 - DNA, 559 bp, Homo sapiens
  misc_feature: GYAE6OF02G99I6.17.25.C03.1.454.CMB.1.raw
  modified_base (343)..(343): a, c, t, g, unknown or other
  misc_feature (343)..(343): n is a, c, g, or t
  modified_base (346)..(346): a, c, t, g, unknown or other
  misc_feature (346)..(346): n is a, c, g, or t
  modified_base (357)..(357): a, c, t, g, unknown or other
  misc_feature (357)..(357): n is a, c, g, or t
  modified_base (430)..(430): a, c, t, g, unknown or other
  misc_feature (430)..(430): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcgagtgaaggtctcctgcaaggcttctggattcacgtttacctcctatagtatcaactgggtgcgccaggccgctggacaacgacctgagtggatgggatgggcgaacctacgacgtggtgtcangtntcttccacccntccgtccggacacgacttaccatcgaccacgacctcctaccaataaacacagcctacagtggagttgaggacncctgacagtctagaccacgacggtcctattacttacgtgtcgcgaagtccgtacccacggtcttcccggtagacggtacccgtacggccgacgggtccgttcccgtttggtaccgttcggtaccggggg

SEQ ID NO: 208274 - DNA, 642 bp, Homo sapiens
  misc_feature: GYAE6OF02JRJQX.17.25.C03.1.454.CMB.1.raw
  modified_base (245)..(245): a, c, t, g, unknown or other
  misc_feature (245)..(245): n is a, c, g, or t
  modified_base (290)..(290): a, c, t, g, unknown or other
  misc_feature (290)..(290): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagccgtggggcctcagtgaaggtctcctgcaaggcttcnggattcacgtttacctctatagtatcaactgggtgcgccaggccncgtggaccaacgacctgagtggatgggatcgggacaaccctacgacgtggtgtcacgtagtgtaccttaccaccctatcccgtcgggaacacgtaccttaccagtacgaaccctaacgaaccttcccgtaccaaaacttaaaccgaccgtaacgacccttaagaacgttcgggtaaagttcggaagggtacgcccttagaacctacgttcgtacgaaccgtaccgaccgggtaccttacgttaatttaccggtgtacgacgtaacgaccgttcccaaggtccgttccgggagaaccgcccgttaacggcgacggtcccggttaaccttttcgggaccgtttcggcccggggg

SEQ ID NO: 208275 - DNA, 514 bp, Homo sapiens
  misc_feature: GYAE6OF02HFXDL.17.25.C03.1.454.CMB.1.raw
  modified_base (471)..(471): a, c, t, g, unknown or other
  misc_feature (471)..(471): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctcgggacagacttaccatgaccacgactcctccataaacacagcctacatggagttgagagcctgacatctgacgacacggccgtctattactgtcgcgagacgtcccacgntccggtgagcctaggcacggccgtcctttgacgttcgtcgggg

SEQ ID NO: 208276 - DNA, 524 bp, Homo sapiens
  misc_feature: GYAE6OF02IIZGJ.17.25.C03.1.454.CMB.1.raw
  modified_base (333)..(333): a, c, t, g, unknown or other
  misc_feature (333)..(333): n is a, c, g, or t
  modified_base (409)..(409): a, c, t, g, unknown or other
  misc_feature (409)..(409): n is a, c, g, or t
  modified_base (417)..(417): a, c, t, g, unknown or other
  misc_feature (417)..(417): n is a, c, g, or t
  modified_base (488)..(488): a, c, t, g, unknown or other
  misc_feature (488)..(488): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggacgaaccctaanacgtggtgtcacagtgtcttcaccctatccgtcgggacagtacttaccatcgaccacgaacctcctacaataaacncagcctanatggagttgaggagcctgacatctgacgacacggcctactattactgtgcgagacgtcccagtctccggtnacgcctacggcacgccggtctttgaccttcgcgggg

SEQ ID NO: 208277 - DNA, 542 bp, Homo sapiens
  misc_feature: GYAE6OF02I2HZ4.17.25.C03.1.454.CMB.1.raw
  modified_base (279)..(279): a, c, t, g, unknown or other
  misc_feature (279)..(279): n is a, c, g, or t
  modified_base (453)..(453): a, c, t, g, unknown or other
  misc_feature (453)..(453): n is a, c, g, or t
  modified_base (460)..(460): a, c, t, g, unknown or other
  misc_feature (460)..(460): n is a, c, g, or t
  modified_base (484)..(484): a, c, t, g, unknown or other
  misc_feature (484)..(484): n is a, c, g, or t
  modified_base (493)..(493): a, c, t, g, unknown or other
  misc_feature (493)..(493): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtncgccaggccgctggacaacgacctgagtggatgggatgggcgaaccctaacacgtggtgtcacagtgtcttcacccatccctcgggacagaccttaccatgaccacgaacctcctccaataacacagacctacatggagtttgaggagcctgacatctgacgacacggccgttntattacngttagcgagtacgtccccacggtntcccgggtnaccggccctacgggcacgggccggtcctttggacctttcggtacggggg

SEQ ID NO: 208278 - DNA, 542 bp, Homo sapiens
  misc_feature: GYAE6OF02HOI6K.17.25.C03.1.454.CMB.1.raw
  modified_base (439)..(439): a, c, t, g, unknown or other
  misc_feature (439)..(439): n is a, c, g, or t
  modified_base (457)..(457): a, c, t, g, unknown or other
  misc_feature (457)..(457): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggacgaaccctaacactggtgtcacagtgtcttcacccatcccgtcgggacagacttaccatcgaccacgaactcctacaataaacacagcctacatggagttgaggacgcctgacattcngaccgacgaccggccgtnttattacgtgtgcgagacgtcccaacgtcgtccggtgacgtccgtacgggcacggccggtccttttacggaccgttcggtcgggg

SEQ ID NO: 208279 - DNA, 602 bp, Homo sapiens
  misc_feature: GYAE6OF02JJALW.17.25.C03.1.454.CMB.1.raw
  modified_base (367)..(367): a, c, t, g, unknown or other
  misc_feature (367)..(367): n is a, c, g, or t
tcagcgtagactagcacgaccggtgctcgatttagtagtgtagatttgggtttgggggagtcagtctcagtcaggacacagcatggacatgagggtcccgctcagctcctggggctcctgctactctggctccgagctgccagatgtgacatccagatgacccagtctccatccctcctgtctgcctctgtgggggtcagagtcaccatcacttgccggacaagtcacggacgttaaaacctatttaaattggtatcagcaagtaaacctaggaaaacgaccccagacctcctcgaatctctggtcgacatccactctgacgaagtcggctcccatcgagttcagtgcagtggatcgtgggacagtnttcaagtctcaccactcacctctactcgacaactcggaacgtagtcgtgactaatccttaactactacgttacaaagtacggtatttaccacgttccccgtcgtacccgttaacgttttacggacccgtaacggggtaaccttaaacggttggtaacgtaaccgtaacgtaaaccggttaaactacggttacggacggttacgtacccgtaacctaccgtttacgtccgtttacc

SEQ ID NO: 208280 - DNA, 599 bp, Homo sapiens
  misc_feature: GYAE6OF02FZEJR.17.25.C03.1.454.CMB.1.raw
  modified_base (394)..(394): a, c, t, g, unknown or other
  misc_feature (394)..(394): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaacctatttaaattggtatcagcaagaaacctaggaaaacgccccacgacctcctgactctcgtggtgcatccactctgcgaagtggccgtcctagtcggtacgttcgagtcggcaggtggtatcgtgggacagtatttcaatctacacactccaccnctctcgaccaacctgaggtattgtcgactaatccttaactactcgtacaaacagtaacgttacctaccgtttcccctacgtaccttaccgtttttcgggacccgtaaccgggggtaaccctaagggttttacggaacgtaacgtaaccgtaaaaccggtaaccgttggttacggctcggtacccaaccgtcttctcggtttaccc

SEQ ID NO: 208281 - DNA, 535 bp, Homo sapiens
  misc_feature: GYAE6OF02G023R.17.25.C03.1.454.CMB.1.raw
  modified_base (357)..(357): a, c, t, g, unknown or other
  misc_feature (357)..(357): n is a, c, g, or t
  modified_base (457)..(457): a, c, t, g, unknown or other
  misc_feature (457)..(457): n is a, c, g, or t
  modified_base (464)..(464): a, c, t, g, unknown or other
  misc_feature (464)..(464): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtgcgccaggccgctggacaacgcctgagtggatgggatggggcgaaccctaacacgtggtgtcacagtcgtcttcacccntccgtcgggacagacttaccatcgaccacgaacctcctaccaataaacacacgcctacatggaagttgaggacgcctgacatctgaccgacacggccttntattacnggtcgcgagacgtcccaggtctccggtgaccgtccgtacggcaggtccggtcctttggaccttcggcgggg

SEQ ID NO: 208282 - DNA, 507 bp, Homo sapiens
  misc_feature: GYAE6OF02IOHPY.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaaacctatttaaattggtatcagcagaaacctggaaaagccccagacctcctgatctctggtgcatccactctgcgaagtggcgtccatcgagttcagtgcagtggatctgggacagatttcaattctcaccatcaccactctgcaacctgagattgtgacaatctactactgtacaacagagttacacgttcccctcgcctacgttttggccgtacggggaacctaagttacgagatacaaacgaactgtaggtctgccaccatctgttcc

SEQ ID NO: 208283 - DNA, 525 bp, Homo sapiens
  misc_feature: GYAE6OF02JCELN.17.25.C03.1.454.CMB.1.raw
  modified_base (331)..(331): a, c, t, g, unknown or other
  misc_feature (331)..(331): n is a, c, g, or t
  modified_base (343)..(343): a, c, t, g, unknown or other
  misc_feature (343)..(343): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaanactggtgtcacngtgtcttcacccatcctcgggacagacttaccatcgaccacgaactcctcaataacacagcctacatggagttgaggacgcctgacatctagacgacacggccgttactattactgtgcgagcgtccgacgtctccggtgacgtccgtacggccaggccggtctttcgaccttgtaccgggg

SEQ ID NO: 208284 - DNA, 620 bp, Homo sapiens
  misc_feature: GYAE6OF02JDMD8.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggaccaacgacctggagtggatggggatgggaccgaaccctaacgacgttggtcgtcacgtagttgtccttcacccatcccgtccgggacacgacttacatcgaccacgactcccacaactaaacacacgcctaacagtggtagttggaacggacgtcctagaccatccgtaggaaccgtaccgaccgggtacccgttacttaacgttacgtggtacgacgtaagtaccgtaccccgaacggtaaccgttcccgggtagaaccggtacccgttaacgggcctacgggtccggttcccgttttaggtacccggtttcgggtaccggggg

SEQ ID NO: 208285 - DNA, 525 bp, Homo sapiens
  misc_feature: GYAE6OF02HGSQ2.17.25.C03.1.454.CMB.1.raw
  modified_base (280)..(280): a, c, t, g, unknown or other
  misc_feature (280)..(280): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatggggatgggcgaaccctaacactggtgtcacagtgtcttcacccatcctccgggacagacttaccatgaccacgactcctccataaacacagcctacatggagttgaggacgcctgacatctgacgacacggcctctattactgtcgcgagacgtacccagactccggtgacgtcctacggcacggtccggtcctttggaccttcgtacgggg

SEQ ID NO: 208286 - DNA, 541 bp, Homo sapiens
  misc_feature: GYAE6OF02G05IL.17.25.C03.1.454.CMB.1.raw
  modified_base (357)..(357): a, c, t, g, unknown or other
  misc_feature (357)..(357): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcctggggctgaggtgaagaagcctggggcctcagtgaaggtctcctgcaaggcttctggattcacgttttacctcctatagtatcaactgggtgcgccaggccgctggacaacgacctgagtggatgggatgggcaaccctaacactggtgtcacagtgtcttcacccntcctcgggacagacttaccatcgaccacgaactcctacaataaaccacacgaccctacagtggagttgaacggacgcctgactatctgaccgacacggtcctacttattactgtgacgagcgtcccacggtcgtccggtgacgcccgtacggcgacggtccggtcctttggacgtttcgcgggg

SEQ ID NO: 208287 - DNA, 557 bp, Homo sapiens
  misc_feature: GYAE6OF02GXPDY.17.25.C03.1.454.CMB.1.raw
  modified_base (446)..(446): a, c, t, g, unknown or other
  misc_feature (446)..(446): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgagagcctggggcctcagtgaaggtctcctgcaaggcttctggattcacgtttacctcctatagtatcaactgggtgcgccaggccgctggacaacgacctgagtggatggggatgggcgaaccctaacactgggtgtcacgagtcgttcttaccacccactcccgtaccggggacacgtaccttaccatacgacccacgaacctccctaccaataaaccacacgcctaacatggagttgaggancctagacatctgacgacgacggccgtacttacttactgtcgtcgacgacgtcccaaggctccggtgaccgccgtacggcacggtcggtacctttgaccgttcggtacgggg

SEQ ID NO: 208288 - DNA, 612 bp, Homo sapiens
  misc_feature: GYAE6OF02HI63O.17.25.C03.1.454.CMB.1.raw
  modified_base (280)..(280): a, c, t, g, unknown or other
  misc_feature (280)..(280): n is a, c, g, or t
  modified_base (411)..(411): a, c, t, g, unknown or other
  misc_feature (411)..(411): n is a, c, g, or t
  modified_base (439)..(439): a, c, t, g, unknown or other
  misc_feature (439)..(439): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctggagtggatggggatggggcgaaccctaacacgtggtgtcacagtgtcttcaccctatccgtccgggacagacttaccatcgaccacgtactccctacaataaaccncagacctacagtggtagttggaggtacnccgttagacctatcgtacggaaccgacgaccgggtcccgttacttacgttacgtgtcggacgtacggtaccgtaccccgacggtacggttcccgggtagaaccggtcccggttacgggcctacgggtcccgggttacccgttttacggtacccgtttccgggtacccgggggg

SEQ ID NO: 208289 - DNA, 535 bp, Homo sapiens
  misc_feature: GYAE6OF02IM0SI.17.25.C03.1.454.CMB.1.raw
  modified_base (463)..(463): a, c, t, g, unknown or other
  misc_feature (463)..(463): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctggagtggatgggatgggcgaaaccctaacactggtgtcacagtgtcttcacccatcctccgggacagacttaccatcgaccacgaacctcctaccaataaacacacgcctacagtggagttgaggagcctgacatctgacgacacggccgtctattacngtcgacgagacgtcccacgactccgggtagacgccgtacggccacggtccggtccgtttgaccttgtcgggg

SEQ ID NO: 208290 - DNA, 544 bp, Homo sapiens
  misc_feature: GYAE6OF02HV7GE.17.25.C03.1.454.CMB.1.raw
  modified_base (351)..(351): a, c, t, g, unknown or other
  misc_feature (351)..(351): n is a, c, g, or t
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaacctatttaaaattggtatcagcagaaacctggaaaacgccccagacctcctgatctctggtgcatccactctgcgaagtgcgtcccagtcgaggttcagtgcagtgatcgngggacagtattcaatctacacatcaccnctctncaacctgagtattgtgactatactactactgtaccaacgagtaacttaccgtaccgttacccctcgtaccttacgtttcggaccgacgggggtaacctaaggttgaacgtaactaccgtaaacgtaactcggtcggactgacctacgtatcctgttaccc

SEQ ID NO: 208291 - DNA, 607 bp, Homo sapiens
  misc_feature: GYAE6OF02JZUC5.17.25.C03.1.454.CMB.1.raw
  modified_base (251)..(251): a, c, t, g, unknown or other
  misc_feature (251)..(251): n is a, c, g, or t
  modified_base (294)..(294): a, c, t, g, unknown or other
  misc_feature (294)..(294): n is a, c, g, or t
  modified_base (319)..(319): a, c, t, g, unknown or other
  misc_feature (319)..(319): n is a, c, g, or t
  modified_base (419)..(419): a, c, t, g, unknown or other
  misc_feature (419)..(419): n is a, c, g, or t
  modified_base (434)..(434): a, c, t, g, unknown or other
  misc_feature (434)..(434): n is a, c, g, or t
  modified_base (455)..(455): a, c, t, g, unknown or other
  misc_feature (455)..(455): n is a, c, g, or t
  modified_base (543)..(543): a, c, t, g, unknown or other
  misc_feature (543)..(543): n is a, c, g, or t
tcagcgtagactagcacgaccggtgctcgatttagtagtgtagatttgggtttggggtacgtcaacaaccacatctgtcctctagagaaaaccctagtgagcacagctccctcaccatggactggacctggaggatcctcttcttggtggcagcagctacaagtgcccactcccaggtgcagctggtgcagtctggggctggaggtgaagagccgtggggcctcgagtgaaggtctcctgacaggcttcgnggattcacgtttacctctatagtatcacgtggtgcgcagccgntggacacgcctgagtggagtcgggngtacgggcgtaacccacgtacgtggtagcgactaggtgttaccttccaccctatccgaccgggacacggtaccttacatcgaccacgacctcctaccaanaaccagacgcctaanacgtcggaggttagacggacnccgtgaccagttcacgacgaccgtaccggccgtacgttaacttcgtaggcgtacgagtaccgtacccgtaaccggcgtttaacccggnggtaccgaccgtacgggaccgtaccggccggtttaccgtttcggtacccggttcggtacggggg

SEQ ID NO: 208292 - DNA, 532 bp, Homo sapiens
  misc_feature: GYAE6OF02FTM24.17.25.C03.1.454.CMB.1.raw
  modified_base (331)..(331): a, c, t, g, unknown or other
  misc_feature (331)..(331): n is a, c, g, or t
  modified_base (338)..(338): a, c, t, g, unknown or other
  misc_feature (338)..(338): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaanactggtntcacagtgtcttcacccatcctcgggacagtacttaccatcgaccacgaactcctaccaactaaaccacacgcctacagtggagttgaggagcctgactatctagacgacacggcctctacttactgtcgcgagacgtcccaacgtctccggtagacgccgtacggcaggccgtcctttcgacgttcgtcgggg

SEQ ID NO: 208293 - DNA, 538 bp, Homo sapiens
  misc_feature: GYAE6OF02GG1WI.17.25.C03.1.454.CMB.1.raw
  modified_base (291)..(291): a, c, t, g, unknown or other
  misc_feature (291)..(291): n is a, c, g, or t
  modified_base (334)..(334): a, c, t, g, unknown or other
  misc_feature (334)..(334): n is a, c, g, or t
  modified_base (342)..(342): a, c, t, g, unknown or other
  misc_feature (342)..(342): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggggcctcagtgaaggtctcctgcaaggcttctggattcacgtttacctcctatagtatcaactgggtgcgccaggccnctggacaacgacctgagtgggatgggatggggcgaaccctaanacgtggtntcacagtgtcttccacccatcctcgggacagacttaccatcgaccacgactcctcaataaacacacgcctacatggagttcgaggcgcctgacatctgaccgacgaccggtcgtcttattactgtcgcgagacgtcccacgtcgtaccggtgacgccgtacggcacggtccggtccctttgaccgttgtaccgggg

SEQ ID NO: 208294 - DNA, 551 bp, Homo sapiens
  misc_feature: GYAE6OF02G9XIC.17.25.C03.1.454.CMB.1.raw
  modified_base (280)..(280): a, c, t, g, unknown or other
  misc_feature (280)..(280): n is a, c, g, or t
  modified_base (340)..(340): a, c, t, g, unknown or other
  misc_feature (340)..(340): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatggggatggggcaaccctaacacgtggtntcacgagtgtcttccacccatcccgtccgggacacgacttaccatcgaccacgaactccctcaataaacacagccctacagtggagttaggaggacgcctgacattcgaggaccgacgacggccgtacttattacgtgtcgacgagtaccgtcccgagcgtccggtagacgccgtacggcacggtccgtcctttacggccgttcgtcgggg

SEQ ID NO: 208295 - DNA, 960 bp, Homo sapiens
  misc_feature: GYAE6OF02HDDRK.17.25.C03.1.454.CMB.1.raw
tcagcgtagactagcacgaccggtgctcgatttagtagtgtagatttgggtttggggactcaacaaccacatctgtcctctagaagaaaaccctgtgagcacagctcctcaccatggactggacctggaggatcctcttcgttggtggcagcagctaacaagtgcccactcccaggtgcagctggtgcagtcgtggggctggaggtgaagaacgccgtggggcctcgagtagaaggtctccgtgcgaaggcttcgtggattctacgtttacctcctatagtatcaacgtgggtgccgccgaggcccgcgtcggaaccaacgaccgtggaggtggagtggggagtcggggaccgaaaccctaacacgtgggtcgtaccaacgtaggttcgttcctttaccgaacccctacgttccccggtaccggggaaccaacggtaaccctttaacccaagttacggaaccccgaaccgtaaacccttccccgtaaccctaaaactaaaaacccaaccgaaccggtaacccttaaaccgtaaggttacggggtaaacggtttacgggaaacggggtaaccgtacccgttaacgggaaacctacgtttaccgtaaccgggtaaacccggtaaccccgggtaaaccccgggggttaccccgttttaacccgttttaaaacgtttttaaccccgggttacgggttacccggggtaaccgggtaaaccggggttaccccggtttaaccccccccggtaaaaccgggttaaccccggggttttaaccccccggggggtttaaggggaaaaccccccggggttttaaccccccggggtttaaaaccccggggggtaaccccggtaaaacccgggggggttacccccccggggtttttaccccccgggttttttttaacccggggttaacccccgggttttttacccccggggggtttaaaccccggggggggggg

SEQ ID NO: 208296 - DNA, 526 bp, Homo sapiens
  misc_feature: GYAE6OF02IW8HE.17.25.C03.1.454.CMB.1.raw
  modified_base (281)..(281): a, c, t, g, unknown or other
  misc_feature (281)..(281): n is a, c, g, or t
  modified_base (340)..(340): a, c, t, g, unknown or other
  misc_feature (340)..(340): n is a, c, g, or t
  modified_base (432)..(432): a, c, t, g, unknown or other
  misc_feature (432)..(432): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatggggcgaaccctaacactggtntcacagtgtccttcacccatcctccggggacacgacttaccatgaccacgaactcctaccaataaacacacgcctacatggagttgaggacncctgacatctgacgacacggccgtactattctgtcgcgagacgtcccaggctccggtgacgccgtacggcaggccgtcttgacgttcgtcgggg

SEQ ID NO: 208297 - DNA, 550 bp, Homo sapiens
  misc_feature: GYAE6OF02GAP2T.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacgactggtgtcactagtgtcttcacccatcccgtccgggacacgacttaccatacgaccacgaacctcctaccaataaacacacacctaacatggagttgaggacgcctagactatctgacgacacggccgtctattactgtcgcgagacgtcccacggtactccggtagaccgccgtacggcgacggtccggtcctttacggtaccttcggtaccgggg

SEQ ID NO: 208298 - DNA, 524 bp, Homo sapiens
  misc_feature: GYAE6OF02G9UHK.17.25.C03.1.454.CMB.1.raw
  modified_base (437)..(437): a, c, t, g, unknown or other
  misc_feature (437)..(437): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggcagacttaccatcgaccacgaacctcctccaataaaccacagccctacatggagttgaggagcctgacatcngacgacgacgccgtctattctgtgcgagcgtcccaggctccggtagacgccgtacggcacggccggtcctttagaccttgtcggggg

SEQ ID NO: 208299 - DNA, 645 bp, Homo sapiens
  misc_feature: GYAE6OF02ILJ8L.17.25.C03.1.454.CMB.1.raw
  modified_base (332)..(332): a, c, t, g, unknown or other
  misc_feature (332)..(332): n is a, c, g, or t
tcagcgtagactagcacgaccggtgctcgatttagtagtgtagatttgggtttgggggactcaaacaaccacatctgtcctctagagaaaaccctgtgagacacagctcctcaccatggactggacctggaggatcctcttcttggtggcagcagctacagtgcccactcccaggtgcagctggtgcagtctggggctgaggtgaagaagcctggggcctcagtagaaggtctcctgcaaggcttctggattcacgtttacctcctatagtatcaactgggtgcgccaggccgctggacaacgcctgagtgatgggatgggacaacctaacnctggtgtcacagtcgtcttccaccctagtccgtccgggacacgtaccttaccacgtcgaaccgaccgtaaaccctccctaaccaactaaaaccaccacgtaccctaacgactgggtaacgttcggaacggacgtacccgtagaacctacttccgtagaaccgtaccgaccgggtacccgttacgttaatttaccgtcggtcggacgtacggtaccgtacccctaacgggtaacgtacccgggtaggtacgcccggttaacgggacctacgggtcccggttaccgttttacggtacccgtttcgggtcccgggg

SEQ ID NO: 208300 - DNA, 565 bp, Homo sapiens
  misc_feature: GYAE6OF02H4LTL.17.25.C03.1.454.CMB.1.raw
  modified_base (260)..(260): a, c, t, g, unknown or other
  misc_feature (260)..(260): n is a, c, g, or t
  modified_base (427)..(427): a, c, t, g, unknown or other
  misc_feature (427)..(427): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttaccncctatagtatcaactgggtgcgccaggccgctggacaacgacctgagtggatgggatgggcaacctaacacgtggtgtcacagtgtcttccacccatccctccgggacagacttaccatcgaccacgaactccctccaaactaaacacagcctacatggagttgagngcctgacatcagacgacacgggccgtcttaacttacgtgtcgacgaggacgtcccgaacggtacgtacccggtaggtaccgcccgtaacgggccgtacgggcccgggtcctttttacggaccgtttccggtacggggg

SEQ ID NO: 208301 - DNA, 641 bp, Homo sapiens
  misc_feature: GYAE6OF02I9PYK.17.25.C03.1.454.CMB.1.raw
  modified_base (545)..(545): a, c, t, g, unknown or other
  misc_feature (545)..(545): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaaggtctcctgcaaggcttctggattcacgtttacctcctatagtatcaacgtgggtgcgccacggcccgcgtgggaacaaccgaccgtgagtggagtggggagtcggggaccgtaaaccccgtaacgacgtgggtcgtaccgacgtaggttcggttccttaccgaccctaacgtccgtaccgggaactacgtaaccttaccgactacgaccaacgtaaccctaccctaccaaactaaaacacaacgacctaacgagtagggattggaacgtacgcctagactagtcgtacgaccgacgaccggtcttactatttaccgnggtacgacgtacgtaccgtacccgacggtagtcccggtagaccgtaccgtacgggactacggtccggtaccgtttacggtaccgttcggtccgggg

SEQ ID NO: 208302 - DNA, 544 bp, Homo sapiens
  misc_feature: GYAE6OF02IZECB.17.25.C03.1.454.CMB.1.raw
  modified_base (331)..(331): a, c, t, g, unknown or other
  misc_feature (331)..(331): n is a, c, g, or t
  modified_base (430)..(430): a, c, t, g, unknown or other
  misc_feature (430)..(430): n is a, c, g, or t
  modified_base (455)..(455): a, c, t, g, unknown or other
  misc_feature (455)..(455): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaanacgtggtgtcacagtgtcttcacccatccgccgggacacgacttaccatcgaccacgaactcctaccaataaacacagcctacatggagttagaggacncctgacatctgacgacacggccgtntacttacgtgtgcgagacgtcccacggacttcccggagaccggccctacgggctaggcccggtaccgtttcgaccgtttcgtacggggg

SEQ ID NO: 208303 - DNA, 580 bp, Homo sapiens
  misc_feature: GYAE6OF02GE3MX.17.25.C03.1.454.CMB.1.raw
  modified_base (280)..(280): a, c, t, g, unknown or other
  misc_feature (280)..(280): n is a, c, g, or t
  modified_base (437)..(437): a, c, t, g, unknown or other
  misc_feature (437)..(437): n is a, c, g, or t
  modified_base (453)..(453): a, c, t, g, unknown or other
  misc_feature (453)..(453): n is a, c, g, or t
  modified_base (494)..(494): a, c, t, g, unknown or other
  misc_feature (494)..(494): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgcgtggaccaacgaccgtgagtggatgggatgggaccgaaccctaacacgtggtctacacgtagttcgtccttccaccctatcccgtaccgggacagtaccttaccatacgaccacgtaacctcctaccaataaaccacacgccctanagtggagttgaggacncctagacatctagacgaccgacggtcccgttatactttacnggtcgacggacgtaccgtcccacggtacgtccggtagaaccgtcccgtaacggcacggtccgttctttcgaccgttcgtacggggg

SEQ ID NO: 208304 - DNA, 576 bp, Homo sapiens
  misc_feature: GYAE6OF02H7GMD.17.25.C03.1.454.CMB.1.raw
  modified_base (281)..(281): a, c, t, g, unknown or other
  misc_feature (281)..(281): n is a, c, g, or t
  modified_base (336)..(336): a, c, t, g, unknown or other
  misc_feature (336)..(336): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcaccgtttacctcctatagtatcaactgggtncgccaggccgctggacaacgacctgagtggatgggatggggaccgaaaccctaanacgtggtgtacactagtcgtcttcaccctatcccgtccgggacagtaccttaccatcgaacccacgaactccctaccaataaaacacaagccctaacatagggacgttggaaggagcctgacatctagacgaccacggccgtacttagttactggtcgacgagacgtccccgagacgtcccggtagaccgtccgtaacggccacggtcccggtaccttttggacccttcggtaccggggg

SEQ ID NO: 208305 - DNA, 610 bp, Homo sapiens
  misc_feature: GYAE6OF02F513H.17.25.C03.1.454.CMB.1.raw
  modified_base (331)..(331): a, c, t, g, unknown or other
  misc_feature (331)..(331): n is a, c, g, or t
  modified_base (339)..(339): a, c, t, g, unknown or other
  misc_feature (339)..(339): n is a, c, g, or t
  modified_base (429)..(429): a, c, t, g, unknown or other
  misc_feature (429)..(429): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaacgtgggtgcgccaggccgctggacaacgcctgagtggatgggatgggacgaaccctaanacgtggtntcacgagtcgtcttccaccctatcccgtccgggacacgtaccttaccagtcgaaccacgaacctcctaccaataaaccacacgacctaanacgtgggtaagttgaacgggtacgtcctaggaacctataccgtaggaacccgacgtacccgggtcccgttacttaagttaccttggtacgcggtacgacgtacccgaacggtacggtcccgggtagaccggtacccgtaacggcgacggccggttcctttacggtaccgttcggtccgggg

SEQ ID NO: 208306 - DNA, 630 bp, Homo sapiens
  misc_feature: GYAE6OF02HTB9K.17.25.C03.1.454.CMB.1.raw
  modified_base (278)..(278): a, c, t, g, unknown or other
  misc_feature (278)..(278): n is a, c, g, or t
  modified_base (301)..(301): a, c, t, g, unknown or other
  misc_feature (301)..(301): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaacctatttaaattggtatcagcaagaaacctggaaaacnccccagacctctgatctctggtncatccactctgcgaagtggcctccatcgaggttcaggtggcaggtgatcgtagggactagtatttacaatctaccaaccatcccaacccaccttctacgacctaaaccgttggacggtatttggtacgactaacttaccttaacttaaccgtcgtaccaaacgtacggttaacgtttaccgtaccgtttcccccgtacgtacctttaccgttttcggacccgtaacggggtaacctaaagggtttacgaacggtaactaaccgaaaaacggtaccgttagggtacggtaccgttacggtaccctaaccgtacttccgttacgttacccg

SEQ ID NO: 208307 - DNA, 519 bp, Homo sapiens
  misc_feature: GYAE6OF02FNCXA.17.25.C03.1.454.CMB.1.raw
  modified_base (279)..(279): a, c, t, g, unknown or other
  misc_feature (279)..(279): n is a, c, g, or t
  modified_base (402)..(402): a, c, t, g, unknown or other
  misc_feature (402)..(402): n is a, c, g, or t
  modified_base (405)..(405): a, c, t, g, unknown or other
  misc_feature (405)..(405): n is a, c, g, or t
  modified_base (410)..(410): a, c, t, g, unknown or other
  misc_feature (410)..(410): n is a, c, g, or t
  modified_base (423)..(423): a, c, t, g, unknown or other
  misc_feature (423)..(423): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtncgccaggccgctggacaacgacctgagtggatgggatgggcaaccctaacactggtcgtcacagtgtcttcacccatccctcgggacagacttaccatgaccacgaactcctaccaataaacncancctanatggagttgagancctgacatctgacgcacggcctactattactgtgacgagacgtcccagtactccggtgacgccctagggcacggccgtcctttgacttcggcgggg

SEQ ID NO: 208308 - DNA, 550 bp, Homo sapiens
  misc_feature: GYAE6OF02FV5HU.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaacgccccagacctcctgactctctggtgcatccactctgcgaagtcggcgtcccatcgaggttcagtggcagtggatcgtgggacagtatttcaatctacactatcaccactctcgacaacctgaggtatgtgcaattctactactgtacaactagtacgttactacgttcccctacgtccttacgttttcggaccgtacggggtaacctaaggttcggaacgtaactaaccgaaacgtaacgttgtacggactacggaccacctacttctgttacc

SEQ ID NO: 208309 - DNA, 531 bp, Homo sapiens
  misc_feature: GYAE6OF02HHHR5.17.25.C03.1.454.CMB.1.raw
  modified_base (339)..(339): a, c, t, g, unknown or other
  misc_feature (339)..(339): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtgcgccaggccgctggacaacgacctgagtggatgggatggggcaaccctaacgactgggtntcacagttgtcttcacccatcccgtccgggacacgacttaccatcgaccacgaactcctaccaataaacacacgcctacatgagttgaggagcctgacatctgacgacacggccgtactattactgtcgcgagacgtcccacggactccggtgacgtcctacggcaggccggtcctttgacgttcgtcgggg

SEQ ID NO: 208310 - DNA, 755 bp, Homo sapiens
  misc_feature: GYAE6OF02H09ZD.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattcacgtttacctcctatagtatcaactgggtgcgccaggccgctggacaacgcctgagtggagtgggatgggacgaaaccctaacgacgtggtcgtacacgtaggtcgttccttccaacccctagtcccgtaccggggactaacggtacctttaacccgagttaccgaacccaaccgtaacccttcccctacccaaactaaaaaccaccaacggtacccttaaccgaagttcggggtaagtttacgggaacgggtacgtacccgtaggaacctaacgttccgtacggaaacccggaaccgacccggggtacccgttaccgtttaaacgttttaccgacggttaccggaccgggtaacggtacccggttacccccgaaacgggtaccgtttccccgggggttaacggaccgggttaaccccgttaaccgggggacccgtaaccggggttaccccggggtttacccgtttttacgggtaccccggttttcgggttaacccgggggggg

SEQ ID NO: 208311 - DNA, 532 bp, Homo sapiens
  misc_feature: GYAE6OF02G4DQD.17.25.C03.1.454.CMB.1.raw
  modified_base (330)..(330): a, c, t, g, unknown or other
  misc_feature (330)..(330): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggttgcagcagctacaagtgcccactcccaggtgcagctggtgcagtctggggctgaggtgaagagcctggggcctcagtgaaggtctcctgcaaggcttctggattcacgtttacctcctatagtatcaactgggtgcgccaggccgctggacaacgacctgagtggatgggatgggcgaaccctaanacgtggtgtcacagtgtcttcacccatcctccgggacagtacttaccatcgaccacgaactcctccaataaaccacagcctacagtggagttgaggagcctagacatctgaaccgacgacgccgtactattacgtgtcgcgagacgtcccacgatccggtgacgccgtacggcacggccggtcctttggaccttcgtcgggg

SEQ ID NO: 208312 - DNA, 582 bp, Homo sapiens
  misc_feature: GYAE6OF02ILTHC.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggcgaaccctaacgactggtcgtcacagtgtcttcacccatccgtcgggacagacttaccatcgaccacgaacctcctacaataaacacagcctacatggagttagaggagcctgacatctagaccgacgaccggccgttcttaacgttactcggtacggacgaaggtaccgtccctaacggtacttcccggggtagaaccgtcccgttaaccgggctaacgggtccgggtacccttttaggaccctttccggtaccgggggg

SEQ ID NO: 208313 - DNA, 552 bp, Homo sapiens
  misc_feature: GYAE6OF02FLKBU.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatgggacgaaccctaacacgtggtgtcacagtgtcttcacccatccgtccgggacacgaccttaccatcgacccacgaacctcctaccaactaaaccacacgaccctaacataggagttgaggacgcctgacatctagacgacgaccggccgtacttattactgtcgcgtagacgtcccacgctccggtgaccgtccgtacggcacggccggtcctttaggacctttcggtcgggg

SEQ ID NO: 208314 - DNA, 612 bp, Homo sapiens
  misc_feature: GYAE6OF02JZUEH.17.25.C03.1.454.CMB.1.raw
  modified_base (246)..(246): a, c, t, g, unknown or other
  misc_feature (246)..(246): n is a, c, g, or t
  modified_base (348)..(348): a, c, t, g, unknown or other
  misc_feature (348)..(348): n is a, c, g, or t
  modified_base (447)..(447): a, c, t, g, unknown or other
  misc_feature (447)..(447): n is a, c, g, or t
tcagcgtagactagcacgaccggtgctcgatttagtagtgtagatttgggtttggggacgtcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgcaaggcttcnggattcacgtttacctcctatagtatcaacgttgggtgcgccgaggccgctggacaacgacctgaggtggatgggatgggccgaaccctaacgacgtgggtntcgactgtgtccttcacccgatcccgtaccgggacacgtaccttaccattcgaaccaccgtaacctccctacctaataaaccacgtaacgacccttaancgtaggagttacggacggactccgtagacctattacgtaggaccgtaccgaccggtcccgttactttactaacgtgtcgcgaagtccgtcccaacggtcgtccggtagaccggtcccgtagggcctagggtcccggttacgtttacgaccgttccggtacggggg

SEQ ID NO: 208315 - DNA, 535 bp, Homo sapiens
  misc_feature: GYAE6OF02GFA9M.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatgggcgaaccctaacactggtgtcacgagtgtccttcacccatcctccgggacagacttacatcgaccacgaactcctaccaataaacacacgcctacatggagttgaggacgcctagacatctagacgacgacgccgtctacttactgtgcgacgacgtcccacgacgtccggtgacgccctacggcacggccggtcctttggaccttgtaccgggg

SEQ ID NO: 208316 - DNA, 581 bp, Homo sapiens
  misc_feature: GYAE6OF02HQLR6.17.25.C03.1.454.CMB.1.raw
  modified_base (244)..(244): a, c, t, g, unknown or other
  misc_feature (244)..(244): n is a, c, g, or t
  modified_base (279)..(279): a, c, t, g, unknown or other
  misc_feature (279)..(279): n is a, c, g, or t
  modified_base (289)..(289): a, c, t, g, unknown or other
  misc_feature (289)..(289): n is a, c, g, or t
  modified_base (358)..(358): a, c, t, g, unknown or other
  misc_feature (358)..(358): n is a, c, g, or t
  modified_base (410)..(410): a, c, t, g, unknown or other
  misc_feature (410)..(410): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcnggattcacgtttcctcctatagtatcaactgggtncgccaggccnctggacaacgcctgagtggagtgggatgggaccaaccctaagcgtggtgtacacagtcgtcttcacccntcccgtacgggacagtaccttaccatcgaccacgaacctcctacaataaacncacgcctacagtggagttcgaggacgcctgacatctagaccgacgaccgggtcctataacttacgtgtcggacgacggtaccgtcccaacggtacgtcccgggttacgaaccgtcccgtaacgggcctacgggcccggtttcccgtttaggtacccgttgggtcccggggg

SEQ ID NO: 208317 - DNA, 566 bp, Homo sapiens
  misc_feature: GYAE6OF02H3M8M.17.25.C03.1.454.CMB.1.raw
  modified_base (331)..(331): a, c, t, g, unknown or other
  misc_feature (331)..(331): n is a, c, g, or t
  modified_base (458)..(458): a, c, t, g, unknown or other
  misc_feature (458)..(458): n is a, c, g, or t
  modified_base (467)..(467): a, c, t, g, unknown or other
  misc_feature (467)..(467): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcaggcacaggtgcccacgcccaggttcagttggtgcagactggggctgaggtgcagaagcctggggcatcagtgactgtctcctgcaaggccagtgatatatcttacaacaaaatataggtatgaagttgggtgcgacgacggcccccggaacaagggcttggaggtggggtggggtgggtnaggtcggtctttggaacgggtaagcacgtagtatgacaaccggaagaactggaagggacaggactcgacgattaaccgacggacccaacccccaagaacacagtacacatcgcaaacgtgaacgacnccgtagagngcgtagacgacaccggccgttactatactgtagcgtagtaagttcgttttctagtctagttacgtaactaagtttacgagttacggcttactagtacgg

SEQ ID NO: 208318 - DNA, 543 bp, Homo sapiens
  misc_feature: GYAE6OF02HQDME.17.25.C03.1.454.CMB.1.raw
  modified_base (279)..(279): a, c, t, g, unknown or other
  misc_feature (279)..(279): n is a, c, g, or t
  modified_base (435)..(435): a, c, t, g, unknown or other
  misc_feature (435)..(435): n is a, c, g, or t
  modified_base (442)..(442): a, c, t, g, unknown or other
  misc_feature (442)..(442): n is a, c, g, or t
  modified_base (498)..(498): a, c, t, g, unknown or other
  misc_feature (498)..(498): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtncgccaggccgctggacaacgcctgagtggatggggatggggacaaccctaacgactgggtgtcacagttgtccttcgaccccatcccgtccgggacagaccttaccatcgaccacgaacctcctacaataaacacagcctacagtggagttgaggncctgacntctgacgacacggcctctattacgtgtacgcgagtacgtcccaaggctcccgggtnacgcccgtaggcacggtccggtaccttttgacgtttcgtacgggg

SEQ ID NO: 208319 - DNA, 536 bp, Homo sapiens
  misc_feature: GYAE6OF02FQX6T.17.25.C03.1.454.CMB.1.raw
  modified_base (280)..(280): a, c, t, g, unknown or other
  misc_feature (280)..(280): n is a, c, g, or t
  modified_base (330)..(330): a, c, t, g, unknown or other
  misc_feature (330)..(330): n is a, c, g, or t
tcagcgtagactagcacgaccggtgctcgatttagtagtgtagatttgggtttggggactcaacaaccacatctgtcctctagagaaaaccctgtgagaacagctcctcaccatggactggaccgggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggcaaccctaanactggtgtcacagtgtcttcacccatccctccgggacagaccttaccatgacccacgaacctcctaccataaacacagcctacatggagttgaggagcctgacatctgacgacacggcctctattacctgtcgcgagacgtcccacgactccggtgacgcccgtacggcaggccggtcctttgaccttcgtcgggggcctacgggg

SEQ ID NO: 208320 - DNA, 615 bp, Homo sapiens
  misc_feature: GYAE6OF02IVPIG.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaggcttctggattcacgtttacctcctatagtatcaactgggtgcgccaggccgctggacaacgacctgagtggatggggatgggaccgtaacccgtaacgactggtgtcaacgagtcgtcttcaccctatccgtaccgggactagacttaccgatcgaccaacgaaccttcccgtaaccaagtaaaccacacgacccttaacagtaggagttcggaggacgtccctgaacctagtctaggaaccgacgaccgggtcctcgttaatttactcggtaggccgaggtaccgtcccgaacggtacttcccgggagaccggtaccccgttaagggcccgtaacggcccgggttacccttttggtaccccgtttcggtccggggg

SEQ ID NO: 208321 - DNA, 695 bp, Homo sapiens
  misc_feature: GYAE6OF02IZLNW.17.25.C03.1.454.CMB.1.raw
  modified_base (281)..(281): a, c, t, g, unknown or other
  misc_feature (281)..(281): n is a, c, g, or t
  modified_base (291)..(291): a, c, t, g, unknown or other
  misc_feature (291)..(291): n is a, c, g, or t
  modified_base (334)..(334): a, c, t, g, unknown or other
  misc_feature (334)..(334): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaagggtctcctgcaaggcttctggattcacgtttacctctatagtatcaactgggtncgcaggccgntggacaacgactgagtggactgggatggggtaccgaacctaanaccgtggtcgtcactagtggtcttacaccctactcctccggggaactacggaacctttaacccattacggaacccaacggtaaaccctccctacccaacttaaaacaccgaacgtaccctaacaagttcggaggtttacgagggacgtcccttacgactaatccgttaggaaccggaaccgaaccgggtacccgttaccgttagtttaaccgtcggtacggtacgaacgggtaccgttaccccgaaccgggtaacggttaccccggggttacggtaaccggtacccggttaccgggtacccgggtaacggtcccgggttacccggttttacggttaaccggtttccgttaacccggggggg

SEQ ID NO: 208322 - DNA, 602 bp, Homo sapiens
  misc_feature: GYAE6OF02FK3I7.17.25.C03.1.454.CMB.1.raw
  modified_base (280)..(280): a, c, t, g, unknown or other
  misc_feature (280)..(280): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaacgtgggtncgccaggccgctggacaacgacctgagtggatggggatgggaccgaaccctaacacgtggtgtcacgagtgtcttacacccatcccgtcgggacagtaccttaccatcgaccacgaactcctaccaataaaccacacgaccctaacatgggagttcggaggtacgccgtagaacctattccgtacggaaccggtaccgaccgggtcccggttacttaacgtttaccgtggtgacggtagtaccgtacccgacgtacgtcccgggtagaccgtcccgtacgggctacggtcccggttcctttacggaccgttcggtaccgggg

SEQ ID NO: 208323 - DNA, 593 bp, Homo sapiens
  misc_feature: GYAE6OF02ITHAH.17.25.C03.1.454.CMB.1.raw
  modified_base (248)..(248): a, c, t, g, unknown or other
  misc_feature (248)..(248): n is a, c, g, or t
  modified_base (294)..(294): a, c, t, g, unknown or other
  misc_feature (294)..(294): n is a, c, g, or t
  modified_base (415)..(415): a, c, t, g, unknown or other
  misc_feature (415)..(415): n is a, c, g, or t
  modified_base (485)..(485): a, c, t, g, unknown or other
  misc_feature (485)..(485): n is a, c, g, or t
tcagcgtagactagcacgaccggtgctcgatttagtagtgtagatttgggtttggggtacgtcgaacaaccacatctgtcctctagagaaaaccctagtgagcacagctcctcaccatggactggacctggaggatcctcttcttggtggcagcagctacaagtgcccactcccaggtgcagctggtgcagtctgggctgaggtgaagaagcctggggcctcgagtgaaggtctcctgcaaggcttcnggattcacgtttacctcctatagtatcaactgggtgcgccaggccnctggacaacgcctgagtggatgggatgggccgaaacctaagacgtggtctcacgagtgtcttcacccatcccgtacgggacagtaccttacatcgacccacgtaactccaccgaataaacncaacgcctacataggagttgagagcctagacattctggaccgaacgaccgggtccttactaatttaccgngttaccgagtacgggtacctacccgtaacgaacgttcccgggtggaacgtcccgttacgggccaacggggtcccggttccgttttacggtaccgttccggtacggggg

SEQ ID NO: 208324 - DNA, 590 bp, Homo sapiens
  misc_feature: GYAE6OF02GWYN5.17.25.C03.1.454.CMB.1.raw
  modified_base (428)..(428): a, c, t, g, unknown or other
  misc_feature (428)..(428): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggagtgggatcgggaccaaccctaacgacgtggtctacacagtgtcttaccaccctatcccgtccgggacacgaccttaccatcgaccacgaacctcctacaactaaacacacgacctanatggtagttgacggacgcctagacatcgtacgaaccgacgtaccggtcctacttaacttacgtgtacgacgtacgtacgtacccacggtacgttccgggtagaccggtcccgtacggccgtacggtccggtacccgttttcggaccgtttccggaccggggg

SEQ ID NO: 208325 - DNA, 575 bp, Homo sapiens
  misc_feature: GYAE6OF02IFDC8.17.25.C03.1.454.CMB.1.raw
  modified_base (334)..(334): a, c, t, g, unknown or other
  misc_feature (334)..(334): n is a, c, g, or t
  modified_base (378)..(378): a, c, t, g, unknown or other
  misc_feature (378)..(378): n is a, c, g, or t
  modified_base (419)..(419): a, c, t, g, unknown or other
  misc_feature (419)..(419): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcaccgtttactcctatagtatcaactgggtgcgccaggccgctggacaacgacctggagtggagtgggatggggcgaaaccctaanacgtggtgtcacgagtcgtcttccaccctatccgtccggggaancgtacttaccatcgaaccacgtactccctaccaataaaccncacgcctacatggagttagaggacgcctgacatcgagacgacaccggtccgtacttaacgttactggtcgacgacgtacgtcccgaacggtcgtaccgggtagaccgtcccgtacggcgacggtccggtacctttcggtaccgttcggtaccgggg

SEQ ID NO: 208326 - DNA, 540 bp, Homo sapiens
  misc_feature: GYAE6OF02G5O9G.17.25.C03.1.454.CMB.1.raw
  modified_base (332)..(332): a, c, t, g, unknown or other
  misc_feature (332)..(332): n is a, c, g, or t
  modified_base (409)..(409): a, c, t, g, unknown or other
  misc_feature (409)..(409): n is a, c, g, or t
  modified_base (444)..(444): a, c, t, g, unknown or other
  misc_feature (444)..(444): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggcgaaccctaanacgtggtgtcacgagtgtcttcacccatccgtccgggacagacttaccatcgaccacgaacctccctacactaaacncacgacctacatggagttgaggacgcctgacatcngacgacgacggcctactattactgtgcgagacgtcccacgcgtcccggtgacgtcccgtacggcacggccggtcctttggaccttcggtaccgggg

SEQ ID NO: 208327 - DNA, 518 bp, Homo sapiens
  misc_feature: GYAE6OF02IANBU.17.25.C03.1.454.CMB.1.raw
  modified_base (291)..(291): a, c, t, g, unknown or other
  misc_feature (291)..(291): n is a, c, g, or t
  modified_base (477)..(477): a, c, t, g, unknown or other
  misc_feature (477)..(477): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctctttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccnctggacaacgacctgagtggatgggatggggcaacctacactggtgtcacgagtgtcttcacccatccctccgggacagaccttaccatcgaccacgactcctaccataaacacagcctaacatggattgaggagcctgacatctagacgacacggccgtctattactgtgcgagacgtcccaggntccggtgacgccacggcaggccggctttcgacttgtcgggg

SEQ ID NO: 208328 - DNA, 543 bp, Homo sapiens
  misc_feature: GYAE6OF02GC9M1.17.25.C03.1.454.CMB.1.raw
  modified_base (280)..(280): a, c, t, g, unknown or other
  misc_feature (280)..(280): n is a, c, g, or t
  modified_base (345)..(345): a, c, t, g, unknown or other
  misc_feature (345)..(345): n is a, c, g, or t
  modified_base (434)..(434): a, c, t, g, unknown or other
  misc_feature (434)..(434): n is a, c, g, or t
  modified_base (453)..(453): a, c, t, g, unknown or other
  misc_feature (453)..(453): n is a, c, g, or t
  modified_base (471)..(471): a, c, t, g, unknown or other
  misc_feature (471)..(471): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgcgtggacaacgacctgagtggatgggatgggacgaaccctaagactggtgtcacngtgtcttcacccatcctacgggacagaccttaccatcgaccacgaacctcctaccaataaaccacacgccctacatggagttgaggacncctgacattcagaccgacncgggccttactagttacngtcgcgagacgtcccacggatcccggtgaccgtcctacggctacgggccggttccttggaccttcggcgggg

SEQ ID NO: 208329 - DNA, 570 bp, Homo sapiens
  misc_feature: GYAE6OF02IJHC9.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttactcctatagtatcaactgggtgcgccaggccgctggacaacgacctgagtggatgggatggggaccgaaaccctaacgacgtggtagtcacgagtcgtcttcacccatcctccgggacacgtacttaccatcgaccacgaactcctaccaataaaccacacgcctaacatggaagttggaggacgccctgaaccatcgtacggaaccgacgaccggtccgttacttaagttaccgtgtcgacgagtacgtcccgacgacgtccggtgacgcccgtaacggcacggtccggtacctttgaccttggtaccgggg

SEQ ID NO: 208330 - DNA, 531 bp, Homo sapiens
  misc_feature: GYAE6OF02F6X0V.17.25.C03.1.454.CMB.1.raw
  modified_base (422)..(422): a, c, t, g, unknown or other
  misc_feature (422)..(422): n is a, c, g, or t
  modified_base (487)..(487): a, c, t, g, unknown or other
  misc_feature (487)..(487): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaacccgtaacactggtgtcacagtgtcttcacccatcctcgggacagacttacatgaccacgactcctcactaaacacagcctacatggagttgacggancctgacatcgtgacgacacggccgtactattactggtagcgagacgtcccaggtacgtccgggtnacgtccctacggcacggccggtcctttcggaccttcgtcggggg

SEQ ID NO: 208331 - DNA, 575 bp, Homo sapiens
  misc_feature: GYAE6OF02FUBRV.17.25.C03.1.454.CMB.1.raw
  modified_base (277)..(277): a, c, t, g, unknown or other
  misc_feature (277)..(277): n is a, c, g, or t
  modified_base (303)..(303): a, c, t, g, unknown or other
  misc_feature (303)..(303): n is a, c, g, or t
  modified_base (374)..(374): a, c, t, g, unknown or other
  misc_feature (374)..(374): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaacctatttaaattggtatcagcagaaacctggaaaacnccccagacctcctgactcgtctggtncactccgacttctcgcgaagtggcgtcccatcgagttcagtgcagtgatcgtggacagtatttcaagttcncaacatccaccactctgacctaactgaggtactgtcgacgtaacttcgtacctacgtacgtacaaacgtagtaacgtttaccgaccgtttcccctcgtaccttaaccgtttcggaccgtaacgggaaccgttaaggttcgaaggtactaaccgaaacggtacgtaggtcggaccttcgacctaacctgttaccgttagtcc

SEQ ID NO: 208332 - DNA, 660 bp, Homo sapiens
  misc_feature: GYAE6OF02JHOA7.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgcctggagtggatgggatggggacgaacctaacacgtggtgcacagtgtcttcacccatcccgtccgggacacgacttaccatcgaacccacgtaacctccctaccaaactaaaccacacgaccctaacacgtggtagttaggacggtactcccgtgaacctataccgttagaacccggaaccgtaaccggggtcccgtttacttaacgtttaccgtaggttacggaccggtaacggtacccgtaccccgtaaccggtaccggttcccgggtaggaacccggtccccggttaaccggggacgttacccggggtcccggtttcccgtttttacgggtacccgtttccgggtaacccgggggg

SEQ ID NO: 208333 - DNA, 541 bp, Homo sapiens
  misc_feature: GYAE6OF02GDGDO.17.25.C03.1.454.CMB.1.raw
  modified_base (330)..(330): a, c, t, g, unknown or other
  misc_feature (330)..(330): n is a, c, g, or t
  modified_base (414)..(414): a, c, t, g, unknown or other
  misc_feature (414)..(414): n is a, c, g, or t
  modified_base (427)..(427): a, c, t, g, unknown or other
  misc_feature (427)..(427): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggcccgctggacaacgacctgagtggatgggatgggcaacctaanactggtgtcacagtgtcttcacccatccgtccgggacacgacttaccatcgaccacgaactcctaccaataaacacacgcctanatggattgaggcncctgacatctgaccgacacgggccttctattactggtgcgtagacgtcccaggtacgtccggtagaccgacccgtacggcaggcccggtcctttggtaccgttcggtacggggg

SEQ ID NO: 208334 - DNA, 649 bp, Homo sapiens
  misc_feature: GYAE6OF02GCH0R.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaacctatttaaattggtatcagcaagaaacctaggaaaacgccccagacctcctgatctcgtggtgcatccactctgcgaagtcgcgtccatcgagttcagtgcagtggatcgtgggacagtactttacaattcctacaccataccaccacttcgtacgacctaaaccgttggaacggtatttcggtacgtacctaaacttccttaaccttacgtacgtaaccaaacgtaaggtaaccgtttaactacccggtttacccccgttagtacctttaaccgttttccgggaacccgtaacgggggtaaacccttaaggttacggaacggtaaacgttaaccgtaaaaccggtaacgtttcggttacggtaccgttacggtaccctaacccgtagttacccgtttacggttaccc

SEQ ID NO: 208335 - DNA, 554 bp, Homo sapiens
  misc_feature: GYAE6OF02FUIC8.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaacctatttaaattggtatcagcaagaaacctggaaaacgccccagacctcctgatctctggtgcatccactctgcgaagtggccgtcccatcgaggttcagtgcagtggatcgtgggacagtatttcaatctcaccatcaccactctgaccaaccgtgaggtattgtgacaattctaacctactcgtacaaactagtaacgttacctacgtttcccctcgtccttacgttttcggaccgtaacggggtaacctaaggttgaacgtaactaaccgaaaccgtaacttcggtggcgtcgaccacctacttcgtgttacc

SEQ ID NO: 208336 - DNA, 533 bp, Homo sapiens
  misc_feature: GYAE6OF02GMEX7.17.25.C03.1.454.CMB.1.raw
  modified_base (333)..(333): a, c, t, g, unknown or other
  misc_feature (333)..(333): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggacgaaccctaanactggtgtcacaggtcgtcgttcaccccagtccctccgggaacagacttaccatcgaccacgaacctcctaccaataaacacacgcctacatggattgaggagcctgacatctgaccgcacggccgtctattctgtcgcgagtacgtcccaggtactccggtgacgcctaggcaggccgtcctttggaccttcgtcgggg

SEQ ID NO: 208337 - DNA, 597 bp, Homo sapiens
  misc_feature: GYAE6OF02HO61M.17.25.C03.1.454.CMB.1.raw
  modified_base (290)..(290): a, c, t, g, unknown or other
  misc_feature (290)..(290): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtgcgccaggccnctggacaacgacctgagtggatggggatggggacaaaccctaacacgtggtgtcacagtgtcttcacccatcccgtccgggacagaccttaccatcgaccacgaacctcctaccaataaaccacacgaccctaacagtaggagttaggacggacgtcctagaccagtcctacggaaccgaccgaccgggtccgttacttactttacgtggtacgacggagaccgtacccaacggtacgtcccgggtagaaccgtcccgtacgggcacgggtccggtacccgttttggacccgtttcggtaccggggg

SEQ ID NO: 208338 - DNA, 571 bp, Homo sapiens
  misc_feature: GYAE6OF02JQEIZ.17.25.C03.1.454.CMB.1.raw
  modified_base (279)..(279): a, c, t, g, unknown or other
  misc_feature (279)..(279): n is a, c, g, or t
  modified_base (423)..(423): a, c, t, g, unknown or other
  misc_feature (423)..(423): n is a, c, g, or t
  modified_base (428)..(428): a, c, t, g, unknown or other
  misc_feature (428)..(428): n is a, c, g, or t
  modified_base (439)..(439): a, c, t, g, unknown or other
  misc_feature (439)..(439): n is a, c, g, or t
  modified_base (445)..(445): a, c, t, g, unknown or other
  misc_feature (445)..(445): n is a, c, g, or t
  modified_base (451)..(451): a, c, t, g, unknown or other
  misc_feature (451)..(451): n is a, c, g, or t
  modified_base (454)..(454): a, c, t, g, unknown or other
  misc_feature (454)..(454): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtncgccaggccgcgtggacaacgcctgagtggatgggatcggggacaaccctacacgtggtcgtacacgagtctccgttaccaccctatcccgtacgggacacgtacttaccagtacgaccacgaacctccaccaataaacacacncctanacgtggagttnaggacnccgtanacntctagacgacgacggtccttatacttcgtgtcgacgagtacgtacccgagcgttccggtgaacgtcccgttaacggcgtacggtccggtaccttttcggaccgttggtacccggggg

SEQ ID NO: 208339 - DNA, 573 bp, Homo sapiens
  misc_feature: GYAE6OF02GYIX6.17.25.C03.1.454.CMB.1.raw
  modified_base (289)..(289): a, c, t, g, unknown or other
  misc_feature (289)..(289): n is a, c, g, or t
  modified_base (331)..(331): a, c, t, g, unknown or other
  misc_feature (331)..(331): n is a, c, g, or t
  modified_base (346)..(346): a, c, t, g, unknown or other
  misc_feature (346)..(346): n is a, c, g, or t
  modified_base (369)..(369): a, c, t, g, unknown or other
  misc_feature (369)..(369): n is a, c, g, or t
  modified_base (433)..(433): a, c, t, g, unknown or other
  misc_feature (433)..(433): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctggggcctcagtgaaggtctcctgcaaggcttctggattcacgtttacctcctatagtatcaactgggtgcgccaggccgntggacaacgacctggagtggatgggatgggacgaaccctaanactggtgtcacagtntcttcaccctatccgtccggganacgacttaccatcgaccacgaacctccaccaataaacacacgcctaacagtaggagttgaggancctagacatcgtagaccgacgaccgcgttactacgttactgtagccgaggtaccgtcccaacggtacgtcccgggtagaccggtcccgtaacgggccaacgggtcccggtacccgttttggacccgtttcgtaccggggg

SEQ ID NO: 208340 - DNA, 729 bp, Homo sapiens
  misc_feature: GYAE6OF02GPDQL.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctccgtgcaaggcttctggattctacgtttacctctatagtatcgaactgggtgcgccaggccgcgtggacaacgacctggagtggagtgggagtcggggaccgaaccccgtaacgacgtgggtcgtaccaacgtagtcggttccttccgaacccctagttccccgtacccgggggaacctacggtaccctttaacccgacgttaccgaaccctaaccggtaaacccttccccgtacctaaaacgttaaaacccacccgtaacggtaccccttaacgaacgttacgggtaaacgtttcgggaacgggtaaccgtacccgttagaaacctacgtttacccgacgggtaacccgtaaaccgacccggggttacccgttaccttaagttttaacccgtggttacgacgtaacggtaccgtacccgaacggtacggtccgggttacgaccggtccgtacgggccacgggtcccggttccttttacggaccgtttggtaccggggg

SEQ ID NO: 208341 - DNA, 538 bp, Homo sapiens
  misc_feature: GYAE6OF02GI4YM.17.25.C03.1.454.CMB.1.raw
  modified_base (289)..(289): a, c, t, g, unknown or other
  misc_feature (289)..(289): n is a, c, g, or t
  modified_base (325)..(325): a, c, t, g, unknown or other
  misc_feature (325)..(325): n is a, c, g, or t
  modified_base (336)..(336): a, c, t, g, unknown or other
  misc_feature (336)..(336): n is a, c, g, or t
  modified_base (350)..(350): a, c, t, g, unknown or other
  misc_feature (350)..(350): n is a, c, g, or t
  modified_base (396)..(396): a, c, t, g, unknown or other
  misc_feature (396)..(396): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttcgtggattcacgtttacctctatagtatcaactgggtgcgccaggccntggacacgacctgagtggatgggatgggcaacctanactggtgtcanagtgtcttcacccntccgtccgggacagacttaccatcgaccacgactcctacataaacncagacctacagtggagttagaggagcctgactatccgtgacgacgacggtcctacttattactggtgacgagtacgtcccacgagtccggtagacgtacccgtacggcacggtccggtacctttcggaccgttggtccgggg

SEQ ID NO: 208342 - DNA, 571 bp, Homo sapiens
  misc_feature: GYAE6OF02FMQP8.17.25.C03.1.454.CMB.1.raw
  modified_base (281)..(281): a, c, t, g, unknown or other
  misc_feature (281)..(281): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgcaaggcttctggattcacgtttacctcctatagtatcaactgggtncgcaggccgctggacaacgacctgagtggatgggatggggccgaaaccctaacacttggtgtcactagtgtccttcacccactccgtaccgggacagtaccttaccatcgaccacgaacctcctcaataaaccacagccctacagtggaagttgaggtagcctagactatctagacgacaccgggccttactaacttctgtgaccgagacgtccccgaaggtacttccggtacgaacgtcccgtaacgggccacggtcccggtaccttttcggacgtttcggaccggggg

SEQ ID NO: 208343 - DNA, 569 bp, Homo sapiens
  misc_feature: GYAE6OF02IGLWX.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctactgcaaggcttctggattcacgtttacctcctatagtatcaacgtgggtgcgccaggccgctggacaacgacctgagtggatgggatgggaccaaccctaacacgtggtgtcacagtgtccttcacccatcccgtccgggacacgacttaccatcgacccacgtaacctcctaccaataaacacacgaccctacagtgggagttaggagacgccctgacactcgagaaccgcaccgggccgttattacgttactgtcgacgtagacgtcccgaacgtcgtcccggtagaccgcccgtaacgggcacggtccggtaccctttggaccttcggtacgggg

SEQ ID NO: 208344 - DNA, 528 bp, Homo sapiens
  misc_feature: GYAE6OF02I59QK.17.25.C03.1.454.CMB.1.raw
  modified_base (333)..(333): a, c, t, g, unknown or other
  misc_feature (333)..(333): n is a, c, g, or t
  modified_base (439)..(439): a, c, t, g, unknown or other
  misc_feature (439)..(439): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggacgaaccctaanactggtgtcacagtgtctcaccactccgtccgggacagacttaccatcgaccacgactcctacaataacacagcctacatggagttagaggacgcctgaccagtcngacgacacggcctactattactgcgcgagacgtcccacgcgtccggtagacgacgtacggcacggccggtcctttggaccttggcgggg

SEQ ID NO: 208345 - DNA, 634 bp, Homo sapiens
  misc_feature: GYAE6OF02JY3V2.17.25.C03.1.454.CMB.1.raw
  modified_base (261)..(261): a, c, t, g, unknown or other
  misc_feature (261)..(261): n is a, c, g, or t
  modified_base (282)..(282): a, c, t, g, unknown or other
  misc_feature (282)..(282): n is a, c, g, or t
  modified_base (442)..(442): a, c, t, g, unknown or other
  misc_feature (442)..(442): n is a, c, g, or t
  modified_base (512)..(512): a, c, t, g, unknown or other
  misc_feature (512)..(512): n is a, c, g, or t
  modified_base (524)..(524): a, c, t, g, unknown or other
  misc_feature (524)..(524): n is a, c, g, or t
tcagcgtagactagcacgaccggtgctcgatttagtagtgtagatttgggtttggggtacgtcaacaaccacatctgtcctctagagaaaaccctagtgagcacagctcctcaccatggactggacctggaggatcctcttcttggtggcagcagctacaagtgcccactcccaggtgcagctggtgcagtctggggctgaggtgaagagctggggcctcagtgaaggtctcctgcaaggcttctggattcaccgtttacnccttatagtatcaactgggtncggccaggccgctggacaacgtacctggacgtggatggggatggggaccgaacctaacgacgtggtagtccatagtgtacttcgacccactccgtccgggacagaacttaccgatacgaccacgaaccttcctaccgaattaaacaccagtacccctaanagtacggtagttgaagggaacgtcccttaggacaacgttctaacggaccgtaaccgacgggtacccttanaacgtttaccgngtggaccgtaagaccggtccccaacgggtaattccccggggtagaccggtacccctaggggacccttaagggccggttccccgttttaagccccggttttggcccggggg

SEQ ID NO: 208346 - DNA, 546 bp, Homo sapiens
  misc_feature: GYAE6OF02IOYQI.17.25.C03.1.454.CMB.1.raw
  modified_base (309)..(309): a, c, t, g, unknown or other
  misc_feature (309)..(309): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctcctgtctgcctctggtgggggtcagagtcaccatcacttgccggacaagtcacggacttaaaactatttaaattggtatcagcaagaaacctaggaaaacgccccagacctcctgatctcgtggtgcatccatcngcgagtgctccatcgagttcagtgctagtgatcgtgggacagtattcaatctacacatccacactctagacaactgaggtacttgtagactaatctactactgtacaacagtaacgttacgtacgttccctacgtaccttacgtttcggaccgtacgggtaacctaaggttacgaagtaacgtaaccgaaacggtaacgttacggtacggtctacgtcctaacgtacttctagttcc

SEQ ID NO: 208347 - DNA, 733 bp, Homo sapiens
  misc_feature: GYAE6OF02HENKM.17.25.C03.1.454.CMB.1.raw
  modified_base (294)..(294): a, c, t, g, unknown or other
  misc_feature (294)..(294): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctcctgcaaggcttctggattcacgtttacctcctatagtatcaagtgggtgcgccaggccgntggacacgacctgagtggatgggatcggggacgaaaccctaagacgtggtgtccacgtacgttgtccttaccaccctacgttcccgtccggggaacctacggtaaccctttacccgaagtttaccgaaccccgtaaaccggtaaacccttccccgtaaacccaaaacttaaaaacccaaccgtaaaccggaaccccttaaacaaacggtttacggggtaacggtttaacgggaaacggggtacgtaccccgttaaggtaaccgaatttcccgtaagggaacccgtaacggacccgggtacccgttacttaaacgtttaccgtggtacggacggtaacggaccggtaccccgacggtacggttacccgggtgaaccggtacccgtaccgggaccacgggttcccggttccgttttacggtaccgttccgggtaccggggg

SEQ ID NO: 208348 - DNA, 708 bp, Homo sapiens
  misc_feature: GYAE6OF02F92PV.17.25.C03.1.454.CMB.1.raw
  modified_base (297)..(297): a, c, t, g, unknown or other
  misc_feature (297)..(297): n is a, c, g, or t
  modified_base (484)..(484): a, c, t, g, unknown or other
  misc_feature (484)..(484): n is a, c, g, or t
  modified_base (617)..(617): a, c, t, g, unknown or other
  misc_feature (617)..(617): n is a, c, g, or t
tcagcgtagactagcacgaccggtgctcgattagtagtgtagattgggtttgggactcaacaccacatctgtcctctagagaaaccctgtgagcacagctcctcaccatggactggacctggaggactcctctcttggtgcagcagctacaagtgcccactcccaggtgcagctggtgcagtctgggctggaggtgaacgtacgcctggggtcctcagtgtacggtcctccgtgccaacgggtccttcgtggacttccacgttaccctccgtattacgtctaccgaacgtggggtcnccgcccgatcccggctgtaccaacgtacgtcggagttacggtacggtggtacgtcggggtacccgaaccccgttaacgaccgttcgggtcgttaccacttacggttcgttccttaccgaccccgtaacgtcccgttaccggggaacctacggtaccttacccgatccgaaccccgaaccgtaacccncccgtaccaaactaacccgaccgacgttacccgtaactagttacggacgtttacgacggtaccgccttacgacctacgttcgacggaacccgaacgtacccggtaccgttaacttacgttaacctgggtaccnccggtaacgtaccgtacccgacgtccggtccgggtacacgtcccggtacggcacgggtcccgggtacctaccggtccgttcggtaccgggg

SEQ ID NO: 208349 - DNA, 571 bp, Homo sapiens
  misc_feature: GYAE6OF02IQB9Q.17.25.C03.1.454.CMB.1.raw
  modified_base (280)..(280): a, c, t, g, unknown or other
  misc_feature (280)..(280): n is a, c, g, or t
  modified_base (362)..(362): a, c, t, g, unknown or other
  misc_feature (362)..(362): n is a, c, g, or t
  modified_base (417)..(417): a, c, t, g, unknown or other
  misc_feature (417)..(417): n is a, c, g, or t
  modified_base (426)..(426): a, c, t, g, unknown or other
  misc_feature (426)..(426): n is a, c, g, or t
  modified_base (479)..(479): a, c, t, g, unknown or other
  misc_feature (479)..(479): n is a, c, g, or t
tcagcgtagactagcacgaccggtgctcgatttagtagtgtagatttgggtttggggactcaacaaccacatctgtccttctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttactcctatagtatcaactgggtncgccaggccgctggacaacgacctgagtggatgggatggggccaaaccctaacacgtggtgtcacgagtgtccttcaccctntcccgtccggggacacgacttaccatcgacccacgaacctcctaccaataaaccncagcctaanagtggagttgaaggacgcctagacatcgtagacgacgacggcctactattacnggtcgacgtagacgtcccacggacgttcccgggtagaccgtacccgtacggccacggtcccggtaccttttggaccgtttcggtaccggggg

SEQ ID NO: 208350 - DNA, 540 bp, Homo sapiens
  misc_feature: GYAE6OF02GDS6H.17.25.C03.1.454.CMB.1.raw
  modified_base (341)..(341): a, c, t, g, unknown or other
  misc_feature (341)..(341): n is a, c, g, or t
  modified_base (420)..(420): a, c, t, g, unknown or other
  misc_feature (420)..(420): n is a, c, g, or t
  modified_base (433)..(433): a, c, t, g, unknown or other
  misc_feature (433)..(433): n is a, c, g, or t
  modified_base (443)..(443): a, c, t, g, unknown or other
  misc_feature (443)..(443): n is a, c, g, or t
  modified_base (473)..(473): a, c, t, g, unknown or other
  misc_feature (473)..(473): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggaccaacgcctgagtggatggggatggggccaaccctaacgactggtntcacagtgtcttcaccccatcccgtccgggacagtaccttaccatgaccacgaacctcctacaataaacacagccctanatggagttgaggncctgacatcngacgacacggccgtactattactgtgcganacgtcccacggactccggtagacgtccgtacggcacggccggtcctttcggaccttcggtacggggg

SEQ ID NO: 208351 - DNA, 527 bp, Homo sapiens
  misc_feature: GYAE6OF02G7Z8F.17.25.C03.1.454.CMB.1.raw
  modified_base (330)..(330): a, c, t, g, unknown or other
  misc_feature (330)..(330): n is a, c, g, or t
  modified_base (341)..(341): a, c, t, g, unknown or other
  misc_feature (341)..(341): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggcaacctaanactggtgtcanagtgtcttcacccatccctcgggacagacttaccatcgaccacgaactcctccaataaacacagcctacatggagttgagacgctgacatctgaccgacacggccgtctattacgtgtgcgagacgtcccaaggtctccgggtgacggcctacggcaggccggtcctttcgtaccttcggtcgggg

SEQ ID NO: 208352 - DNA, 551 bp, Homo sapiens
  misc_feature: GYAE6OF02H7EZV.17.25.C03.1.454.CMB.1.raw
  modified_base (281)..(281): a, c, t, g, unknown or other
  misc_feature (281)..(281): n is a, c, g, or t
  modified_base (467)..(467): a, c, t, g, unknown or other
  misc_feature (467)..(467): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtgatgggatgggcgaacctacactggtgtcacagtgtcttcacccatccctccgggacagacttaccatcgaccacgaacctccctaccaactaaaacacagcctaacatggattggaggagcctgacatcgtagacgacacgggtcctctaatttacngtcgcgagtacgtccccagacgttccggtaggacgcccgtacggccaggtcccggtccttttacggaccgtttccgtcgggggg

SEQ ID NO: 208353 - DNA, 699 bp, Homo sapiens
  misc_feature: GYAE6OF02JU2GF.17.25.C03.1.454.CMB.1.raw
  modified_base (228)..(228): a, c, t, g, unknown or other
  misc_feature (228)..(228): n is a, c, g, or t
  modified_base (258)..(258): a, c, t, g, unknown or other
  misc_feature (258)..(258): n is a, c, g, or t
  modified_base (267)..(267): a, c, t, g, unknown or other
  misc_feature (267)..(267): n is a, c, g, or t
  modified_base (279)..(279): a, c, t, g, unknown or other
  misc_feature (279)..(279): n is a, c, g, or t
  modified_base (374)..(374): a, c, t, g, unknown or other
  misc_feature (374)..(374): n is a, c, g, or t
tcagcgtagactagcacgaccggtgctcgatttagtagtgtagatttgggtttggggtacgtcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgagagcctgggcctcagtgaaggtcncctgcaaggcttctggattcacgtttaccncctatagtntcaacgtgggtncgccaggccgcgtggacaacgacctggagtcggatgggagtgggccgaaaccctacgacgtgggtacgtcacgaggttgtcttaccgaacccctntcccggtccgggactacggtaccttaccatacgacctaccgaacctcccgtaccaataaacctacaccggtacctacaacgtcggtacgttacggacggtacgacccgtagacctaacgtcgtacggaccgtaccgtaaccgggccccgttaacgttacgtttaaaccccgtgggtaccggtaccgggtaagtacccgggttacccgaaccgggttaaccggtcccggggttaaggtaacccggaccccggttaacccggggccgtaacccggggtccccggttacccggttttacggttacccgttacccgggttcccgggggg

SEQ ID NO: 208354 - DNA, 567 bp, Homo sapiens
  misc_feature: GYAE6OF02GAEBN.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcaccccatcccgtccgggacagacttaccatcgaaccacgaacctcctaccataaaccacagccctacagtcggagttgaaggcgccctgacatctggacgaccgacggccgttctaattactggtacgcgacgagtccccaacggtacttcccgggtagaccgtcccgttaacgggctacggccgggtacccttttggacctttcggtaccggggg

SEQ ID NO: 208355 - DNA, 553 bp, Homo sapiens
  misc_feature: GYAE6OF02JKOT5.17.25.C03.1.454.CMB.1.raw
  modified_base (418)..(418): a, c, t, g, unknown or other
  misc_feature (418)..(418): n is a, c, g, or t
  modified_base (498)..(498): a, c, t, g, unknown or other
  misc_feature (498)..(498): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctggagtggatgggatggggtgaaccctaagactgggtcgtcacgaggtgtcttcacccatcccgtcgggacagacttaccatcgaccacgaactcctcaataaacacagcctaantggagttgaagcgcctgacatcagacgacacggcctacttatacgtgtagacgacgtacgtacccaaggtactcgggtanacggaccgtaacgggcaacgggtccgtaccgttttcggacgtttccggaccgggg

SEQ ID NO: 208356 - DNA, 540 bp, Homo sapiens
  misc_feature: GYAE6OF02F53DR.17.25.C03.1.454.CMB.1.raw
  modified_base (439)..(439): a, c, t, g, unknown or other
  misc_feature (439)..(439): n is a, c, g, or t
  modified_base (464)..(464): a, c, t, g, unknown or other
  misc_feature (464)..(464): n is a, c, g, or t
  modified_base (470)..(470): a, c, t, g, unknown or other
  misc_feature (470)..(470): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcaccccatcccgtccggggacacgaccttaaccatcgaccacgaacctcctaccaataaaccacagccctacatacggagttgaggacncctgacatcagacgacacggccgtntattcngtcgcgagcgtcccagtactccggtagacgccgtacggcacggtccggtacctttggaccttcgtcgggg

SEQ ID NO: 208357 - DNA, 531 bp, Homo sapiens
  misc_feature: GYAE6OF02FQHA5.17.25.C03.1.454.CMB.1.raw
  modified_base (280)..(280): a, c, t, g, unknown or other
  misc_feature (280)..(280): n is a, c, g, or t
  modified_base (332)..(332): a, c, t, g, unknown or other
  misc_feature (332)..(332): n is a, c, g, or t
  modified_base (407)..(407): a, c, t, g, unknown or other
  misc_feature (407)..(407): n is a, c, g, or t
  modified_base (444)..(444): a, c, t, g, unknown or other
  misc_feature (444)..(444): n is a, c, g, or t
  modified_base (453)..(453): a, c, t, g, unknown or other
  misc_feature (453)..(453): n is a, c, g, or t
  modified_base (496)..(496): a, c, t, g, unknown or other
  misc_feature (496)..(496): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatggggatgggcgaaccctaanactggtgtcacagtgtcttcacccatcctccgggacagaccttaccatcgaccacgaactcctaccaataaaccncagccctaacatggagttgaggacgcctagacattcngacgtaccncggcccgtatattactggtgcgagacgtcccagactccgggtnacgcctagtcggctaggcggtcctttgacttcggg

SEQ ID NO: 208358 - DNA, 552 bp, Homo sapiens
  misc_feature: GYAE6OF02G1JJR.17.25.C03.1.454.CMB.1.raw
  modified_base (279)..(279): a, c, t, g, unknown or other
  misc_feature (279)..(279): n is a, c, g, or t
  modified_base (328)..(328): a, c, t, g, unknown or other
  misc_feature (328)..(328): n is a, c, g, or t
  modified_base (429)..(429): a, c, t, g, unknown or other
  misc_feature (429)..(429): n is a, c, g, or t
  modified_base (501)..(501): a, c, t, g, unknown or other
  misc_feature (501)..(501): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtncgccaggccgctggacaacgacctgagtggatgggatgggcaaccctanactggtgtcacagtgtcttcacccatcccgtcgggacagaccttaccatcgaccacgaacctccaccaataaaccacacgcctacagtggtagttgaggcncctgacatcgagaccgacgaccggtccttatacttacgtgtcgcgagaccgtcccgacgtacgtccgggtanacggtcccgtacggcgacggtccggtaccttttggaccgttcggtacgggg

SEQ ID NO: 208359 - DNA, 933 bp, Homo sapiens
  misc_feature: GYAE6OF02GPXZW.17.25.C03.1.454.CMB.1.raw
tcagcgtagactagcacgaccggtgctcgatttagtagtgtagatttgggtttgggactcaacaaccacatctgtcctctagagaaaaccctgtgagcacagctcctcaccatggactggacctggaggatctcttctggtggcagcagctacaagtgcccatccaggtgcagctggtgcagtctgggctgagtgaagagcctgggcctcagtgaaggtctcctgcaaggtcttcgtggtacttcgacggttttacctccgtaattaggttactcgtaaaccgttggggttcaccggtccaagggtcccgtacgttacgggtaacctaaaccggtacccgttaggaacgttcgggtaacgttcggggtaacgttcggggaccgtaaaccccgttaacgtaccggttacgggtacgttaccgaacgttaacggttcgttacccttacgtaaccccgttacgttacccggttacccggggaacttacgggtaacccttttaacccgaacgttaccggtaacccgtaacggtaaaccccgtttcccgttaaacccggtaaacgttaaaacccgtaaccgtaaccggttaccccgttaaaacgtaaccggttttaaggggtaacccggtttttacgggaaacccgggtttaccggttaccccgtttaagggttaaacccttacgggtttacccgtaacgggttaaaccccggtaaccgttaacccggggttacccgtttacgtttaaccggtttaaccgttcgggtaaccgggttaacccggtacgggttaacccggtttaccccggttaacggtaacccggttttacccgggtacgggttaacccgttaccccgggtttaacgggtaccccggttacggttacccgggttaccggttttttaccgggaacccggttttaccgggtaacccgggggg

SEQ ID NO: 208360 - DNA, 531 bp, Homo sapiens
  misc_feature: GYAE6OF02G4F36.17.25.C03.1.454.CMB.1.raw
  modified_base (408)..(408): a, c, t, g, unknown or other
  misc_feature (408)..(408): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatcgaccacgaactcctaccaataaaccacanccctacatggagttgaggacgcctgacatctagacgacacggccgtctacttactgtcgcgagcgtcccagctccggtgacgccgtacggctacggccggtcctttgaccgttggtaccgggg

SEQ ID NO: 208361 - DNA, 701 bp, Homo sapiens
  misc_feature: GYAE6OF02JERTY.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtacccactcccaggtgcagctggtgcagtctggggctgaggtgaagaagcctggggcccagtgaggtacgtcctcgtcgaacggacgttcttggagttactacgtttaccgttcctactagtatcaactaggtggcaccacggaccggctcggtacgaacgaaccgtcgtagcggtagtagggtaggtaggacggaaccctaaaccgtacgtacgggttggtactaccgaagttacggtccgtttcctacccgaacctcccgttacccgggacgacgaacttacccaactacgaccaaccgaacctcctacctaactaaaacaaccacgcctaacctactagggtacggttagagggaacgtccgtacgtaacacttacgtacggtaaccggaaccctaccgggacccggttctttaacgttacgttagggttcgacggtaacgtacgtaccccgtaccgacggttaccgggttcggaacggccctaaccggacggagtcccgggtcttttcggacctttcggttcgggggaccggtacggg

SEQ ID NO: 208362 - DNA, 703 bp, Homo sapiens
  misc_feature: GYAE6OF02HDTXD.17.25.C03.1.454.CMB.1.raw
  modified_base (204)..(204): a, c, t, g, unknown or other
  misc_feature (204)..(204): n is a, c, g, or t
tcagcgtagactagcacgaccggtgctcgatttagtagtgtagatttggggtttggggggagtcagtctcagtcagggacacagcatggacatgacgggtcccgctcacgctcctgggctcctgctactctgctccgagctgccagatgtgacatccagatgacccagtcctccagtcctcctgtctgcctctgtggggtcagngtcacatcacttgccggaacaagtcacggacgttaaaacctatttaaatggtatcagcaagaaacctaggaaacgccccagacctcctagtactactacgtggtgacactccactcgtggacgaacggtcggaccgtccctagtcgtaggttcaggtggctaggtaggaatcgtagggactaggttaacttttaccaaattccgtaacgtaacctaacgttacccaaccgtacgttacgtacggaacccgtaaaccgtgggtaaacggttacgttttcggtacgtactaaacgtttccctaaacgtttaacctacggtaaccaaacgtacgttaacggtttaacgtacccgtttcccgttacggttccgtttaacggttttaccgggaccgtaacggggttaacctaaacgggtttcgaaggtaactaaccgaaaacggtaaccgttcggtaccggtaccctacggccctaaccgtacgtttccggttaccgtttaccc

SEQ ID NO: 208363 - DNA, 515 bp, Homo sapiens
  misc_feature: GYAE6OF02IDFE8.17.25.C03.1.454.CMB.1.raw
  modified_base (280)..(280): a, c, t, g, unknown or other
  misc_feature (280)..(280): n is a, c, g, or t
  modified_base (331)..(331): a, c, t, g, unknown or other
  misc_feature (331)..(331): n is a, c, g, or t
  modified_base (398)..(398): a, c, t, g, unknown or other
  misc_feature (398)..(398): n is a, c, g, or t
  modified_base (400)..(400): a, c, t, g, unknown or other
  misc_feature (400)..(400): n is a, c, g, or t
  modified_base (403)..(403): a, c, t, g, unknown or other
  misc_feature (403)..(403): n is a, c, g, or t
  modified_base (473)..(473): a, c, t, g, unknown or other
  misc_feature (473)..(473): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtgatgggatgggcgaaaccctaanacgtggtgtcacagtgtcttcacccatccctcgggacagacttacatcgaccagactctcataaacnancantgattgagagcctgacatcgagacgacgacgcgtactatctgcgacgagacgtcccacggtaactccggngacgtacctacggcaggccggtcctttgaccgttcgtcgggg

SEQ ID NO: 208364 - DNA, 596 bp, Homo sapiens
  misc_feature: GYAE6OF02GC3MX.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgcctgagtggatgggatgggcaaccctaacactggtgtcacagtcgtcttcacccatcctccgggacagacttaccatcgaccacgaacctcctaccaataaaccacagaccctaacagtcggtaagttggaaggacgtccctagtaccattccgtacggaaccgaacccgtacgggtcccgttactaacgtttaccgtggtcgacgacgtaccgtaccccgacggtactcccggggtagacggtacccgtacggcgacggtcccggtaccttttcggaccgtttcggtaccggggg

SEQ ID NO: 208365 - DNA, 596 bp, Homo sapiens
  misc_feature: GYAE6OF02GGB4R.17.25.C03.1.454.CMB.1.raw
  modified_base (330)..(330): a, c, t, g, unknown or other
  misc_feature (330)..(330): n is a, c, g, or t
  modified_base (414)..(414): a, c, t, g, unknown or other
  misc_feature (414)..(414): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctctatagtatcaactgggtgcgccaggccgctggacaacgacctgagtggatgggatgggccgaaccctaanactggtgtcacagtgtccttccacccatcccgtaccgggacacgtaccttaccatcgaccacgaacctccctaccaataaaccncacgaccctacatggagttgaggtacgcctagacactcgtacgaaccgaccgacggtcccgttacttacgttacctggtacgccgagtaccgtaccccgaacggtcgtacccgggtagaaccggtcccgtaacgggccgtacggtcccggttccctttggtaccgtttccgggtaccggggg

SEQ ID NO: 208366 - DNA, 547 bp, Homo sapiens
  misc_feature: GYAE6OF02FUCT2.17.25.C03.1.454.CMB.1.raw
  modified_base (274)..(274): a, c, t, g, unknown or other
  misc_feature (274)..(274): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaacnccccagacctcctgatctctggtgcatccactctgcgaagtgcgtcccatcgagttcagtggcagtggatcgtgggacagtatttcaatctcacactcaccactctcgcaacctgacggtattgtgacaatctaactactctacaactagtacgttactacgttcccctacgtctacttttcggaccgtaacggggtaacctaagttcgaagtaactaaccgaaacgtaacgtggtacggtaccgttcgacctacctacttaccttgttaccc

SEQ ID NO: 208367 - DNA, 681 bp, Homo sapiens
  misc_feature: GYAE6OF02JVXH3.17.25.C03.1.454.CMB.1.raw
  modified_base (278)..(278): a, c, t, g, unknown or other
  misc_feature (278)..(278): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctgggcctcagtgaaggtctcctgcaaggcttctggattcacgtttacctcctatagtatcaacgtgggtncgccaggccgctggacaacgacctgagtggagtgggagtgggaccgaaccctaacgacgttgggtgtaccgacgtaggttcgtcctttaccacccgtacttcccgtacccggggacacggtaaccttaccgatcgaacccgaccgtaacctccctaccgaaactaaaccaccagaccctaagacgtcggaacgttcgaagggacgcctaggacctacgtacgtacggaaccgacccgaccgggtcccggttacttaacgtttaccgtcggttacggaccgtaaggtacccgtccccgtaaccggtacggttacccggtacggtaacccggtacccggtaccgggaccgtaccgggtacccgggttaccctttttacggacccgtttcccgggtaaccgggggg

SEQ ID NO: 208368 - DNA, 575 bp, Homo sapiens
  misc_feature: GYAE6OF02F67X3.17.25.C03.1.454.CMB.1.raw
  modified_base (278)..(278): a, c, t, g, unknown or other
  misc_feature (278)..(278): n is a, c, g, or t
  modified_base (335)..(335): a, c, t, g, unknown or other
  misc_feature (335)..(335): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaaggcttctggattcacgtttacctctatagtatcaactgggtncgccaggccgctggacacgacctgagtggatgggatgggcgaaccctacgactggtntcacagtgtcttcacccatcctaccggggacagtaccttaccatcgacccacgaacctccctaccaataaaccacaacgcctaacagtaggtagttagaggacgccgtgacctagtacctggaaccgcgaaccgggtccgtacttattaaccgtggtgacgacgtacgtcccgaacggtacgtccggtagacgcccgttacggctacggtcccgtcgtttacgtacgttcgtaccggggg

SEQ ID NO: 208369 - DNA, 541 bp, Homo sapiens
  misc_feature: GYAE6OF02FLHA3.17.25.C03.1.454.CMB.1.raw
  modified_base (397)..(397): a, c, t, g, unknown or other
  misc_feature (397)..(397): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaacgccccagacctcctgatctctggtgcatccactctgcgaagtggcgtccatcgaggttcagtggcagtggatcgtgggactagatttcaatctacacatcaccactctgcaacctgaggatgtnacaattctactactgtacaacagagttaccacgtttccccgtcgcctacgttttcggaccgtaaggggtaccaacgttggagtaactaccgaaaacggtaacgttcggtacggtaccttggacctaaccctatccgtgttaccc

SEQ ID NO: 208370 - DNA, 537 bp, Homo sapiens
  misc_feature: GYAE6OF02ID0HB.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctaggaaaacgccccagacctcctgatctctggtgcatccactctgcgaagtcggcgtccatcgaggttcaggtggcagtggatcgtagggacagtactttcaatctacactactccaacctctctgaccaacgtgagtatgtgacatctactactcgtacaacgagtacgttactcgttccctcgtcttaccgtttcggaccgagggtaccaggttagacgaataccgaaacgtaacgtgttaggcgtcggacctaccgtagtccgtgtacc

SEQ ID NO: 208371 - DNA, 514 bp, Homo sapiens
  misc_feature: GYAE6OF02F6H5Z.17.25.C03.1.454.CMB.1.raw
  modified_base (260)..(260): a, c, t, g, unknown or other
  misc_feature (260)..(260): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttaccncctatagtatcaactgggtgcgccaggccgctggacacgacctgagtggatgggatgggcgaacctacactggtgtcacagtgtcttcacccatcctccgggacagacttaccatgaccacgaactcctccataaacacagcctacatggagttgaggagcctgacatctgacgacacggccgtctattactgtgcgagcgtcccgacgatccggtgagcctacggcgagccggtcctttgaccttcgtcgggg

SEQ ID NO: 208372 - DNA, 592 bp, Homo sapiens
  misc_feature: GYAE6OF02HUWER.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctgggcctcagtgaaggtctcctgcaaggcttctggattcacgtttactcctatagtatcaactgggtgcgccaggccgctggacaaccgacctgagtggatgggatggggaccgaaacccctaacgacgtggtcgtacacgagttcgtcctttccaacccctacttcccgtacccggggaactacggtaccttacccaagtcgaacccaacgtaacctccctaccaactaaaccacaacgaccctaacgataggagtttaggaggacgtccgtagactatctagaaccgacgaccggtccgtactacttacgtgtcgcgagacgtcccgacgtcgtccggtagcgtccgtacggcacggccgtcctttcgaccttcggtcgggg

SEQ ID NO: 208373 - DNA, 573 bp, Homo sapiens
  misc_feature: GYAE6OF02IAZ6M.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaacctatttaaattggtatcagcagaaacctggaaaacgccccagacctcctgatctctggtgcactccactctgcgaagtcgctccatcgagttcagtgcaggtgatcgtgggacagtatttcaatctacactatccaccactctacgactaaccgtgaaggtcttggtcgactaagttcttaacttacgttgtaaccaacgtaacggtaacggtttacctaccggtttacccctggtccttaacgtttcggaaccgtacggggaacctaaggttacgagtaacttaacgaaacgtacgttgtacggcttacgaccaccgtcttccgtgttccc

SEQ ID NO: 208374 - DNA, 621 bp, Homo sapiens
  misc_feature: GYAE6OF02HRW4U.17.25.C03.1.454.CMB.1.raw
  modified_base (460)..(460): a, c, t, g, unknown or other
  misc_feature (460)..(460): n is a, c, g, or t
  modified_base (513)..(513): a, c, t, g, unknown or other
  misc_feature (513)..(513): n is a, c, g, or t
  modified_base (555)..(555): a, c, t, g, unknown or other
  misc_feature (555)..(555): n is a, c, g, or t
tcagcgtagactagcacgaccggtgctcgatttagtagtgtagatttgggtttggggactcaacaaccacatctgtcctctagagaaaaccctagtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattctacgtttactcctatagtatcaactgggtgccgcaggccgctggacaacgacctgagtggagtgggagtgggaccgaaaccctaacgacgtgggtgtcacgtagtcgtcttccaccctatcccgtccgggaacacgtaaccttaccatacgaccaacgaacctccctaccaataaaccacacgtaccctacatgggagttgaagggacncctaggaactattccgtagaaccggaccgaccgggtccttactattttaccgnggtcgacgaggtaccgttccccgaaggtacgttcccgggtanaccggtacccctagggacccacggggtcccggttacccgttttggacccgtttccgggtacggggg

SEQ ID NO: 208375 - DNA, 597 bp, Homo sapiens
  misc_feature: GYAE6OF02GTWNG.17.25.C03.1.454.CMB.1.raw
  modified_base (401)..(401): a, c, t, g, unknown or other
  misc_feature (401)..(401): n is a, c, g, or t
  modified_base (434)..(434): a, c, t, g, unknown or other
  misc_feature (434)..(434): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatggggaccgaaccctaacacgtggtgtcacgagtgtcttcacccatcccgtcgggacacgacttacatcgaccacgaacctccnccaataaccacacgcctacatggagttgaggancctgacatctgaaccgacaccgggtcccgttacttacgtttactggtcgacggtacgaccggttccccaaggtacgttcccgggtaggaacccgtcccggttaaccgggaccgtacgggtcccgggttaccctttttcggacccgttttcgggtacccggggg

SEQ ID NO: 208376 - DNA, 978 bp, Homo sapiens
  misc_feature: GYAE6OF02HVW93.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagagccgtgggcctcagtgaacggtctccgtgcgaaggtcttacgtggtactttcgtaccgttttacctaccttaatagttactacctaaacgttggggtctccggccgtaacgggcccggtacgttacggggaacctaaccggaccgttaggacggttacggtaaggttcgggggacgttcgggggaacccggtaaaccccgttaacgtaccggttgggtcgttaccgtaaccgtacggtttcgttaccttaccgtaacccccgtaaattccccggtaacccgggggtacctaacggttaacccgtttaacccgaacgtttaccgaaacccgtaacccgttaaaccgtcccccttaacccgtaaacttaaaaacccgtaacccggtaaccgtaaccccgttaacgtaacgtttaacggggtacgttttacggggaaacgggttaaccggtaccccgttagggtaaaccctacggtttacccgtttaaccgggaaaccggtaaccggttaaccccggggtttacccggtttaaccgtttaaccggtttttaaacccggttagggttaacccgggtacccgggttaaaccggtaacccgggtttaccccccggaacggtttaacccggggttaccccggggtttaacgaacccggggttaacccccggttaacccggggggtacccgttaaccgggggttcccccggggttttaaacccccggtttttcggggtttacccccggtttttaacggggttaacccccgggggggg

SEQ ID NO: 208377 - DNA, 620 bp, Homo sapiens
  misc_feature: GYAE6OF02HVMFN.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgcaaggcttctggattcacgtttacctcctatagtatcaactgggtgcgccaggccgctggacaacgacctggagtggatggggatggggaccgaaccctaacgacgtggtcgtcacagtcgttcttcaacccagtccgtccgggacacgaccttaccatcgaccaacgaactccctaccaaataaaccacaacgacctaacgaacgtggaagttcggaaggacgtcctaggaccagtctaggaaccgaccgaaccgggtccgtacttaacttacgtgttcgacggtaacgacgttaccccaacggacgttcccgggtaggaccgtacccgttacgggcgaacggtcccggttacccttttacggaccgtttccgggtaccggggg

SEQ ID NO: 208378 - DNA, 542 bp, Homo sapiens
  misc_feature: GYAE6OF02G3S4Y.17.25.C03.1.454.CMB.1.raw
  modified_base (330)..(330): a, c, t, g, unknown or other
  misc_feature (330)..(330): n is a, c, g, or t
  modified_base (429)..(429): a, c, t, g, unknown or other
  misc_feature (429)..(429): n is a, c, g, or t
  modified_base (465)..(465): a, c, t, g, unknown or other
  misc_feature (465)..(465): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggcaaccctanacgtggtgtcacagtgtcttcacccatcctccgggacagacttaccatcgaccacgaacctcctaccaataaacacacgcctacatggagttgaggacnctagacatctagacgacgacggtccgtactattacngtcgcgagacgtacccacggtactccggtgacgcccgtacgggccgagccggtcctttggaccgtttcggtacgggg

SEQ ID NO: 208379 - DNA, 554 bp, Homo sapiens
  misc_feature: GYAE6OF02GJRXN.17.25.C03.1.454.CMB.1.raw
  modified_base (452)..(452): a, c, t, g, unknown or other
  misc_feature (452)..(452): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattcacgtttacctcctatagtatcaactgggtgcgccaggccgcgtggacaacgacctgagtggatggggatgggaccaaccctaacacgtggtgtcacgtagtcgtccttccaccctactccgtccgggacacgaccttaccatcgaccacgaactcctaccaataaacacacacctacagtcggagttgaggagcctgactntctagacgacgaccgccgttactacgttactgtcgacgagacgtcccacgtacgtccggtagacgtcctacggcacggccgtctttacgacgttcgtcgggg

SEQ ID NO: 208380 - DNA, 525 bp, Homo sapiens
  misc_feature: GYAE6OF02I0E8G.17.25.C03.1.454.CMB.1.raw
  modified_base (405)..(405): a, c, t, g, unknown or other
  misc_feature (405)..(405): n is a, c, g, or t
  modified_base (424)..(424): a, c, t, g, unknown or other
  misc_feature (424)..(424): n is a, c, g, or t
  modified_base (459)..(459): a, c, t, g, unknown or other
  misc_feature (459)..(459): n is a, c, g, or t
  modified_base (472)..(472): a, c, t, g, unknown or other
  misc_feature (472)..(472): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggacgaaccctaacacgtggtgtcacagtgtccttcacccatcccgtccgggacacgacttaccatgaccacgactcctcataaacnacgctacatgagttgagancctgacatctgacgacacggtcctctattctgcgngagcgtcccacgntccggtgacgtcccgtacggctacggccgtcctttcgaccgttcgtccggggg

SEQ ID NO: 208381 - DNA, 837 bp, Homo sapiens
  misc_feature: GYAE6OF02GJRPM.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtccctcgtcgacgacgtcttcgtaggtcttacgttaccgtttacctactaagtagtactactacggttggtcgccgacgtacggcccgtcggtacggaaaccgaaccgtaccgtaggtacgggtaggtaggtagggtagggtaccgggaaacccgtaaaccccgtaaacgtcggttagggttaccgtaccgaacggttacggttccgtttacccttaccccgaacccgttacccgttccccgggtaacccggtaaccgtaaccgttaacccttaaaccgtacgtaaccgaacccgtaaaccgtaccccttacccctaaaccgaaaactaaaacccgaaccggtaaccctaacccgtaaagccgggttaagggttaacggttaacgggaaacgggtacccgtccgtaagtaaaccgtccgttaccggaaccgaacccggtaacccgggtcccggttaaccctttaacgtttaccgttacggtacggaccgtaacggtaaccgtacccgacccgtaagggtccccgggttacggacggtaaccccggttcggacccgacgggtccggttacccggtttaccgttaccgttacggttcccgggggtacccggg

SEQ ID NO: 208382 - DNA, 545 bp, Homo sapiens
  misc_feature: GYAE6OF02IEU8E.17.25.C03.1.454.CMB.1.raw
  modified_base (281)..(281): a, c, t, g, unknown or other
  misc_feature (281)..(281): n is a, c, g, or t
  modified_base (293)..(293): a, c, t, g, unknown or other
  misc_feature (293)..(293): n is a, c, g, or t
  modified_base (332)..(332): a, c, t, g, unknown or other
  misc_feature (332)..(332): n is a, c, g, or t
  modified_base (339)..(339): a, c, t, g, unknown or other
  misc_feature (339)..(339): n is a, c, g, or t
  modified_base (343)..(343): a, c, t, g, unknown or other
  misc_feature (343)..(343): n is a, c, g, or t
tcagcgtagactagcacgaccggtgctcgatttagtagtgtagatttgggtttggggactcaacaaccacatctgtcatctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgttttacctcctatagtatcaactgggtncgccaggcccgntggacaacgcctgagtggatgggatgggacaaccctaanactggtntcanagtgtcttcaccatccgtccgggactagacctttaccagtcgaacccacgtaacctccctaccaataaacacacgacctacatggagttagaggacgctagacatctagacgacgacggccgtactattacgtgtcgcgagacgtcccgacgacttccggtagacgccgtacggctacggccggcctttacggacttccggg

SEQ ID NO: 208383 - DNA, 563 bp, Homo sapiens
  misc_feature: GYAE6OF02F8VBC.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactggtgcgccaggccgctggacaacgacctgagtggatgggatgggacgaaccctaacgacgtggtgtcaacgagttgtccttccaccctactccgtccgggacacgacttaccatcgaccacgacctcctaccaataaacacacgcctacagtaggagttggaggagcctgacagtcgtagaccgacgaccggtcctacgttaattacgtggtcgcgtaagtcgtcccaaggtcgtccggtagacgtccgtacggcgacggcggttccttcggtaccgttcggtccgggg

SEQ ID NO: 208384 - DNA, 535 bp, Homo sapiens
  misc_feature: GYAE6OF02FGLT7.17.25.C03.1.454.CMB.1.raw
  modified_base (279)..(279): a, c, t, g, unknown or other
  misc_feature (279)..(279): n is a, c, g, or t
  modified_base (432)..(432): a, c, t, g, unknown or other
  misc_feature (432)..(432): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtncgccaggccgctggacaacgacctgagtggatgggatggggcgaaccctaacactggtgtcacagtgtcttcacccatcctccgggacagaccttaccatcgaccacgaactccctaccaataaaccacagccctaacatggagttgaggacncctgacatcgtgacgacacggcctattattactgtgcgagtacgtcccagtacgtccggtgacgccgtagggcacggccggtcctttcgaccttcggtcgggg

SEQ ID NO: 208385 - DNA, 632 bp, Homo sapiens
  misc_feature: GYAE6OF02IXDAU.17.25.C03.1.454.CMB.1.raw
  modified_base (219)..(219): a, c, t, g, unknown or other
  misc_feature (219)..(219): n is a, c, g, or t
  modified_base (244)..(244): a, c, t, g, unknown or other
  misc_feature (244)..(244): n is a, c, g, or t
  modified_base (260)..(260): a, c, t, g, unknown or other
  misc_feature (260)..(260): n is a, c, g, or t
  modified_base (279)..(279): a, c, t, g, unknown or other
  misc_feature (279)..(279): n is a, c, g, or t
  modified_base (343)..(343): a, c, t, g, unknown or other
  misc_feature (343)..(343): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctnagtgaaggtctcctgcaaggcttcnggattcacgtttaccnctatagtatcaactgggtncgccaggccgctggacaacggacctgagtggagtgggatggggccaaaccctaacacgttggtntaccacaggttcgtcttcaccctatcccgtaccggggacacgtaccttaccgaatcgaacccaaccgtaaccttccctaccaaactaaaaccacctaacgaccctaacagtaggaacggtttcggaaggacgccgttagacactcgtagaacccgacgaccggtaccgtacttaactttacgtacggtcgacgggaggacgtaccccgtaacggtacgttcccgggtagtaccgaccgtaccggcgacgggtcccggtccgttttacggaccgtttccggtaccggggg

SEQ ID NO: 208386 - DNA, 839 bp, Homo sapiens
  misc_feature: GYAE6OF02H6N6A.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctggggcctcagtgaaggtctcctgcaaggcttcgtggattcacgttttacctccttatagtatcaacgttgggtgcgccgacggccgcgtaggacaacgacctggagtggagtgggagtcggggaccgaaacccgtaacacgtcgggtgtaccgaaccgtaggttcgttcttaccaacccctaacgttcccggtaccgggggaacctaacgggtaaccctttaacccgagtttacgaaccccgtaaaccggtaacccttacccccttaaccctaaacttaaaaacccaaccgtaaaccggtaccctaaaccgtaaggtttacgggtaacggtttaggaacgggtaacggtacccgttagggaacctaacgttacccgttaacgggaaccccggtaaccgtaaaccccggggttccccggttaacccgtttaaacgttttaaccgttcgggttaaccgggtaccggtaaacggggtaccccgttaacccccgtaaccggggttaaccggttaccccgggggttaacgggtaacccggttaccccggttaacccggggccggttaacccggggtcccgggttttacccccgttttacgggttaaccccggttttcggggtaaccccggggggg

SEQ ID NO: 208387 - DNA, 604 bp, Homo sapiens
  misc_feature: GYAE6OF02GVZEG.17.25.C03.1.454.CMB.1.raw
  modified_base (330)..(330): a, c, t, g, unknown or other
  misc_feature (330)..(330): n is a, c, g, or t
  modified_base (345)..(345): a, c, t, g, unknown or other
  misc_feature (345)..(345): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgcctgagtggatgggatgggcgaaccctaanactggtgtcacagtntcttcacccatcctcgggacagacttaccatgaccacgaacctcctaccaataaacacacgcctaacactggagttagaggagcctggaaccataccgtaggaacccgtaccgaaccgggtcccgttcttaaacgttaccgtggttcgccggtaagacgttcccccgaacggtaacgttcccgggtagaaccgtcccgttaacgggccgtaacgggcccggttacccgtttttacggacccttttcggtaccggggggg

SEQ ID NO: 208388 - DNA, 644 bp, Homo sapiens
  misc_feature: GYAE6OF02I0XXY.17.25.C03.1.454.CMB.1.raw
  modified_base (284)..(284): a, c, t, g, unknown or other
  misc_feature (284)..(284): n is a, c, g, or t
  modified_base (346)..(346): a, c, t, g, unknown or other
  misc_feature (346)..(346): n is a, c, g, or t
  modified_base (435)..(435): a, c, t, g, unknown or other
  misc_feature (435)..(435): n is a, c, g, or t
  modified_base (460)..(460): a, c, t, g, unknown or other
  misc_feature (460)..(460): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaaggtctcctgcaaggcttctggattcacgtttacctcctatagtactcaacgtgggtnccgccaggccgctggaaccaaccggacctgacgtggatcgggagtgggaccgtaaccctaanacgtggtcgtacacgtagtgtccttacacccagtccgccgggacagtaccttaccagtcgaaccaacgtacctaccaccaaactaaacnccagcctaacatcggattgagtacncctagaccatcgtagaccgtacgaccggtccgttacttaaagttcgtaggtcgaacggtcggtaacccttccccgaacgggtacgtttacccgggtagaaccgggtttacccccgtaaggggtccctaacggggtcccccggtttaccgtttttacggaaccgtttcccgggttaccggggggg

SEQ ID NO: 208389 - DNA, 553 bp, Homo sapiens
  misc_feature: GYAE6OF02HQM7L.17.25.C03.1.454.CMB.1.raw
  modified_base (333)..(333): a, c, t, g, unknown or other
  misc_feature (333)..(333): n is a, c, g, or t
  modified_base (440)..(440): a, c, t, g, unknown or other
  misc_feature (440)..(440): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaagggcttctggattcacgtttacctcctatagtatcaactgggtgcgccaggccgctggacaacgacctggagtggatgggatgggcgaaccctaancgtggtgtcacagtgtcttcaccctatccctcgggacagacttaccatcgaccacgaactcctaccaataaacacagcctacatggacgttgagagcctagacatcngacgacaccggctcgtattacgtgtcgcggtagacgttccccaacggtacgtcccggtagacgtcccgtacgggccaaggccggtcccttttaggaccgtttcgtaccggggg

SEQ ID NO: 208390 - DNA, 576 bp, Homo sapiens
  misc_feature: GYAE6OF02IYZB7.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctggggcctcagtgaaggtctcctgcaaggcttctggattcacgtttacctcctatagtatcaactgggtgcgcaggccgctggacacgacctggagtggatggggatggggcgaaccctaacactggtgtcacagtgtcttcacccatcctccgggacagacttaccatcgaccacgaactccctcaataaacacagcctacatggagttgacggagcctagaccagttctaggaacgaccgaccgggccgttcttaatttacgtggttacgcgtagacgtccccgaacggtcgttacccgggtacgacggccccgttaacgggcctacggtcccgggtccttttagggacctttccggtaccggggg

SEQ ID NO: 208391 - DNA, 535 bp, Homo sapiens
  misc_feature: GYAE6OF02GDNHZ.17.25.C03.1.454.CMB.1.raw
  modified_base (299)..(299): a, c, t, g, unknown or other
  misc_feature (299)..(299): n is a, c, g, or t
  modified_base (340)..(340): a, c, t, g, unknown or other
  misc_feature (340)..(340): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtncatccactctgcgaagtggcgtcccatcgaggttcagtgcngtggatcgtgggacagtatttcaatctcacatcaccactctcgcaacctgaggtattgtagctaatctactactgtacaactagtagttacctacgttcccctcgtcttacgttttcggaccgtacggggtaacctaaggttgaagtactacgaaacgtaactaggtgcgtacggacctaccgtacttctgttcc

SEQ ID NO: 208392 - DNA, 585 bp, Homo sapiens
  misc_feature: GYAE6OF02HIW3J.17.25.C03.1.454.CMB.1.raw
  modified_base (434)..(434): a, c, t, g, unknown or other
  misc_feature (434)..(434): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatggggcgaaccctaacactggtgtacacagtgtcttcacccatccgtccgggacagacttaccatcgaccacgacctcctaccaataaaccacacgacctacatgggagttggaggngcctgacatctagaccgacaccggtcctacttacttacgtgtcgcgacgacgttccccaacggtacgttcccgggtagaaccggtacccctacggggcctacgggtcccgggttaccccttttacgggtaccctttcgggtacccgggggg

SEQ ID NO: 208393 - DNA, 619 bp, Homo sapiens
  misc_feature: GYAE6OF02GR2GM.17.25.C03.1.454.CMB.1.raw
  modified_base (413)..(413): a, c, t, g, unknown or other
  misc_feature (413)..(413): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccgagccgctggacaacgcctgagtggatgggatgggacgaaccctaacgactggtgtcacagtgtcttccacccactccgtccgggacacgacttaccatacgaccacgaacctcctaccaactaaaccncaacgtcctaacacgtaggaggttggagggacgccgtagacctattacgtcggaaccgaaccgaccgggtcccgttacgttaacgtttacgtggttacgacgaacggtacgtaccccgtacggtacgttacccgggttacgaccggtacccgtaccgggcgacgggtcccggttaccgttttcggtacccgtttcggtaccggggg

SEQ ID NO: 208394 - DNA, 553 bp, Homo sapiens
  misc_feature: GYAE6OF02FF5TR.17.25.C03.1.454.CMB.1.raw
  modified_base (428)..(428): a, c, t, g, unknown or other
  misc_feature (428)..(428): n is a, c, g, or t
  modified_base (444)..(444): a, c, t, g, unknown or other
  misc_feature (444)..(444): n is a, c, g, or t
  modified_base (456)..(456): a, c, t, g, unknown or other
  misc_feature (456)..(456): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtgcgccaggccgctggacaacgacctgagtggatggggatggggaccgaaccctaacacgtgggtgtcacagtgtccttcacccatcccgtcgggacagtaccttaccatcgacccacgaacctcctaccaataaaccacacgtccctaanatgggtagttgagganccgtagacatcnggacacgacgccgttactacttactgtgacgacgtacgtcccagtacgtcccggtagacgtccgtaggccaggccggtcctttgacctttggcgggg

SEQ ID NO: 208395 - DNA, 596 bp, Homo sapiens
  misc_feature: GYAE6OF02HIEGP.17.25.C03.1.454.CMB.1.raw
  modified_base (287)..(287): a, c, t, g, unknown or other
  misc_feature (287)..(287): n is a, c, g, or t
  modified_base (343)..(343): a, c, t, g, unknown or other
  misc_feature (343)..(343): n is a, c, g, or t
  modified_base (351)..(351): a, c, t, g, unknown or other
  misc_feature (351)..(351): n is a, c, g, or t
  modified_base (359)..(359): a, c, t, g, unknown or other
  misc_feature (359)..(359): n is a, c, g, or t
  modified_base (439)..(439): a, c, t, g, unknown or other
  misc_feature (439)..(439): n is a, c, g, or t
  modified_base (460)..(460): a, c, t, g, unknown or other
  misc_feature (460)..(460): n is a, c, g, or t
tcagcgtagactagcacgaccggtgctcgatttagtagtgtagatttgggtttgggggactcaacaacccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcgagtgaaggtctcctgcaaggcttctggtattcaccgtttacctcctatagtatcaacgtgggtncgccaggccgcgtggacaacgcctggagtggatgggatggggaccgaaaccctaanacgtggtncgacagtntcttcaccctatcccgtccggacacgaccttaccatacgacccaacgtaacctcctaccaataaaccactaagccctaanagtggaacgttggaacgggancccgtagactatcgtagacgaccgacggtcctactattacgtgtcgacgacgtacgtcccaaggtcgtccggtaggaaccgtcccgtaagggccacgggtccggttacccgtttaggacccgtttcggtaccgggg

SEQ ID NO: 208396 - DNA, 563 bp, Homo sapiens
  misc_feature: GYAE6OF02FV8E1.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaacgccccagacctcctgatctctggtgcatccactctgcgaagtggccgtcccatcgaggttcaggtggcaggtggatcgtggggacagtatttcaatcctacaccatccaccactctcgccaacctggaggtattgacgcaattctactactcgtacaactagtagttacctacgttcccctcgtccttaccgtttcggccgtaaggggtacctaaggttgaacggtaactaaccgaaaaccgtacgttaggtcggtacgtacggtaccaacctacgttccgtcgttcc

SEQ ID NO: 208397 - DNA, 632 bp, Homo sapiens
  misc_feature: GYAE6OF02H6J46.17.25.C03.1.454.CMB.1.raw
  modified_base (263)..(263): a, c, t, g, unknown or other
  misc_feature (263)..(263): n is a, c, g, or t
  modified_base (283)..(283): a, c, t, g, unknown or other
  misc_feature (283)..(283): n is a, c, g, or t
  modified_base (292)..(292): a, c, t, g, unknown or other
  misc_feature (292)..(292): n is a, c, g, or t
  modified_base (438)..(438): a, c, t, g, unknown or other
  misc_feature (438)..(438): n is a, c, g, or t
  modified_base (584)..(584): a, c, t, g, unknown or other
  misc_feature (584)..(584): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcagtgaaggtctcctgcaaggcttcgtggattcgacgtttaccncctatagtatcaactgggtncgcaggccnctggacaacgactgacgtgatgggatcggggacgaacccttaagacgtggtagtcacgtaggttcgtacttccaacccctatcccgtaccgggaactagactttacccagtacgacccaacgacctcccgtacctaaagtaaaccncgaacgtccctaagaggttcgaagtttacggaggactccgttaggaactacggttacgtacggaaccgtaccgaaccggggtccttaccgttaatttaaccgtggtaccgtacgggaacgtacgtaccccgaaggacttaccgggntaacggcccttaaggcaaggtccgtactttcgaccgttacgtccgggg

SEQ ID NO: 208398 - DNA, 614 bp, Homo sapiens
  misc_feature: GYAE6OF02G4UPI.17.25.C03.1.454.CMB.1.raw
  modified_base (347)..(347): a, c, t, g, unknown or other
  misc_feature (347)..(347): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctggagtggatgggatcgggacaaccctacacgtggtcgtacacngtgtcttcacccactcctcgggacagtactaccactcgaccacgaacctccctacaactaaacacacgacctacgatacggagttgaacggacgcctagactacgtcgtacggaccgaacgaccgggtcccgttacttaactttaccgtggttcgaccggtaacgtaccgttaccccgaacggtacgttcccggggtacgtaccggtacccgtacgggaccgtacgggtccgtccggttttacggtacccgtttcggtaccgggggg

SEQ ID NO: 208399 - DNA, 563 bp, Homo sapiens
  misc_feature: GYAE6OF02G27D0.17.25.C03.1.454.CMB.1.raw
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacacgtggtgtcacagtgtcttcacccatccgtccgggacagacttacatcgaccacgaacctcctacaataaacncancctacagtggagttgagagcctgacatctagaccgtacacgggcctactacttactggtagccgagtaccgtcccgacggtacgttcccggtagaccgcccgttaaggccgtaacggtcccggtaccgttttacggaccgtttccggaccggggg

SEQ ID NO: 208400 - DNA, 558 bp, Homo sapiens
  misc_feature: GYAE6OF02IDAHS.17.25.C03.1.454.CMB.1.raw
  modified_base (280)..(280): a, c, t, g, unknown or other
  misc_feature (280)..(280): n is a, c, g, or t
  modified_base (335)..(335): a, c, t, g, unknown or other
  misc_feature (335)..(335): n is a, c, g, or t
  modified_base (406)..(406): a, c, t, g, unknown or other
  misc_feature (406)..(406): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggcaacctaacactggntcacagtgtcttcaccctatccgtccgggacagtaccttaccatcgaccacgactccctaccaataaaccncaacgcctaacagtggagttgaggacgccgtgaacatctagaccgacgaccgggtccgttacttacttactggtcgacgagacgtccccgagtacgtccggtgacgtcccgtaaggccacggtccggttcctttggaccgttcggtcggggg

SEQ ID NO: 208401 - DNA, 528 bp, Homo sapiens
  misc_feature: GYAE6OF02F74MH.17.25.C03.1.454.CMB.1.raw
  modified_base (280)..(280): a, c, t, g, unknown or other
  misc_feature (280)..(280): n is a, c, g, or t
  modified_base (368)..(368): a, c, t, g, unknown or other
  misc_feature (368)..(368): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggcgaaccctaacactggtgtcacagtgtcttcacccatccctccggganacgacttaccatcgaccacgaactcctaccaataaacacagcctaacatggagttgaggagcctgacatctgacgacacggccgtctattactgtgcgagacgtcccaggctccgggtgacgcccgtacggcacggccggtcctttggacttcgtcgggg

SEQ ID NO: 208402 - DNA, 601 bp, Homo sapiens
  misc_feature: GYAE6OF02FPJOF.17.25.C03.1.454.CMB.1.raw
  modified_base (229)..(229): a, c, t, g, unknown or other
  misc_feature (229)..(229): n is a, c, g, or t
  modified_base (249)..(249): a, c, t, g, unknown or other
  misc_feature (249)..(249): n is a, c, g, or t
  modified_base (277)..(277): a, c, t, g, unknown or other
  misc_feature (277)..(277): n is a, c, g, or t
  modified_base (363)..(363): a, c, t, g, unknown or other
  misc_feature (363)..(363): n is a, c, g, or t
tcagcgtagactagcacgaccggtgctcgatttagtagtgtagatttgggtttggggagtcagtcctcagtcaggacacagctatggacatgagggtccccgctcagctcctggggctcctgctactctggtctccgagctgcctagattgtgactatccagatgacccagtctccatcctccgtgtctgccggtctggtggggtcagagtcaccatcacttgccgganagtcacggacttaaaacctntttaaattgatcagcagaacctgaaacncccagacctcctagactctcgtggtacgctactccactctgacgtaagttcggtcctccatcggagttcagtggactagtgatcgnggactagtacttcaattcctacactataccacctactctacgaccaaacgtgacggtattgtatactaattcctaacttacgtacgtaccaacgtaagtacgtttacgaaccgtttcccctagttccttaccgttttcggaccggtacgggtaaccgtaaggttacggaagtaacgtaacgtaaaccggtacgtaggttcgacgtacggtacctaaccgttacttccgttgttacccg

SEQ ID NO: 208403 - DNA, 552 bp, Homo sapiens
  misc_feature: GYAE6OF02IMHZ2.17.25.C03.1.454.CMB.1.raw
  modified_base (418)..(418): a, c, t, g, unknown or other
  misc_feature (418)..(418): n is a, c, g, or t
  modified_base (434)..(434): a, c, t, g, unknown or other
  misc_feature (434)..(434): n is a, c, g, or t
  modified_base (498)..(498): a, c, t, g, unknown or other
  misc_feature (498)..(498): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaaccctaacacgtggtgtcacgagtgtcttcacccatcctccgggacagaccttaccatcgaccacgaacctccaccaataaacacacgcctaanactggagttgaaggcncctgacatcgtgacgaccgacggccgttactattactgtcgcgagacgtcccaacgcttccggngtacgcccgttaacgggccacgggtccgtcctttggaccgtttcgtaccggggg

SEQ ID NO: 208404 - DNA, 561 bp, Homo sapiens
  misc_feature: GYAE6OF02HAS6A.17.25.C03.1.454.CMB.1.raw
  modified_base (331)..(331): a, c, t, g, unknown or other
  misc_feature (331)..(331): n is a, c, g, or t
  modified_base (339)..(339): a, c, t, g, unknown or other
  misc_feature (339)..(339): n is a, c, g, or t
  modified_base (379)..(379): a, c, t, g, unknown or other
  misc_feature (379)..(379): n is a, c, g, or t
  modified_base (550)..(550): a, c, t, g, unknown or other
  misc_feature (550)..(550): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggtagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaanacgtggtntcacagtgtcttccacccatccctccgggacagacttacntcgaccacgactcctaccaataaacacacgcctacatggagttgagagcctgactatctagaccgacaccgggcctacttaattaccgtgtcgacggagacgtcccaggtactccgggtagacgtccctacgggaccacgggtccggttacccgtttggaccgtttccggnggggtacccgg

SEQ ID NO: 208405 - DNA, 657 bp, Homo sapiens
  misc_feature: GYAE6OF02GDG4E.17.25.C03.1.454.CMB.1.raw
  modified_base (279)..(279): a, c, t, g, unknown or other
  misc_feature (279)..(279): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtncgccaggccgctggacaacgacctgagtggagtgggagtgggccgaaaccctaacacgtggtcgtcacgagttgtccgttaccacccctattcccgtaccgggaacacgtaaccttaccagtcgaacccaacgtaaccctccctacccaaataaaacccacgaacgtaccctaacagtgggtaagtttggaacgggagtcccgtagacctacgtcgtcgaaccgaccgaccgggtcccgttacgttaatttaccgtggttacggaccgtacggtaccgttccccgaacggtacgtacccgggttggaaccggtaccccgtacgggaccacgggtacccgggttccttttacgggtacccgtttcgggtacccgggggg

SEQ ID NO: 208406 - DNA, 524 bp, Homo sapiens
  misc_feature: GYAE6OF02HM4PD.17.25.C03.1.454.CMB.1.raw
  modified_base (260)..(260): a, c, t, g, unknown or other
  misc_feature (260)..(260): n is a, c, g, or t
  modified_base (280)..(280): a, c, t, g, unknown or other
  misc_feature (280)..(280): n is a, c, g, or t
  modified_base (435)..(435): a, c, t, g, unknown or other
  misc_feature (435)..(435): n is a, c, g, or t
  modified_base (474)..(474): a, c, t, g, unknown or other
  misc_feature (474)..(474): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttaccncctatagtatcaactgggtncgccaggccgctggacaacgacctgagtggatgggatgggcaaccctaacactggtgtcacagtgtcttcacccatcctccgggacagacttaccatcgaccacgaactcctaccaataaacacagcctacatggagttgaggagcctgacatcngacgacacggcctatattactgtgcgagacgtcccacgngtcccggtgacgcccgtacggcacggccggtcctttgaccttcgtcgggg

SEQ ID NO: 208407 - DNA, 527 bp, Homo sapiens
  misc_feature: GYAE6OF02HB70P.17.25.C03.1.454.CMB.1.raw
  modified_base (259)..(259): a, c, t, g, unknown or other
  misc_feature (259)..(259): n is a, c, g, or t
  modified_base (279)..(279): a, c, t, g, unknown or other
  misc_feature (279)..(279): n is a, c, g, or t
  modified_base (330)..(330): a, c, t, g, unknown or other
  misc_feature (330)..(330): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttaccncctatagtatcaactgggtncgccaggccgctggacaacgacctgagtggatggggatgggcgaaccctanactggtgtcacagtgtcttcacccatcctcgggacagacttaccatcgaccacgaactcctaccaataaaccacacgccctaacatggagttgaaggagcctagactatctagacgacacggcctctattactgtgcgagacgtccaggctccggtgacgacctacggcacggccgtcctttggaccttcgtcgggg

SEQ ID NO: 208408 - DNA, 538 bp, Homo sapiens
  misc_feature: GYAE6OF02IF583.17.25.C03.1.454.CMB.1.raw
  modified_base (401)..(401): a, c, t, g, unknown or other
  misc_feature (401)..(401): n is a, c, g, or t
  modified_base (423)..(423): a, c, t, g, unknown or other
  misc_feature (423)..(423): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcaaccctaacactggtgtcacagtgtcttcaccctatcctcgggacagacttacatgaccacgaactcctaccataaacncagcctacatggagttgaggancctgacatctgacgacacggccgtactatactgtcgacgagacgtcccacggctccgggtgaccgtaccgtacgggccaggtcccgggtaccttttcggaccttcgtaccggggg

SEQ ID NO: 208409 - DNA, 549 bp, Homo sapiens
  misc_feature: GYAE6OF02GIM52.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtgcgccaggccgctggacaacgacctgagtggatgggatcgggacgaaccctaacactggtgtcactagtgtcttccacccatccctccgggacagaccttacatcgaccacgaacctcctacaataaacacacgcctacatggagttgaggagcctgacatcgtgaccgacgacggtccgtcttaacttacgtgtgacgtagccgtcccgacgtacgtccggtggacgtccctacggacacggccggtccttttcgactttcggtacgggg

SEQ ID NO: 208410 - DNA, 533 bp, Homo sapiens
  misc_feature: GYAE6OF02FZ74M.17.25.C03.1.454.CMB.1.raw
  modified_base (332)..(332): a, c, t, g, unknown or other
  misc_feature (332)..(332): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatgggcgaaccctaanactggtgtcacagtgtcttcacccatcctcgggacagacttaccatcgaccacgaacctcctaccaataaacacacgacctacactggagttgaggagcctgacatcgtgacgacacggccgtctattactgtcgacgagcgtcccagacgtccggtagacgccgtacgggcacggtccgtcgtttcgacctttgtcgggg

SEQ ID NO: 208411 - DNA, 639 bp, Homo sapiens
  misc_feature: GYAE6OF02JLHRS.17.25.C03.1.454.CMB.1.raw
  modified_base (275)..(275): a, c, t, g, unknown or other
  misc_feature (275)..(275): n is a, c, g, or t
  modified_base (348)..(348): a, c, t, g, unknown or other
  misc_feature (348)..(348): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctcctgtctgcctctgtggggtcagagtcaccatcacttgccggacaagtcacggtacgttaaaacctatttaaattggtatcagcaagaaacctggaaaacnccccagacctctgatctcgtggtgcatccactctgcgaagtggcctccagtcgaggtcagtgcagtggatcgnggactagtactttcaagttccactaaccataccgaacctacttaccgtcgtacctaaaccgtgaaggtacttagtcgaaccttaaacgttccttaacttacttcgtaacgtaaacgtaaggtaacgtttaacccgtaaccggtttcccctaacggtacctttaacggttttaccggacccgaaaggggtaccctaaaggttaccggtaacgtaaacgtaaccgtaaaacggttaccgttacggtacggtaccttaccggtaaccctaccgtaacgttcgtaccggtttacc

SEQ ID NO: 208412 - DNA, 624 bp, Homo sapiens
  misc_feature: GYAE6OF02I5H77.17.25.C03.1.454.CMB.1.raw
  modified_base (279)..(279): a, c, t, g, unknown or other
  misc_feature (279)..(279): n is a, c, g, or t
  modified_base (306)..(306): a, c, t, g, unknown or other
  misc_feature (306)..(306): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatccctcctgtctgcctctggtgggggtcagagtcaccatcacttgccggacaagtcacggtacttaaaacctatttaaattggtaatcagcaacgaaactaggaaaacnccccaagacctcctgactctgtggtcncatccactctgacgaagtcggcctaccagtcgtaggttcaggtcggactaggtaggattcggtcgggactagtactttcaagttcctacacctataccacctactcctacgacctaaccgtaggtacggtaattcgtacgactaacgttcttaacctacgtacgtaccaaacgtaagtacgttaccgtaccgttacccctcgtaccttacgtttcgggacccgtaacggggtaaccctaaggttacgtaacgtaacgtaacgtaaacggtaacgtggtacggtaccgtgaacccgtactacgttcgtacgtttacccg

SEQ ID NO: 208413 - DNA, 528 bp, Homo sapiens
  misc_feature: GYAE6OF02J2FW8.17.25.C03.1.454.CMB.1.raw
  modified_base (310)..(310): a, c, t, g, unknown or other
  misc_feature (310)..(310): n is a, c, g, or t
  modified_base (427)..(427): a, c, t, g, unknown or other
  misc_feature (427)..(427): n is a, c, g, or t
  modified_base (447)..(447): a, c, t, g, unknown or other
  misc_feature (447)..(447): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggctcagtgaaggtctcctgcaaggcttctggattcacgtttacctcctatagtatcaactgggtgcgccaggccgctggacaacgacctgagtggangggatgggcaacctacactggtgcacagtgtcttcacccatccgtcggacagacttaccatcgaccacgactcctccataaaccacacgacctacataggagttgaggagcctgacntctgacgacacggccgtctnttaaacgtgtgcgagacgtcccacggcgtccggtgacgtccgtacgcacggccggtccgtttcgaccgttcggtaccgggg

SEQ ID NO: 208414 - DNA, 541 bp, Homo sapiens
  misc_feature: GYAE6OF02GS69Y.17.25.C03.1.454.CMB.1.raw
  modified_base (280)..(280): a, c, t, g, unknown or other
  misc_feature (280)..(280): n is a, c, g, or t
  modified_base (329)..(329): a, c, t, g, unknown or other
  misc_feature (329)..(329): n is a, c, g, or t
  modified_base (341)..(341): a, c, t, g, unknown or other
  misc_feature (341)..(341): n is a, c, g, or t
  modified_base (415)..(415): a, c, t, g, unknown or other
  misc_feature (415)..(415): n is a, c, g, or t
  modified_base (429)..(429): a, c, t, g, unknown or other
  misc_feature (429)..(429): n is a, c, g, or t
  modified_base (432)..(432): a, c, t, g, unknown or other
  misc_feature (432)..(432): n is a, c, g, or t
  modified_base (439)..(439): a, c, t, g, unknown or other
  misc_feature (439)..(439): n is a, c, g, or t
  modified_base (456)..(456): a, c, t, g, unknown or other
  misc_feature (456)..(456): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgcctgagtggatgggatgggcaaccctaanacgtggtgtcanagtgtcttcacccatccgtaccgggacagacttaccatcgaccacgaacctcctaccaataaacacacgcctanatggagttgaggcnccngacatcngaccgacgacggccgtntattactgtgacgagcgtcccgacgtcgtccggtgacgtccgtacgggcacgggtccgtccgttttagaccgttggtaccggggg

SEQ ID NO: 208415 - DNA, 571 bp, Homo sapiens
  misc_feature: GYAE6OF02HROV5.17.25.C03.1.454.CMB.1.raw
  modified_base (332)..(332): a, c, t, g, unknown or other
  misc_feature (332)..(332): n is a, c, g, or t
  modified_base (422)..(422): a, c, t, g, unknown or other
  misc_feature (422)..(422): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaacgtgggtgcgccaggccgctggacaacgcctgagtggatgggatgggccgaaccctaanacgtggtctcacagtgtcttcacccatcccgtccgggacacgacttaccatcgaccaacgaacctcctaccaataaaccacagccctaanagtaggtagttggaggacgtcctagacagttcgtgaaccgacgaccggcctacttaacttacgtgtacgacgacgtacgtcccgaacgtcgtccgggtagacgtacccgtacggcacggtccggttccctttggaccttggtaccgggg

SEQ ID NO: 208416 - DNA, 550 bp, Homo sapiens
  misc_feature: GYAE6OF02IYBOI.17.25.C03.1.454.CMB.1.raw
  modified_base (424)..(424): a, c, t, g, unknown or other
  misc_feature (424)..(424): n is a, c, g, or t
  modified_base (432)..(432): a, c, t, g, unknown or other
  misc_feature (432)..(432): n is a, c, g, or t
  modified_base (445)..(445): a, c, t, g, unknown or other
  misc_feature (445)..(445): n is a, c, g, or t
  modified_base (455)..(455): a, c, t, g, unknown or other
  misc_feature (455)..(455): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatggggaccgaaccctaacgacgtgggtgtccacgagttcgtccttccacccatcccgtaccgggacacgaccttaccatcgaccacgaacctcctaccaataaaccncagcctanatggagttgaggncctgacatcngacgacacggcctactattactgtacgcgagacgtcccaggtactcccggtgacgccgtacggcacggccggtcctttaggaccttcggtcgggg

SEQ ID NO: 208417 - DNA, 662 bp, Homo sapiens
  misc_feature: GYAE6OF02HFQM6.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggcctcagtgaaggtctcctgcaaggcttctggtattcacgtttacctcctatagtatcaacgtgggtgcgccaggccgcgtggacaacgacctgagtggagtggagtcgggaccgaaccctaacgacgtggtcgtacacgagttgtcttaccaccctacgtcccgtaccgggactacgtaccttaccagtcgaacccaacgtaacctccctaccaaactaaaccacgacgtaccctaacgagtacgggaaggtttaggacgggtacgccgttacggaacacgttacgttacggaaccggtaacccgacccgggtacccgttactttaacgtttaccggtggtacggaccggtaagccggttacccgacggtacgtacccgggtaggaaccgcccggtaggccgtacggcccgggttaccctttcggtaccgttccggtacccggggg

SEQ ID NO: 208418 - DNA, 536 bp, Homo sapiens
  misc_feature: GYAE6OF02FLH6P.17.25.C03.1.454.CMB.1.raw
  modified_base (428)..(428): a, c, t, g, unknown or other
  misc_feature (428)..(428): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggggcctcagtgaaggtctcctgcaaggcttctggattcacgtttacctcctatagtatcaactgggtgcgccaggccgctggacaacgacctgagtggatggggatggggcgaaccctaacacgtggtgtcacagtgtcttcacccatcctccgggacagacttaccatgaccacgaactcctccataaacacaagcctacatggagttgaggancctgacatctgacgacacggccgtctagttactgtcgcgagtacgtcccaacgtactccggtgacgcccgtacggcacggccggtcctttcggaccttcggtacgggg

SEQ ID NO: 208419 - DNA, 554 bp, Homo sapiens
  misc_feature: GYAE6OF02HQP18.17.25.C03.1.454.CMB.1.raw
  modified_base (339)..(339): a, c, t, g, unknown or other
  misc_feature (339)..(339): n is a, c, g, or t
  modified_base (427)..(427): a, c, t, g, unknown or other
  misc_feature (427)..(427): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggtacgttaaaacctatttaaattggtatcagcaagaaacctggaaaacgccccagacctcctgatctctggtgcatccactctgcgagtggcgtcccatcgagttcagtgnagtgatcgtgggacagtatttacaatctcaccatccacctactctacgccaacctgagtattgtagactatcttactactgtaccaanagtaacgttactaccgttcccctcgtacttaccgtttcggacccgtaacggggtacctaaggttgtaacgtaactaaccgaaacgtacgtacggtacgacgtcgacctacctattccgttgttaccg

SEQ ID NO: 208420 - DNA, 539 bp, Homo sapiens
  misc_feature: GYAE6OF02IE0SG.17.25.C03.1.454.CMB.1.raw
  modified_base (413)..(413): a, c, t, g, unknown or other
  misc_feature (413)..(413): n is a, c, g, or t
  modified_base (443)..(443): a, c, t, g, unknown or other
  misc_feature (443)..(443): n is a, c, g, or t
  modified_base (446)..(446): a, c, t, g, unknown or other
  misc_feature (446)..(446): n is a, c, g, or t
  modified_base (468)..(468): a, c, t, g, unknown or other
  misc_feature (468)..(468): n is a, c, g, or t
  modified_base (470)..(470): a, c, t, g, unknown or other
  misc_feature (470)..(470): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaacgtgggtgcgccaggccgctggacaacgacctgagtggagtgggatgggacgaacccgtaacacgtggtcgtcacagtcgtcttcaccctatccgtccgggacagtacttaccatcgaccacgaactcctacataaaccncacgcctacatggagttagagagcctgacntcngacgcaccggcctctattacgngngcgagacgtcccgagcgtccggtgaccgaccgtacggcacggtccgtccgtttgaccttcggtccgggg

SEQ ID NO: 208421 - DNA, 555 bp, Homo sapiens
  misc_feature: GYAE6OF02GWNVY.17.25.C03.1.454.CMB.1.raw
  modified_base (279)..(279): a, c, t, g, unknown or other
  misc_feature (279)..(279): n is a, c, g, or t
  modified_base (301)..(301): a, c, t, g, unknown or other
  misc_feature (301)..(301): n is a, c, g, or t
  modified_base (329)..(329): a, c, t, g, unknown or other
  misc_feature (329)..(329): n is a, c, g, or t
  modified_base (475)..(475): a, c, t, g, unknown or other
  misc_feature (475)..(475): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttcctcctatagtatcaactgggtncgcaggccgctggacacgaccngagtggatgggatggggcgaaccctaanactggtgtcacagtgtcttcacccatccgtccggacagacttaccatcgaaccacgaacctcctaccaataaacacacgacctacactggagttgaggacgccgtagactatcgtggaaccgacgaccggcctacgttatttaagngtagcgagtacgtcccgacgtgtaccggtgacggccgttacggccgaggtcccggttcgtttcggaccttgtaccggggg

SEQ ID NO: 208422 - DNA, 890 bp, Homo sapiens
  misc_feature: GYAE6OF02IAL8N.17.25.C03.1.454.CMB.1.raw
tcagcgtagactagcacgaccggtgctcgatttagtagtgtagattttggggtttggggagtacagtctcagtcaggacacagcagtaggacatgagggtccccgctccgagctcctggggcctcctgcctactctggctccgagctgccagatgtgacatccagactgacccagtcctcccatcctccctgtactcgcctcgtggtcgggggtcagacgtccaccactcctacgttcggaccggaacgaacggtaccaaccgggtaacgtttaaaaacccgttagttttaaaacgttacgggtaaactcgaacgacgtaaacggtaaaacccgttagggaaaaaccgcccccaaaggtaccccttaccgtacgaacgttcccttaccgtcgggtaccgacctaacttccctacctaccgtacggaaccggtaaacggtccgggtacccgtaccccgaagttaccggtaacgggtttaccgaagggttacgggaccgtaaggtttcggaacgtttcggtaacggggtacctaagttaacgttttacgaaacgttcctaacccgtaccctaacttaccaacccctaacgttttccgaacgtaaccttaaacccggtgggtaaacgggttagttacggtaccggtaacttaaacttaccgttaaacttacgtacgttaaccgaaacgttaacgggttaaacgtttacccgtaacccgtttacccccgtacggttaccctttaaccggttttaccggggaaacccggtaacggggggttaaacccttaaaggggtttccgggaaacggttaaactaaccggtaaaaccggtaacccggttggtaccggtaccgtaccgtacccgaaccgtttacttaccggttcggttacccc

SEQ ID NO: 208423 - DNA, 531 bp, Homo sapiens
  misc_feature: GYAE6OF02F62K2.17.25.C03.1.454.CMB.1.raw
  modified_base (339)..(339): a, c, t, g, unknown or other
  misc_feature (339)..(339): n is a, c, g, or t
  modified_base (426)..(426): a, c, t, g, unknown or other
  misc_feature (426)..(426): n is a, c, g, or t
  modified_base (452)..(452): a, c, t, g, unknown or other
  misc_feature (452)..(452): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtgcgccaggccgctggacaacgacctgagtggatgggatgggacgaaccctaacacgtggtntcacagtgtcttcacccatccgtcgggacagacttaccatcgaccacgaactcctacataaacacacgcctacatggagttgaggancctgacatctgacgacgacggccgtntacttactgtgacgagacgtcccgagtacgtccggtagacgtcctaggcacggccgtaccgtttgacgttcgtacgggg

SEQ ID NO: 208424 - DNA, 594 bp, Homo sapiens
  misc_feature: GYAE6OF02H306T.17.25.C03.1.454.CMB.1.raw
  modified_base (437)..(437): a, c, t, g, unknown or other
  misc_feature (437)..(437): n is a, c, g, or t
  modified_base (453)..(453): a, c, t, g, unknown or other
  misc_feature (453)..(453): n is a, c, g, or t
  modified_base (541)..(541): a, c, t, g, unknown or other
  misc_feature (541)..(541): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaaggtctcctgcaaggcttctggattcacgtttacctcctatagtatcaactgggtgcgccaggccgctggacaacgacctgagtggatgggatggggaccgaaccctaacgacgtggtgtcacgtaggtcgtcttccaccctatcccgtccgggacacgtaccttaccagtcgaccacgaacctccctaccaataaaccacacgcctaacngtggtagttggacggngccctagacagttcgtagaaccgaccgaccgggtccgttacttacttacgtggtacgacgagtaccgtcccgaggtactcccgggtanaccggtcccgtacggcacgggtcccgttccgtttggaccgttcggtaccgggg

SEQ ID NO: 208425 - DNA, 605 bp, Homo sapiens
  misc_feature: GYAE6OF02I2I36.17.25.C03.1.454.CMB.1.raw
  modified_base (280)..(280): a, c, t, g, unknown or other
  misc_feature (280)..(280): n is a, c, g, or t
  modified_base (415)..(415): a, c, t, g, unknown or other
  misc_feature (415)..(415): n is a, c, g, or t
  modified_base (439)..(439): a, c, t, g, unknown or other
  misc_feature (439)..(439): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatggggacgaacctaacacgtggtcgtcacagtgtccttcacccatcctccggggacaggtaccttaccattacgaccacgaacctctaccaataaaccncagcctacatcggattagaggacnccgtgacacgtcgtacgacgtaccgacgggtcccgtacgttaacttacctagtcggaccgtaacggtacgttacccccgaacggtacttacccggggtagaaccggtccccgttaacgggctaacgggtcccggtacccgttttggacccgtttcggtaccggggg

SEQ ID NO: 208426 - DNA, 562 bp, Homo sapiens
  misc_feature: GYAE6OF02GJVJB.17.25.C03.1.454.CMB.1.raw
tcagcgtagactagcacgaccggtgctcgatttagtagtgtagatttgggtttggggactcaacaaccacatctgtcctctagagaaaaccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctcgtggacaaggccttgagtggatgggagatcgtcctatcgttgacacacaaactacgcacagaagttccagggcagactcaccataccgcggaacaaattacgaacacagtaatcgtaggagactagaacagcctgtacatctgaggacacgggtcttctacttctgtgcgaggtaacgtaattactaataactactcgtaccgttccttttaactacccttcccgttcgtacgtttcgtcgggtccacgtccggtaccccggtctaccccg

SEQ ID NO: 208427 - DNA, 654 bp, Homo sapiens
  misc_feature: GYAE6OF02J1RY7.17.25.C03.1.454.CMB.1.raw
  modified_base (227)..(227): a, c, t, g, unknown or other
  misc_feature (227)..(227): n is a, c, g, or t
  modified_base (249)..(249): a, c, t, g, unknown or other
  misc_feature (249)..(249): n is a, c, g, or t
  modified_base (310)..(310): a, c, t, g, unknown or other
  misc_feature (310)..(310): n is a, c, g, or t
tcagcgtagactagcacgaccggtgctcgatttagtagtgtagatttgggtttgggggtaggtcgagtctcagtcaggacacagcatggacatgaggtcccgctcagctcctgggctcctgctactctggctccgagctgccagatgtgacatccagatgacccagtctccatccctccctgtcctgccctctggtggggtacagagtccaccatcacttgccgganaagtcacggtcgttaaaacctntttaaattggtatacagcaagaacctaggaaaacgccccaagcctcctgattctctggtcnctaactcccgacttcgtcgacggaagtcggccgtcccagtcggtaaggttccagggttcggctaggtagggtactccggtgggaactaaggtacttttccaaagttcctacgacctataccgacctacttcacgtacctaaccgttggaacggtacttcggacgtactaaacttccttaccttaacgttacgtacctaaacgaggttaacctttaccgtaaccgtttccccgtcgtaccgtttaaccgtttacggacccgtaacgggttaaacccgagttaggtaaccgaacttaacgaacgtaacctggtccgtacttcggaccctacgtacttactcgttac

SEQ ID NO: 208428 - DNA, 574 bp, Homo sapiens
  misc_feature: GYAE6OF02IO3QO.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatccctccctgtctgcctctggtgggggtcagagtcaccatcacttgccggacaagtcacggacgttaaaacctatttaaattggtatcagcaagaaacctggaaaacgccccagaccctcctgactctctggtgcatccactctgacgaagtcggccgtcccagtccggtaggttcaggtgctaggtggatcgtgggacagtattacaatctcaccactcacctactctcgacaaccgtgaggtattgtagtactaactaccttacttactcgtacaaacgagtaacgttactaccgtttccctaccgtccttacgtttcggaccgtaacgggtaacctaaggttacgaggtaactaaccgaaacgtaacgtacgtggtctacgacctaccacttctgttaccg

SEQ ID NO: 208429 - DNA, 592 bp, Homo sapiens
  misc_feature: GYAE6OF02JCKT8.17.25.C03.1.454.CMB.1.raw
  modified_base (281)..(281): a, c, t, g, unknown or other
  misc_feature (281)..(281): n is a, c, g, or t
  modified_base (292)..(292): a, c, t, g, unknown or other
  misc_feature (292)..(292): n is a, c, g, or t
  modified_base (329)..(329): a, c, t, g, unknown or other
  misc_feature (329)..(329): n is a, c, g, or t
  modified_base (407)..(407): a, c, t, g, unknown or other
  misc_feature (407)..(407): n is a, c, g, or t
  modified_base (417)..(417): a, c, t, g, unknown or other
  misc_feature (417)..(417): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcgtggattcacgtttacctcctatagtatcaactgggtncgccaggccgntggacaacgacctgagtggatgggatgggcaacctancgtgtgtcacgagtgtccttcaccctagtcctccgggacagacttaccatcgaccacgaacctcctaccaataaaccncacgcctaangtggagttgaggagccgtgaccattcgtgaaccgtaccacggtccgttactaacgttaccgtggtacgcggtaacgacgttccccaacgggtacgttcccgggtagaaccggtacccgttacgggcctaacgggcccgggttacccttttacggacccgtttccggtaccggggg

SEQ ID NO: 208430 - DNA, 559 bp, Homo sapiens
  misc_feature: GYAE6OF02FW8MQ.17.25.C03.1.454.CMB.1.raw
  modified_base (427)..(427): a, c, t, g, unknown or other
  misc_feature (427)..(427): n is a, c, g, or t
  modified_base (440)..(440): a, c, t, g, unknown or other
  misc_feature (440)..(440): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggaccaaaccctaacacgtggtgtcactagtgtccttcaccctagtccctccgggacacgtaccttaccatcgacccacgaacctcctaccaataaaccacacgcctanatggagttgaggntcctgacatctgacgcgacgtccgtctattactgtgacgacgacgtcccgagtacgtcccggtagaccgcctaacgggcctacggtcccggttcctttcggaccgttcgtaccgggggg

SEQ ID NO: 208431 - DNA, 537 bp, Homo sapiens
  misc_feature: GYAE6OF02GJ8GG.17.25.C03.1.454.CMB.1.raw
  modified_base (280)..(280): a, c, t, g, unknown or other
  misc_feature (280)..(280): n is a, c, g, or t
  modified_base (333)..(333): a, c, t, g, unknown or other
  misc_feature (333)..(333): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatggggatggggcgaaccctaanactggtgtcacagtgtcttcacccatcctccgggacagacttaccatcgaccacgaacctcctaccaataaaccacacgcctacatggagttggaggagcctgacatctgacgacaccggccgtactattactgtgcgtagacgtcccacgtctccggtgacgtccgtacggcgacggccggtcctttcgaccgttcgtcgggg

SEQ ID NO: 208432 - DNA, 582 bp, Homo sapiens
  misc_feature: GYAE6OF02JCBA9.17.25.C03.1.454.CMB.1.raw
  modified_base (280)..(280): a, c, t, g, unknown or other
  misc_feature (280)..(280): n is a, c, g, or t
  modified_base (503)..(503): a, c, t, g, unknown or other
  misc_feature (503)..(503): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctggagtggatgggatggggaccgaaccctaacgacgttgggtgtcacgagttcgtccttcacccctatccctaccggggacacgaccttaccgatacgacccacgaacctccctaccaactaaaccacagcctacacgtggaagttggaggtacgcctagaccatcgtagaccgacgaccggtccgttacttacgttacngtacggacgtagacgtcccaggtctccgggtagaccgccgtacgggcacggtcccggtctttggaccttcggtacgggg

SEQ ID NO: 208433 - DNA, 879 bp, Homo sapiens
  misc_feature: GYAE6OF02G6ODW.17.25.C03.1.454.CMB.1.raw
tcagcgtagactagcacgaccggtgctcgatttagtagtgtagatttgggtttggggactcaacaaccacatctgtccgtctagagaaaaccctgtgagcacagctcctcaccatggactggacctggaggatcctcttcttggtggcagcagctacaagtgcccactcccaggtgcagctggtgcagtctggggctggaggtgaagaagcctggggccctcgaggtaggtaacggtcctccgtgacgaaggtcttcgtggtacttaccgttaaccgttttacctccgttaattagttactactaacggttgggtcgccgtaccgacgggcccgtcgtacgggaaccaaccggtaccgtaggacggtagggaggttaggggacggtaccggggaaccgtaaaccccgtaacgacggttcgggtacgtacgtaacgtacggttcgttccgtttacccaacccgttaccgttacccggtaccgggaaccgtacgttaacccttacctacgtaccgtaacccgaaaccggtaacccctttccccgtaaacctaaacgtaaaacccgaaccgtaaccgtacccttaacgtacggttagggtaacggtttacgggaacgggtaaccgtcccgttaacggaacctacggttaccgtaacgggtaaacccggtaacccgggtacccggggtaccctttaacgtttaaaccgtttccggttacgggtaacggtaccgggtaaccgggttaccccgtaccccggtaacgggttaaccccggttaccggggttaacgggtacccggtaacccggttaccgggaccgggtaccgggttcccgggtttacccggtttacggttacccgggtttccggggtaacccgggggg

SEQ ID NO: 208434 - DNA, 573 bp, Homo sapiens
  misc_feature: GYAE6OF02GL4MW.17.25.C03.1.454.CMB.1.raw
  modified_base (278)..(278): a, c, t, g, unknown or other
  misc_feature (278)..(278): n is a, c, g, or t
  modified_base (568)..(568): a, c, t, g, unknown or other
  misc_feature (568)..(568): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacgttaaaacctatttaaattggtatcagcaagaaacctaggaaaacnccccagacctcctgatctcgtggtgcactccactcgtgacgaaggtcggccgtcccagtcggtaggttcaggtggcaggtgactcgtgggacagttattacaatcctacaccactccacctctctcgacctaaccgtgaggtattcgtgactaacttctaacttactacgtaccaacgtagtaacgttacctaccgttccccgtacgtccttacgtttcggaccggtaagggtaacctagtacgaagtactaaccaaacgtacgtgtcggacgtcgacctacacttcgtnttacc

SEQ ID NO: 208435 - DNA, 557 bp, Homo sapiens
  misc_feature: GYAE6OF02HXEBU.17.25.C03.1.454.CMB.1.raw
  modified_base (280)..(280): a, c, t, g, unknown or other
  misc_feature (280)..(280): n is a, c, g, or t
  modified_base (330)..(330): a, c, t, g, unknown or other
  misc_feature (330)..(330): n is a, c, g, or t
  modified_base (401)..(401): a, c, t, g, unknown or other
  misc_feature (401)..(401): n is a, c, g, or t
  modified_base (424)..(424): a, c, t, g, unknown or other
  misc_feature (424)..(424): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgcaggccgctggacaacgcctggagtggatgggatgggcgaaccctaanacgtggtgtcacagtgtcttcacccatccctcgggacagacttaccatcgaccacgactccaccataaacncagcctacatggagttgaggacncctagacatctagacgacgacggtccgtacttatttaccgtgtcgcgaggtacgttccccaacggacgttcccgggtagacggacccgtacgggccacgggccggtacccttttcggaccgttcggtcggggg

SEQ ID NO: 208436 - DNA, 569 bp, Homo sapiens
  misc_feature: GYAE6OF02HLS4I.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgcctgagtggatgggatggggcaaccctaacactggtgtcacagtgtcttcacccatcctccgggacagaccttaccatcgaaccacgaactcctccaataaacacagcctacatggattggaggagcctagacatctagacgtacgaccggccgtacttacgttactggtagcgaagtacgtacccgaccggtaacgtcccgggtaggaccgcccgtaacggccgacgggtcccgggtccttttacggaccgtttccggtaccgggggg

SEQ ID NO: 208437 - DNA, 561 bp, Homo sapiens
  misc_feature: GYAE6OF02IOL5H.17.25.C03.1.454.CMB.1.raw
  modified_base (339)..(339): a, c, t, g, unknown or other
  misc_feature (339)..(339): n is a, c, g, or t
  modified_base (477)..(477): a, c, t, g, unknown or other
  misc_feature (477)..(477): n is a, c, g, or t
tcagcgtagactagcacgaccggtgctcgatttagtagtgtagatttgggtttggggactcaacaaccacatctgtcctctagagaaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggacttcacgttttacctcctaatagtatcaactgggtgcgccaggccgctggacaacggacctggagtggatgggatgggacgaaaccctaanacgtggtgtcacagtgtcttcaccatcccgcggacagactacatcgaccacgactacctacaataaaacacacgcctacagtcggtagttcggaggactcctagacatctaggacgacgacgccgttactaatttacngtcgacgagaccgtccaacgtacgtccgggtagacgacccgttaacggcacggccggtcctttaggtaccgtttacgacggggg

SEQ ID NO: 208438 - DNA, 550 bp, Homo sapiens
  misc_feature: GYAE6OF02ICRMZ.17.25.C03.1.454.CMB.1.raw
  modified_base (280)..(280): a, c, t, g, unknown or other
  misc_feature (280)..(280): n is a, c, g, or t
  modified_base (406)..(406): a, c, t, g, unknown or other
  misc_feature (406)..(406): n is a, c, g, or t
  modified_base (416)..(416): a, c, t, g, unknown or other
  misc_feature (416)..(416): n is a, c, g, or t
  modified_base (429)..(429): a, c, t, g, unknown or other
  misc_feature (429)..(429): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatggggatggggcgaaccctaacacgtggtgtcacagtgtcttcaccctatcctcgggacagacttaccatcgaccacgactcctaccaataaacncagcctaacntggagttgaggancctgacatctgacgacacggcctctattactgtcgcgagacgtcccgagacgtccggtagaacgtcccgtaacgggcctacgggtccggttccttttacggacccgtttcggtaccggggg

SEQ ID NO: 208439 - DNA, 543 bp, Homo sapiens
  misc_feature: GYAE6OF02G0LV6.17.25.C03.1.454.CMB.1.raw
  modified_base (279)..(279): a, c, t, g, unknown or other
  misc_feature (279)..(279): n is a, c, g, or t
  modified_base (332)..(332): a, c, t, g, unknown or other
  misc_feature (332)..(332): n is a, c, g, or t
  modified_base (429)..(429): a, c, t, g, unknown or other
  misc_feature (429)..(429): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggcctcagtgaaggtctcctgcaaggcttctggattcacgtttacctcctatagtatcaactgggtncgccaggccgctggacaacgacctgagtggatgggatggggacaacccgtaanacgtggtgtcacgagtgtcttcacccagtcctcggacagacttaccatcgaccacgaactcctaccaataaacacagcctacagtggagttagaganctgacatctgacgacaccgcgtactagttactgtgcagtacgtccacggtcgtccggtaggacgtacccgtacggcgacggcccggtaccgttttaggaccttcggtaccgggg

SEQ ID NO: 208440 - DNA, 686 bp, Homo sapiens
  misc_feature: GYAE6OF02IFEXF.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctctgcaggcttctggattcacgtttacctcctatagtatcaactgggtgcgccaggccgctggacaacgcctggagtggatcgggatgggacgaaccctaagacgtggtgtcacagtgtccttcacccatccgtccgggacacgacttaccagtcgaccctaacgaaccttcccgtaccaactaaaaccgactaacgtccctaacagttcggaagtttaggaagggtacgacccgttagacctaacttccgtacggaacccggtaaccgtaaccggggtcccgtttacgttaacgtttaaccgttcgggttaggaccggtaaggtacccgttaacccccgtaacgggtaccggtttaccccgggggtacggaaccgggtcccccgtaaacgggtccccggaacggttaccccggggttacccgttttcgggtacccttttccggggtacccgggggg

SEQ ID NO: 208441 - DNA, 681 bp, Homo sapiens
  misc_feature: GYAE6OF02HROFI.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggtattcacgtttacctcctatagtatctaacgtgggtgcgccaggcccgcgtcggaaccaacggacctggaggtgggagtggggatggggaccgaaccctaacgacgtggtcgtacacgtagttcgtacttccgaaccctacgtccgtcccggggaacacgtaccttaccgagtacgaacccacgtaaccctcccgttaccaaataaaccaacaacgtacccatacgtaggtaacggttaggacggaacgtccgtaagacctacgttcgtacggtaaccgaccgacgggtacccgttactaactttacgtcgttacggacgtacggaccgtaccccgaacggtaaccgttccgggtaagaaccggtcccgttaacgggccgtaacgggtcccgggttacccgtttttacggtacccggtttacgggtacccggggg

SEQ ID NO: 208442 - DNA, 255 bp, Homo sapiens
  misc_feature: GYAE6OF02HEIGV.17.25.C03.1.454.CMB.1.raw
  modified_base (224)..(255): a, c, t, g, unknown or other
  misc_feature (224)..(255): n is a, c, g, or t
tcagcgtagactagcacgaccggtgctcgatttagtagtgtagatttgggtttgggggccgagggaaccctgggtcaccgtctcctcagcctccaccaagggcccatcggtcttcccctggcaccctcctccaagagcacctctgggggcacagcggccctgggctgcctggtcaaggactacttccctagtctacgctgagccgggctggcaaggcgcatagnnnnnnnnnnnnnnnnnnnnnnnnnnnnnnnn

SEQ ID NO: 208443 - DNA, 529 bp, Homo sapiens
  misc_feature: GYAE6OF02FJYKX.17.25.C03.1.454.CMB.1.raw
  modified_base (333)..(333): a, c, t, g, unknown or other
  misc_feature (333)..(333): n is a, c, g, or t
  modified_base (340)..(340): a, c, t, g, unknown or other
  misc_feature (340)..(340): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatggggcgaaccctaanactggtntcacagtgtcttcacccatcctccgggacagacttaccatcgaccacgaactcctccaataaacacagcctaacatggagttgaggagcctgacatctgacgacacggccgtctattactgtgcgagacgtcccacgtatcccggtgacgcctacggcacggccggtcctttggacctttcggtcgggg

SEQ ID NO: 208444 - DNA, 536 bp, Homo sapiens
  misc_feature: GYAE6OF02HNO53.17.25.C03.1.454.CMB.1.raw
  modified_base (330)..(330): a, c, t, g, unknown or other
  misc_feature (330)..(330): n is a, c, g, or t
  modified_base (463)..(463): a, c, t, g, unknown or other
  misc_feature (463)..(463): n is a, c, g, or t
  modified_base (467)..(467): a, c, t, g, unknown or other
  misc_feature (467)..(467): n is a, c, g, or t
  modified_base (490)..(490): a, c, t, g, unknown or other
  misc_feature (490)..(490): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcaaccctaanacgtggtgtcacagtgtcttcacccatccgtcgggacgacttacatcgaccacgaactcctaccaataaacacacgcctaacatggagttgaggagcctagactatcagaccgacgacggccttctacttacnggtnacgagacgtcccagacgtccggngacgccgtacggcaggccggtcctttggactttccggtgggaccgg

SEQ ID NO: 208445 - DNA, 578 bp, Homo sapiens
  misc_feature: GYAE6OF02I82EA.17.25.C03.1.454.CMB.1.raw
  modified_base (294)..(294): a, c, t, g, unknown or other
  misc_feature (294)..(294): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtgggcctcagtgaaggtctcctgcaaggcttcgtggattcgacgtttacctcctatagtatcaactgagtgcgccaggccgntggacaacgctgagtggatgggagtgggcgaacctacagtggtgtcactagtcgtctccacctatcccgtacggacagtaccttaccatcgaccacgtaacctcctaccaataaaccacacgacctaacagttggagttagaggtctacctagactactctagaccgaacgccggtccgtacttaacttacgtgtacgcgtagaccgtaccctaaggtacccgtcggtggaccgtacccgtacggcctaagggcccggttacctttacggtccgttacccgggg

SEQ ID NO: 208446 - DNA, 555 bp, Homo sapiens
  misc_feature: GYAE6OF02IG351.17.25.C03.1.454.CMB.1.raw
  modified_base (288)..(288): a, c, t, g, unknown or other
  misc_feature (288)..(288): n is a, c, g, or t
  modified_base (310)..(310): a, c, t, g, unknown or other
  misc_feature (310)..(310): n is a, c, g, or t
  modified_base (418)..(418): a, c, t, g, unknown or other
  misc_feature (418)..(418): n is a, c, g, or t
  modified_base (426)..(426): a, c, t, g, unknown or other
  misc_feature (426)..(426): n is a, c, g, or t
  modified_base (440)..(440): a, c, t, g, unknown or other
  misc_feature (440)..(440): n is a, c, g, or t
  modified_base (447)..(447): a, c, t, g, unknown or other
  misc_feature (447)..(447): n is a, c, g, or t
  modified_base (450)..(450): a, c, t, g, unknown or other
  misc_feature (450)..(450): n is a, c, g, or t
  modified_base (458)..(458): a, c, t, g, unknown or other
  misc_feature (458)..(458): n is a, c, g, or t
  modified_base (503)..(503): a, c, t, g, unknown or other
  misc_feature (503)..(503): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctccgtgcaaggcttcgtggacttctaccgtttacctcctaatagtatcaacgtgggtncgcaggccgctggacaacgccngagtggatgggatgggaccaaccgtacacgtggtctcacagtctcttcaccctatcccgtcgggacagtaccttaccagtccgaaccacgacctcctacaataaaccnacgcctanagtgagttgaggcncctgacntcngacgaccncggccgtctattacgtgtcgcgtagcgtcccgagactccgggtanaccggtccgtacggcacgggtcccgttccgtttcgaccgttcggtaccgggg

SEQ ID NO: 208447 - DNA, 687 bp, Homo sapiens
  misc_feature: GYAE6OF02H6T2K.17.25.C03.1.454.CMB.1.raw
  modified_base (187)..(187): a, c, t, g, unknown or other
  misc_feature (187)..(187): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgccccactcccaggtgcagctggtgcngtcgtggggctgaggtgaagaagccgtggggcctcagtgaaggtctccgtgcgaaggtcttcgtggtattcgtaaccgttttacctcctaatagtatcgaacgttgggtgccgccgaaggccgtccgtaggaaccaaccgacctgagtggagttcgggagtcgggaccgaaacccctaagtacgtcggttgtacacgtagttcgtacttccaccctacgtacccgtccggaactacgtaccgtttaccaagtccgaaccaacgtacctccctaaccgaaactaaaaccacgacgaccctaacgagttacgggtaacgtttaggaacggacgtccgtagaactacgttaccgacgtaaccgaccgaccgtccggttaactttacgttacgtacgtacgtacgtaacgtaccgtacccgtaacggcgttacccgggtacgaaccggtacccgttaccggacttacgggccgtttaccgtttggtacccgtcgggtaccgggg

SEQ ID NO: 208448 - DNA, 584 bp, Homo sapiens
  misc_feature: GYAE6OF02F9YSV.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacacgtggtgtcacagtgtccttcaccccatcccgtcgggacacgacttaccgatcgacccacgaacctcctaccaataaacacacgccctacagtggagttagaggacgtcctagactatcgtagaaccgacgaccggtcccttacgttaacttaccgtggtacgacgacggtacgtccccgaacgtcgtcccgggttgaccgtcccgtaacggcctagggcccggtccgttttagaccgtttcggtacggggg

SEQ ID NO: 208449 - DNA, 530 bp, Homo sapiens
  misc_feature: GYAE6OF02FHTYB.17.25.C03.1.454.CMB.1.raw
  modified_base (362)..(362): a, c, t, g, unknown or other
  misc_feature (362)..(362): n is a, c, g, or t
  modified_base (428)..(428): a, c, t, g, unknown or other
  misc_feature (428)..(428): n is a, c, g, or t
  modified_base (439)..(439): a, c, t, g, unknown or other
  misc_feature (439)..(439): n is a, c, g, or t
  modified_base (446)..(446): a, c, t, g, unknown or other
  misc_feature (446)..(446): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggccgaaccctaacacgtggtgtcacagtgtcttcacccatccncgggacagacttaccatcgaccacgaactcctacactaaacacacgcctacatcggagttgaggancctgacagtcngacgacnccggcgtctacttactgtgccgagacgtcccaggtcgtccggtgacgccgtacggcaggtccgtcctttgaccgttcgtcgggg

SEQ ID NO: 208450 - DNA, 701 bp, Homo sapiens
  misc_feature: GYAE6OF02I265H.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaggcttctggattcacgtttacctcctatagtatcaacgtgggtgcgccaggccgctggacacgacctgagtggatgggatcgggcgaaccctaacgactggtgtcacgagtcgtcttccgaccctatcccgtaccggggacacgtaccttaccacgtacgaacccacgaacccttccctacccaaactaaaaccaccaacgtacccttaaaccgagtacgggtaacggttggaacgggtaccgtcccgtaggtaacctacgttccgtacggtaacccggaccggtaacccggggtccccgtttaacgtttaacgtttaaccgtggttacggaccggtaaggtaccggtaccccgtaaccgggtacgttacccggggtacggtaaccggtccccggttaaaccgggcccgtaacgggtcccgggttacccgttttcgggtaaccgtttcccggggtaccggggggg

SEQ ID NO: 208451 - DNA, 626 bp, Homo sapiens
  misc_feature: GYAE6OF02GWCHS.17.25.C03.1.454.CMB.1.raw
  modified_base (473)..(473): a, c, t, g, unknown or other
  misc_feature (473)..(473): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgttacctcctatagtatcaactgggtgcgccaggccgctggacacgacctggagtggatggggatggggccgaaacccctaacgaccgtgggtcgtacgacgtaggttcgttccttccaacccctatcccgtcccggggacaacggtaccttaccatacgacccacgaacctcctaccaactaaacacagcctacgatggtagttgacggtacgcctagacntcgtaggaccgacgtaccggtcccgttacttaacgttacgtgtcggacgacggtaccgtccccgaacggtccgttaccgggtacggaccggtcccggttacggccgtaacgggtccgggttacccgttttcggtaccgttccggtaccggggg

SEQ ID NO: 208452 - DNA, 559 bp, Homo sapiens
  misc_feature: GYAE6OF02IO3EA.17.25.C03.1.454.CMB.1.raw
  modified_base (287)..(287): a, c, t, g, unknown or other
  misc_feature (287)..(287): n is a, c, g, or t
  modified_base (298)..(298): a, c, t, g, unknown or other
  misc_feature (298)..(298): n is a, c, g, or t
  modified_base (318)..(318): a, c, t, g, unknown or other
  misc_feature (318)..(318): n is a, c, g, or t
  modified_base (324)..(324): a, c, t, g, unknown or other
  misc_feature (324)..(324): n is a, c, g, or t
  modified_base (339)..(339): a, c, t, g, unknown or other
  misc_feature (339)..(339): n is a, c, g, or t
  modified_base (421)..(421): a, c, t, g, unknown or other
  misc_feature (421)..(421): n is a, c, g, or t
  modified_base (426)..(426): a, c, t, g, unknown or other
  misc_feature (426)..(426): n is a, c, g, or t
  modified_base (435)..(435): a, c, t, g, unknown or other
  misc_feature (435)..(435): n is a, c, g, or t
  modified_base (441)..(441): a, c, t, g, unknown or other
  misc_feature (441)..(441): n is a, c, g, or t
tcagcgtagactagcacgaccggtgctcgatttagtagtgtagatttgggtttggggtacgtcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtgggcctcgagtgaaggtctccgtgcaaggtctcgtggattctacgtttacctctatacgtatcaactggggtncgaccaggccngtggacaacgcctgagtggngtgggntggggacaaccctangtgtgccacagtcgtctccacctgtccgtaccggatacgtacttaccgatcgaaccacgaactccacaataacacagcctanagtgngttagacgnccgtanacgtactgtcgaaccgacgaccgtccgtactttactaccgtgtcgacgagccgtacccgagtctccgggatacgacccgttaggctaggtcccgtacgtttcgacgttcggaccgggg

SEQ ID NO: 208453 - DNA, 546 bp, Homo sapiens
  misc_feature: GYAE6OF02FP1II.17.25.C03.1.454.CMB.1.raw
  modified_base (277)..(277): a, c, t, g, unknown or other
  misc_feature (277)..(277): n is a, c, g, or t
  modified_base (335)..(335): a, c, t, g, unknown or other
  misc_feature (335)..(335): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctctgcaggcttctggattcacgtttacctctatagtatcaactgggtncgccaggccgctggacaacgacctgagtggatgggatggacaaccctaagactgggtntcacagtgtcttcaccctagtccctccgggacacgtacttaccatcgaccacgaacctcctaccaataaacacacgacctacatggagttgacggagcctgactatctagacgacacggtccgtctacttctgtcgcgagtacgtcccgagtactccgggtagaccgtccgtacgggcacggtccggtacctttcggtacttcggtcgggg

SEQ ID NO: 208454 - DNA, 609 bp, Homo sapiens
  misc_feature: GYAE6OF02HS3EF.17.25.C03.1.454.CMB.1.raw
  modified_base (278)..(278): a, c, t, g, unknown or other
  misc_feature (278)..(278): n is a, c, g, or t
  modified_base (338)..(338): a, c, t, g, unknown or other
  misc_feature (338)..(338): n is a, c, g, or t
  modified_base (341)..(341): a, c, t, g, unknown or other
  misc_feature (341)..(341): n is a, c, g, or t
  modified_base (352)..(352): a, c, t, g, unknown or other
  misc_feature (352)..(352): n is a, c, g, or t
  modified_base (397)..(397): a, c, t, g, unknown or other
  misc_feature (397)..(397): n is a, c, g, or t
  modified_base (405)..(405): a, c, t, g, unknown or other
  misc_feature (405)..(405): n is a, c, g, or t
  modified_base (436)..(436): a, c, t, g, unknown or other
  misc_feature (436)..(436): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctgtgcagtctggggctgaggtgaagaagccgtggggcctcagtgaaggtctcctgcaaggcttctggattcacgtttacctcctatgtatcaactggtncgccagccgctggacaacgctgagtggatggatcgggacaacctaacacgtggtgtcacngtntccttcacccngtccgtcggacagacttaccatcgaccacgaacctccacataacncagcctangtacgagttcgaggactctagacctattacncggaaccgaaccgaccggtccgttacgtaactttaccgtggtacggtaccgacggtacgtacccctaagggtaaccgttcccgggtacggtaacgtaccccgttaacggggccgttaaccggggtcccggtttaccggttttacccggtacccggtttccgggtaccgggggg

SEQ ID NO: 208455 - DNA, 674 bp, Homo sapiens
  misc_feature: GYAE6OF02IZFT2.17.25.C03.1.454.CMB.1.raw
  modified_base (219)..(219): a, c, t, g, unknown or other
  misc_feature (219)..(219): n is a, c, g, or t
  modified_base (277)..(277): a, c, t, g, unknown or other
  misc_feature (277)..(277): n is a, c, g, or t
  modified_base (434)..(434): a, c, t, g, unknown or other
  misc_feature (434)..(434): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagccgtggggcctnagtgaaggtctctgcaggctctggattcacgtttacctctatagtatacaactgggtnccgcaggccgctggacaacgaccgtgagtggagtgggacgtcgggacgaaaccctaacgtacgtgggtgtacacgtagttgtccttaccacctactccgtaccgggacacgtaaccttaaccgatacgacctacgaaaccttccaccaaactaaacncacgtacctaacgtagtaggtaagttacgaggacgtaccgtagacctaagtccgttacggaaccggaaccgtaccgggttaccccgttactttaaagtttacccgtaggttaccggaaccggtaacggtacccgtacccgaaccgggtaccgttacccgggtggaacccggtacccgttacgggcccgtaacgggtcccggtttaccccttttacgggtaccttacccgggtacgggggg

SEQ ID NO: 208456 - DNA, 825 bp, Homo sapiens
  misc_feature: GYAE6OF02JMWO5.17.25.C03.1.454.CMB.1.raw
tcagcgtagactagcacgaccggtgctcgatttagtagtgtagatttggtttggggtacgtcgaacaaccacatctgtcctctagagaaaacctagtgagcacagctcctcaccatggactggacctggaggatctcttcttggtggcagcagctacaagtgccactcccaggtgcagctggtcgcagtctgggctggaggtgaagaacgccgtggggccttcgaggtgaacggtcttcctgacgaaggtacttcgtagggtacttcaccggttttaccctcctaagtaacgttatacgtaaccgtggggttcgcggcctacgggcccgtcgttacggaaccaaccggtaccttggaacgtttagggacttgggggagttcgggaaccgtaacccctaaacgtcgtcggtcgttacgacggttaacgtcgttaccgtttaccgtaacccccagtttcccggtaccgggaaccgtaacgtaaccgttaccctaaccgttgggaaccccttaaccggaaccctttccccgttaactaaacccggtaaactaaacccggacctacccgttaaactaacggtaccgggttaagtttacgggaaaacggccgggtacccttaggaaacccgacgtttaaccgtcgggtaaacccgaacggtacccggtacccggtttactttaacggttaacccttgggttaaccgaccgggttacgacccggttaaacccgtccggaccggttacggggtacaccccggtaccggggttaaccgccgtaacgggcccggtttaccgtttccgggttaaccttccggggttaacccgggg

SEQ ID NO: 208457 - DNA, 589 bp, Homo sapiens
  misc_feature: GYAE6OF02FW2F4.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaattgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggacgaaccctaacacgtggtcgtacactagtgtcttacaccctatcccgtaccggggacacgtaccttaccatcgaccacgaacctcctaccaataaaccacacgccctaacagtggaagttgaaggacgtcctagacctatcgtagaccgaccgtacggtcccgttacttaacgttacgtggtcgacggtagacgtcccgacggtacgtaccggtcggacgcccgtaacggcacggtccgtccgtttacgtaccgttcggtaccgggg

SEQ ID NO: 208458 - DNA, 579 bp, Homo sapiens
  misc_feature: GYAE6OF02GSOLJ.17.25.C03.1.454.CMB.1.raw
  modified_base (281)..(281): a, c, t, g, unknown or other
  misc_feature (281)..(281): n is a, c, g, or t
  modified_base (292)..(292): a, c, t, g, unknown or other
  misc_feature (292)..(292): n is a, c, g, or t
  modified_base (417)..(417): a, c, t, g, unknown or other
  misc_feature (417)..(417): n is a, c, g, or t
  modified_base (480)..(480): a, c, t, g, unknown or other
  misc_feature (480)..(480): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactggggtncgccaggccgntggacacgacctgagtggatgggatggggcaaccctaacactgggtgtcacgtagtcgtcttcacccctatcccgtaccgggacacgaccttaccatcgaccacgaacctcctaccaataaaccncacgcctacatggagttgaggagcctgacagtctcgacgaccgacgggccttacttacttacnggttacgcgtaagacgtaccccaggacgttcccgggtagacgtacccgttacgggccacgggtcccggttccttttaggacccgtttcggtaccggggg

SEQ ID NO: 208459 - DNA, 618 bp, Homo sapiens
  misc_feature: GYAE6OF02JLBCM.17.25.C03.1.454.CMB.1.raw
  modified_base (301)..(301): a, c, t, g, unknown or other
  misc_feature (301)..(301): n is a, c, g, or t
  modified_base (345)..(345): a, c, t, g, unknown or other
  misc_feature (345)..(345): n is a, c, g, or t
  modified_base (379)..(379): a, c, t, g, unknown or other
  misc_feature (379)..(379): n is a, c, g, or t
  modified_base (400)..(400): a, c, t, g, unknown or other
  misc_feature (400)..(400): n is a, c, g, or t
tcagcgtagactagcacgaccggtgctcgatttagtagtgtagatttgggtttggggtacgtcaacaaccacatctgtcctctagagaaaaccctagtgagcacagctcctcaccatggactggacctggaggatcctcttcttggtggcagcagctacaagtgcccactcccaggtgcagctggtgcagtctgggctgaggtgaagagcctggggcctcagtgaagtctcctgcaaggcttcgtggattcgacgtttaccctcctatagtaatcgaactgggtagccggacctagggccncgtcgggaccaaaaccggacccttggaaggttggaattggggancggggactaaaccccgtaacacgtgggtctacanacggtcgtcttccgaaccctntacccgtcggacaagccttaacgatcgaaccaccgtaacctactccaaagtaacactacgctacagtggagttgaggacgcctagacctatacgtgaaccgtaccgaccggtccgttcttaagtaccgttgtacgccgtaagccggttacccaaggtccttacggtgaacgccccgtaggactcggtaccggtcccttttaggaccgttcgacggggg

SEQ ID NO: 208460 - DNA, 564 bp, Homo sapiens
  misc_feature: GYAE6OF02IN9KN.17.25.C03.1.454.CMB.1.raw
  modified_base (447)..(447): a, c, t, g, unknown or other
  misc_feature (447)..(447): n is a, c, g, or t
  modified_base (451)..(451): a, c, t, g, unknown or other
  misc_feature (451)..(451): n is a, c, g, or t
  modified_base (508)..(508): a, c, t, g, unknown or other
  misc_feature (508)..(508): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatcgggacgaaccctaacgacgtggtgtcacgagtgtccttcacccatccgtcgggacagacttaccatcgaccacgaacctcctaccaataaaccacacgcctaacatgggagttgaaggacgcctgaacntcgngaccgacgaccggccgttatacttactggtcgcgagacgtcccaacgcgttccgggngacgtacccgtacggccgacggccggtcccgttttacggaccgttcggtccggggg

SEQ ID NO: 208461 - DNA, 601 bp, Homo sapiens
  misc_feature: GYAE6OF02FJJT4.17.25.C03.1.454.CMB.1.raw
  modified_base (339)..(339): a, c, t, g, unknown or other
  misc_feature (339)..(339): n is a, c, g, or t
  modified_base (413)..(413): a, c, t, g, unknown or other
  misc_feature (413)..(413): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaggcttctggattcacgtttacctcctatagtatcaactgggtgcgccgagccgctggacaacgacctgagtggatgggatgggaccaaccctaacacgtggtntcacagtgtcttccacccatcccgtccgggacagaccttaccatcgacccacgtaacctcctaccaataaaccncacgccctaacatggacgttgaggtacgcctgactatccgtagaaccgaccgtacggtcccgttattacgttacctggtacgcgaaggtaccgtacccgacggtaacgtcccgggtagaaccgtccccgttaacgggccgtacggtcccgggttacccttttacgggaccgtttccggtaccgggggg

SEQ ID NO: 208462 - DNA, 562 bp, Homo sapiens
  misc_feature: GYAE6OF02HRFV0.17.25.C03.1.454.CMB.1.raw
  modified_base (279)..(279): a, c, t, g, unknown or other
  misc_feature (279)..(279): n is a, c, g, or t
  modified_base (447)..(447): a, c, t, g, unknown or other
  misc_feature (447)..(447): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggcctcagtgaaggtctcctgcaaggcttctggattcacgtttacctcctatagtatcaactgggtncgccaggccgctggacaacggacctggagtggatggggatgggcgaaccctaacacgtggtgtcacgagtgtcttcacccatccctcgggacagacttaccatcgaccacgtaacctcctaccataaaccacagccctaacatggagttgaggagtcctagacattcngacgaccgacggtcctacttagttactgtgcggaagtcgtccccacggtactcccgggtagaccggtcccgtacgggccaggtccggtcccttttaggacctttcggtacggggg

SEQ ID NO: 208463 - DNA, 531 bp, Homo sapiens
  misc_feature: GYAE6OF02FP7ON.17.25.C03.1.454.CMB.1.raw
  modified_base (367)..(367): a, c, t, g, unknown or other
  misc_feature (367)..(367): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgcaaggccgctggacaacgacctgagtggatgggatggggcaaccctaacactggtgtcacagtgtcttcacccatcctccgggangacttacatgaccacgaactcctacataaacacagcctacatggagttgaggagcctgacatctgacgacacggccgtctacttactgtcgcgagacgtcccacggtacgtccggtagacggcccgtacggcctacggccggtcctttggaccttcggtcgggg

SEQ ID NO: 208464 - DNA, 695 bp, Homo sapiens
  misc_feature: GYAE6OF02JL9SF.17.25.C03.1.454.CMB.1.raw
  modified_base (282)..(282): a, c, t, g, unknown or other
  misc_feature (282)..(282): n is a, c, g, or t
  modified_base (466)..(466): a, c, t, g, unknown or other
  misc_feature (466)..(466): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctggtcgggggtcagagtcaccatcacttcgccggacaagtcacggtacttaaaaccttatttaaattggtatcagacaagaaacctaggaaaacnccccaagtaccctcctagtactcgtactggtcgctactccacgtctgaccgaagtcggaccgtaccagttacggaggttacaggtggacgtaggtcggtaatcggtagggaactagttactttacgaacttcgtaccacctactacccacctacgttactacgacctaaccgttggaacggttnttacgtgtaaaccgttaacttaccgttaaccgttacgttacgtacctaaacgtacggttaacctttaacccgtaaccgtttccccgtacggtaaccgttttccggtttaccggaaccggtaacggggttaacccttaaggttcgaacggtaacgttaaccgtaaacggttaacggtaccgttacggtaccgttacgtaccctaaccgtacgtttacgttaccgttaccg

SEQ ID NO: 208465 - DNA, 686 bp, Homo sapiens
  misc_feature: GYAE6OF02HNLUW.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctgggcctcgagtgaaggtctcctgcaaggcttctggattctacgtttactcctatagtatcaactggtcgcgcaggccgctaggacaacggacctgagtgagtgggatgggacaaccctaacgactggtgtacacgtagtcgtcttacaaccctacgtccctaccgggaacaaggtaccttaaccgagtcgaacccaacgtaaaccttccctaaccaaactaaaaccactacgacctacaagtcgggtaacgttaggacggaacgccgtagaacctagttcctacggaaccgtaccgaccggggtacccgttaacgttaagtttaaccgttcggttacggacggtaaccggtacccgtaccccgtaacgggtaacgttccccggggttagaaaccccgggtcccgttaacccggggactaaccgggggtcccggttacccccgtttttaaggacccggtttcccgggtaaccgggggg

SEQ ID NO: 208466 - DNA, 723 bp, Homo sapiens
  misc_feature: GYAE6OF02I4CY5.17.25.C03.1.454.CMB.1.raw
  modified_base (260)..(260): a, c, t, g, unknown or other
  misc_feature (260)..(260): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctgggaggatcctcttcttggtggcagcagctacaagtgcccactcccaggtgcagctggtgcagtctggggctgaggtgaagaagcctgggcctcagtgaaggtctcctgcaaggcttctggattcacgtttaccncctatagtatcaactgggtgcgccaggccgcgtaggacaacgacctggaggtggagtggggatggggaccgaaacccctaaacgacgttgggttacgtaccgaacgaggttcggttcctttaccgaacccctacgttcccgtacccggggaactaacggtaccttaaccagtacgaacccaaccgtaaacctccctacctaaataaaaccaccaacgtaccctaactaagtacgggtaacgttgggaaacgggacgtacccgtaggaacctagttccgtacggaaccgtaaccgtaccgggacccgtttacttaacgtttaacgtcggttaacgacccgggtaagaccggttaccccgaacggtacggttaccccgggtaggaacccggtacccgttaacccgggactaacgggtcccgggtttcccgtttacggttacccgtttaccgggtacccggggggg

SEQ ID NO: 208467 - DNA, 582 bp, Homo sapiens
  misc_feature: GYAE6OF02FZDPN.17.25.C03.1.454.CMB.1.raw
  modified_base (276)..(276): a, c, t, g, unknown or other
  misc_feature (276)..(276): n is a, c, g, or t
  modified_base (309)..(309): a, c, t, g, unknown or other
  misc_feature (309)..(309): n is a, c, g, or t
  modified_base (350)..(350): a, c, t, g, unknown or other
  misc_feature (350)..(350): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacgttaaaacctattaaattggtatcagcagaacctaggaaacnccccagacctctgatctctggtgcatccactcngcgaagtcggctccatcgagttcaggtggctaggtgatcgngggacagtatttcaatctacacctactaccacctactctcgaccaaccgtggtaggtattgtacgactaattcctaacttacgtagtaaccaacgagtaacgtttaccgtaccgtttacccccgtacgtccttacgttttcggaccgtaacggggtaaccttaaggtgaacgtaacgtaacgaaaccggtacgtaggtacggtcctacggacctacctacttccgtgttacc

SEQ ID NO: 208468 - DNA, 804 bp, Homo sapiens
  misc_feature: GYAE6OF02JX8PN.17.25.C03.1.454.CMB.1.raw
tcagcgtagactagcacgaccggtgctcgatttagtagtgtagatttgggtttggggtacgtcaacaaccacatctgtcctctagagaaaaccctagtgagcacagctcctcaccatggactggacctggaggatcctcttcttggtggcagcagctacaagtcgcccactcccaggtgcagctggtgcagtcgtggggctgaggtgaagaagccgtgggcctcgagtgaaggtctcctgcgaaggtcttcgtggacttcgtacgtttaccctccgttaatagtactacaacgttggggtcgacgccgaggtcccgcgtacgggaaccaaaccggaccttggaacggttggaggttaggggcgtacgggggaccgtaaaacccctaacgtacggtgggttagtccgaaacgtgggttacgttccttacccacccgtacgtcccgttaccggggactaacggtacttaacccgagtaccggaaccctaaccggtaaaccctccccgtaacctaaaactaaaacccggacctacggaccccttaaacgagtacggggttaagttcgggaaacgggacgtacccgttaagaaccgaagttcctaacgggaaacccgtacccggtaaccggggttccctttaactaccgttttaagccgggttaaaggccgtaacgtacccgggttccccaaacgggttcccgggtttaccgggtaaggaccccgtttaccccgggaaccgggtaccgtaacggggtcccggtttttccccgtttaggaacccggttttcccggggtaaccggggggg

SEQ ID NO: 208469 - DNA, 593 bp, Homo sapiens
  misc_feature: GYAE6OF02G0MSK.17.25.C03.1.454.CMB.1.raw
  modified_base (447)..(447): a, c, t, g, unknown or other
  misc_feature (447)..(447): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtgcgccaggccgctggacaacgacctgagtggagtgggatgggaccgaaccctaacgacgtggtgtacagagtgtcttcaccctatccgtccggacagtaccttaccatcgaccaacgaacctcctaccaataaaaccacacgccctaagactgggacgttggacggacncctgactattctaggaccgacgaccgggtccgttacttaacgttacgtggtacgacgaggtaccgtcccgaacggtcgttacccgggtagaccggtcccgtacgggacacgggtccggtcccttttaggacctttcggtacggggg

SEQ ID NO: 208470 - DNA, 626 bp, Homo sapiens
  misc_feature: GYAE6OF02HCRA0.17.25.C03.1.454.CMB.1.raw
  modified_base (279)..(279): a, c, t, g, unknown or other
  misc_feature (279)..(279): n is a, c, g, or t
  modified_base (513)..(513): a, c, t, g, unknown or other
  misc_feature (513)..(513): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtncgccaggccgctggacaacgacctggagtggatggggatggggaccaaaccctaacacgttggtgtccaacgaggtgttccttacacccctatcccgtaccgggacacgtaccttaccatcgaacccacgaacctccctaccaaactaaaccacacgaccctaacagtgggaagttggaggtacgcctgactatcgtggaaccgacgaccgggtcccgttacttaatttaccgnggtacgcgaagtccgtacccgaacggtcgttcccgggtaggaccgtacccggttaacgggaccgtacgggtccccggttaccttttacggacccgttttccgggtacgggggg

SEQ ID NO: 208471 - DNA, 601 bp, Homo sapiens
  misc_feature: GYAE6OF02H51K5.17.25.C03.1.454.CMB.1.raw
  modified_base (338)..(338): a, c, t, g, unknown or other
  misc_feature (338)..(338): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcgagtgaaggtctcctgcaaggcttctggacttcaccgtttacctcctatagtatcaacgttgggtgcgccaggccgctggacaacgacctgagtgagtgggatgggacaaccctaacncgtggtgacacgtagtcgtcttccaccctactcccgtcgggaacacgtaccttaccagtcgaacccaacgacctccctaccaactaaaccacagaccctaactagtacggagttaggaacgacgcctagacatcgtacgaccgacgaccggccgtacttagttaccgtggtcgacgagtacgtacccgtaggcgttaccggtaggaccgtacccgtacgggcacgggtccggttacccttttggtacccgttcggtaccgggg

SEQ ID NO: 208472 - DNA, 527 bp, Homo sapiens
  misc_feature: GYAE6OF02FWYRW.17.25.C03.1.454.CMB.1.raw
  modified_base (448)..(448): a, c, t, g, unknown or other
  misc_feature (448)..(448): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggggcctcagtgaaggtctcctgcaaggcttctggattcacgtttacctcctatagtatcaactgggtgcgccaggccgctggacaacgacctgagtggatgggatgggcgaaccctaacactggtgtcacgagtgtcttcacccatccgtccgggacagaccttaccatgaccacgaactcctaccaataaacacacgcctacatggagttgaggacgcctgacatctgacgacncggctctattactgtgcgagacgtcccacggctccggtgacgccgtacggcacggccggtctttcgtacttcgtcgggg

SEQ ID NO: 208473 - DNA, 577 bp, Homo sapiens
  misc_feature: GYAE6OF02GDVVB.17.25.C03.1.454.CMB.1.raw
  modified_base (278)..(278): a, c, t, g, unknown or other
  misc_feature (278)..(278): n is a, c, g, or t
  modified_base (289)..(289): a, c, t, g, unknown or other
  misc_feature (289)..(289): n is a, c, g, or t
  modified_base (328)..(328): a, c, t, g, unknown or other
  misc_feature (328)..(328): n is a, c, g, or t
  modified_base (335)..(335): a, c, t, g, unknown or other
  misc_feature (335)..(335): n is a, c, g, or t
  modified_base (339)..(339): a, c, t, g, unknown or other
  misc_feature (339)..(339): n is a, c, g, or t
  modified_base (404)..(404): a, c, t, g, unknown or other
  misc_feature (404)..(404): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctggggcctcagtgaaggtctcctgcaaggcttctggattcacgtttacctcctatagtatcaactgggtncgccaggccgntggacaacgacctgagtggatgggatggggcaaccctanactggtntcangtgtcttcacccatccgtcgggacacgtacttaccgatcgaccacgaactcctaccaataaaccncagacctacactggattgaggtagcctagactatcgtagacgaccgaccgggccgttacttagtttaccgtgtcggaccgagtacggtaccccaaggtaccggtcccggtaggaccgtcccgtaacgggctaaccggccggttccctttaggtaccgtttcggtacccggggg

SEQ ID NO: 208474 - DNA, 620 bp, Homo sapiens
  misc_feature: GYAE6OF02GBSST.17.25.C03.1.454.CMB.1.raw
  modified_base (326)..(326): a, c, t, g, unknown or other
  misc_feature (326)..(326): n is a, c, g, or t
  modified_base (333)..(333): a, c, t, g, unknown or other
  misc_feature (333)..(333): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctggggcctcagtgaaggtctcctgcaaggcttctggattcacgtttacctctatagtatcaactgggtgcgccaggccgctggacaacgacctgagtggatgggatgggcaaccctanactggtntcacagtgtcttcacccatccgtcggacagaccttaccatcgacccacgaacctcctaccaataaaccacacgacccttaacgatagggtacgtttaggagggtacgcccttagacctattccgtaggaaccgaccgaccgggtcccgttacttaactttaaccgtggtacgtccgaaggtaccggttcccgaacggtacgttcccggggtagaacccggtacccgttaacggggccctacgggtcccggttaccttttacggaccgttttccgggtacccgggggg

SEQ ID NO: 208475 - DNA, 747 bp, Homo sapiens
  misc_feature: GYAE6OF02JEX2G.17.25.C03.1.454.CMB.1.raw
  modified_base (330)..(330): a, c, t, g, unknown or other
  misc_feature (330)..(330): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagctggggcctcagtgaaggtctcctgcaaggcttctggattcacgtttacctctatagtatcaactgggtgcgccaggccgctggacaacgacctggagtggatgggatggggcgaaccctanacgtggtgtcacgtagtgtcttaccgaccctagttcccgtaccggggaactacggtaacccttaacccgacgttacgaaccctaaccggtaaacccttcccgttaaccccaaatttaaaaacccgaccgtaacggtaccccttaactaacgttacggggtaacgtttacgggaacgggtacggtacccgttagggaacctaagttcccgttaagggaacccgacccggtaacccggggtcccggttaccttaacgtttaaaccgtcgggttacggaccgggtaaggtacccggttaccccgaaccgggttaacggttaccccgggttaggtaaccggtacccggttaaccggggccgtaaacggggtcccgggttaccccttttgggtacccggtttttccgggtaacccggggggg

SEQ ID NO: 208476 - DNA, 536 bp, Homo sapiens
  misc_feature: GYAE6OF02GJR3G.17.25.C03.1.454.CMB.1.raw
  modified_base (279)..(279): a, c, t, g, unknown or other
  misc_feature (279)..(279): n is a, c, g, or t
  modified_base (290)..(290): a, c, t, g, unknown or other
  misc_feature (290)..(290): n is a, c, g, or t
  modified_base (329)..(329): a, c, t, g, unknown or other
  misc_feature (329)..(329): n is a, c, g, or t
  modified_base (413)..(413): a, c, t, g, unknown or other
  misc_feature (413)..(413): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtncgccaggccgntggacaacgacctgagtggatgggatgggcgaaccctanactggtgtcacagtgtcttcacccatcctccgggacaggaccttaccatgaccacgaacctcctccaataaaccacagccctanatggagttgaggtagccctgacatctgaccgacacggccgtctacgttactggtgcgagtacgtcccacggtactccggtgacgccgtacggcacggccgtccgtttggtaccttgtacgggg

SEQ ID NO: 208477 - DNA, 568 bp, Homo sapiens
  misc_feature: GYAE6OF02HX8AM.17.25.C03.1.454.CMB.1.raw
  modified_base (290)..(290): a, c, t, g, unknown or other
  misc_feature (290)..(290): n is a, c, g, or t
  modified_base (423)..(423): a, c, t, g, unknown or other
  misc_feature (423)..(423): n is a, c, g, or t
  modified_base (516)..(516): a, c, t, g, unknown or other
  misc_feature (516)..(516): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcgtggattcacgtttacctcctatagtatcaactgggtgcgcaggccnctggacaacgactgacgtggatgggatggggaccaaccctaacacgtggtgcacgtagtgtcttcacccatccgtacgggactagacttaccagtcgaccacgaacctcctaccaataaaccacactacctanagtaggagttgacggacgcctagacattcgacgacgaccgacggccttactagttacgtgtacgacgtacgtacgtcccgagtcgtccgggtnaaccggtccgtacggcacggtccggttaccgtttgaccgtttcggtacgggg

SEQ ID NO: 208478 - DNA, 651 bp, Homo sapiens
  misc_feature: GYAE6OF02IWM8H.17.25.C03.1.454.CMB.1.raw
  modified_base (243)..(243): a, c, t, g, unknown or other
  misc_feature (243)..(243): n is a, c, g, or t
  modified_base (596)..(596): a, c, t, g, unknown or other
  misc_feature (596)..(596): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaaggcttcnggattcacgtttacctcctatagtatcaacgtgggtgcgccaggccgctggacaacggtacctggagtcgggagtggggacgtggggaccgtaaacccctaacgaccgtgggtcgtacgactaaggttcgttcttacccaaccctactcccgttacccggggaacacggtaaccttaccaacgtcgaacccaacgtaacctccctacaaacgttaaaccaccacgtaccctaacaagtacggtagttacggaacggtacgcccttaaggaccagttctagaccgtaacaccgggtacccgtcttaacgttaccgtgtacggacgacgacgttaccccgaggacgttcccgggngaaccgtcccgtaacggtcgacggtcccgtccgtttagaccgttcgtaccggggg

SEQ ID NO: 208479 - DNA, 554 bp, Homo sapiens
  misc_feature: GYAE6OF02I8M2T.17.25.C03.1.454.CMB.1.raw
  modified_base (332)..(332): a, c, t, g, unknown or other
  misc_feature (332)..(332): n is a, c, g, or t
  modified_base (339)..(339): a, c, t, g, unknown or other
  misc_feature (339)..(339): n is a, c, g, or t
  modified_base (342)..(342): a, c, t, g, unknown or other
  misc_feature (342)..(342): n is a, c, g, or t
  modified_base (355)..(355): a, c, t, g, unknown or other
  misc_feature (355)..(355): n is a, c, g, or t
  modified_base (375)..(375): a, c, t, g, unknown or other
  misc_feature (375)..(375): n is a, c, g, or t
  modified_base (532)..(532): a, c, t, g, unknown or other
  misc_feature (532)..(532): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcctggggcctcgagtgaaggtctcctgcaggcttctggattcacgtttacctctatagtatcaactgggtgccgccaggccgctcggacaacgactgagtggatgggatcgggacaacctacncgtggtncangtctcttcacctntccgtcggacagtacctacntcgaccacgacctcctacaactaaacactacgactacacgtggagttgaggacgctgactatctagacgaccgaccggtccgtactaacgttactggtgacgtagacgtacccgacggtacgtaccggtgaccgtcctacgggctacggtcccggtntttccggtacttggtaccgggg

SEQ ID NO: 208480 - DNA, 567 bp, Homo sapiens
  misc_feature: GYAE6OF02HHMPD.17.25.C03.1.454.CMB.1.raw
  modified_base (290)..(290): a, c, t, g, unknown or other
  misc_feature (290)..(290): n is a, c, g, or t
  modified_base (414)..(414): a, c, t, g, unknown or other
  misc_feature (414)..(414): n is a, c, g, or t
  modified_base (430)..(430): a, c, t, g, unknown or other
  misc_feature (430)..(430): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaacgtgggtgcgccaggccnctggacaacgacctgagtggatgggatgggaccgaaaccctaacacgtggtgcacagtgtcttcacccatccgtccggacacgacttaccatcgaccacgactcctacaataaacacagcctanagtggagttggagacncctagacatcgagaccgacgaccggtccttactacttaccgtggtacgacgtacgaccgtcccgaacggtacgttccggtagaaccgcccgttaacggcgacgggtccggttccctttagaccgtttcggtacgggg

SEQ ID NO: 208481 - DNA, 598 bp, Homo sapiens
  misc_feature: GYAE6OF02H85Y8.17.25.C03.1.454.CMB.1.raw
  modified_base (297)..(297): a, c, t, g, unknown or other
  misc_feature (297)..(297): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcaggtgaaggtcctccgtgcaaggcttcgtggtattcaccgtttacctcctatagtatcaactgggtgcgccaggccnctggacaacgacctgagtggatgggatcgggcgaaaccctaacgctggtgtacacgagtcgtcttccaccctagtcccgtaccgggacagtaccttaccatcgaccaacgaacctcctaccaataaaccacacgacctacagtaggtagttgaaggacgcctagactactcgtaggaaccgaccgaccggtaccgtacttacttacgtgtacgacgagtaccgtacccgacggtactccggtgaaccgtcccgtacgggctacggtccggttcctttacggtaccgtttcggtaccggggg

SEQ ID NO: 208482 - DNA, 594 bp, Homo sapiens
  misc_feature: GYAE6OF02JDJK7.17.25.C03.1.454.CMB.1.raw
  modified_base (277)..(277): a, c, t, g, unknown or other
  misc_feature (277)..(277): n is a, c, g, or t
  modified_base (287)..(287): a, c, t, g, unknown or other
  misc_feature (287)..(287): n is a, c, g, or t
  modified_base (326)..(326): a, c, t, g, unknown or other
  misc_feature (326)..(326): n is a, c, g, or t
  modified_base (332)..(332): a, c, t, g, unknown or other
  misc_feature (332)..(332): n is a, c, g, or t
  modified_base (336)..(336): a, c, t, g, unknown or other
  misc_feature (336)..(336): n is a, c, g, or t
  modified_base (424)..(424): a, c, t, g, unknown or other
  misc_feature (424)..(424): n is a, c, g, or t
  modified_base (533)..(533): a, c, t, g, unknown or other
  misc_feature (533)..(533): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaggcttctggattcacgtttacctctatagtatcactgggtncgccaggccnctggacaacgcctggagtggatgggatgggcaacctacnctggtntcanagtgtccttcacccacgttccgtaccgggacagtaccttaccagttcgacccacgtaacctcccttaccaataaaccacacgcctaanacgtggagttcggaggactcctaggactagttcctaggacccgacctaccgggtcccgttccttaagtttccgtgtgaccgtagaccgtcccgaacggcgttacccggngaacccgtccgttaaccggcgtacggccggttaccttttcggaccgtttccggtacggggg

SEQ ID NO: 208483 - DNA, 518 bp, Homo sapiens
  misc_feature: GYAE6OF02F5AS3.17.25.C03.1.454.CMB.1.raw
  modified_base (278)..(278): a, c, t, g, unknown or other
  misc_feature (278)..(278): n is a, c, g, or t
  modified_base (329)..(329): a, c, t, g, unknown or other
  misc_feature (329)..(329): n is a, c, g, or t
  modified_base (404)..(404): a, c, t, g, unknown or other
  misc_feature (404)..(404): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgagagcctggggcctcagtgaaggtctcctgcaaggcttctggattcacgtttacctcctatagtatcaactgggtncgccaggccgctggacaacgacctgagtggatgggatgggcgaaccctaanactggtgtcacagtgtcttcacccatcctcgggacagacttacatgaccacgactcctcataaacacacacctanatggattgagagcctagacatctgacgacacggcctctattactgtgcgagcgtcccaggacttccggtgacgcccgtacggcaggccggtaccttttggaccttcggtcgggg

SEQ ID NO: 208484 - DNA, 555 bp, Homo sapiens
  misc_feature: GYAE6OF02G9EFR.17.25.C03.1.454.CMB.1.raw
  modified_base (408)..(408): a, c, t, g, unknown or other
  misc_feature (408)..(408): n is a, c, g, or t
  modified_base (416)..(416): a, c, t, g, unknown or other
  misc_feature (416)..(416): n is a, c, g, or t
  modified_base (431)..(431): a, c, t, g, unknown or other
  misc_feature (431)..(431): n is a, c, g, or t
  modified_base (470)..(470): a, c, t, g, unknown or other
  misc_feature (470)..(470): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacgactggtgtcacagtgtcttcacccatccgtccgggacagacttaccatcgacccacgaactcctaccaataaaccncagcctanactggagttgagacncctgacatcagacgacacgccgtcttagttactgtacgngacgacgtcccaaggtcgtcccgggtagacggacccgtaccgggacacggtccggtcccttttaggacccgtttcggtaccgggg

SEQ ID NO: 208485 - DNA, 533 bp, Homo sapiens
  misc_feature: GYAE6OF02GVDKU.17.25.C03.1.454.CMB.1.raw
  modified_base (280)..(280): a, c, t, g, unknown or other
  misc_feature (280)..(280): n is a, c, g, or t
  modified_base (291)..(291): a, c, t, g, unknown or other
  misc_feature (291)..(291): n is a, c, g, or t
  modified_base (328)..(328): a, c, t, g, unknown or other
  misc_feature (328)..(328): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgntggacaacgcctgagtggatgggatgggcaaccctanacgtggtgtcacgagtgtcttcacccatccctccgggacagaccttaccatcgaccacgactccgtaccaataaacacagcctacacgtggagttgaggacgcctgacatcgagacgacacggcctactacttactgtgcgagacgtcccaggtctcggtagacgtccgtacggcacggtccgtccgtttgaccgttcgtcgggg

SEQ ID NO: 208486 - DNA, 600 bp, Homo sapiens
  misc_feature: GYAE6OF02FW6FY.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaacctatttaaattggtatcagcagaaacctggaaaagccccagacctcctagactctctggtgcatccactctgcgaagtggcctccatcgagttcagtggcagtggatcgtagggactagatttcaattctacaactataccaccctactctacgaccaaaccgtggaaggtacttcggtagtacctaaatttcctaaccttacttcggtaacaacgtaacggtacgtttaccgtaccgtttcccccgtcgtaccgttacgttttcggacccgtaaggggtaccctaaggttcgaacggtaataaccgaaaccggtaaccttggtacggcctacggaccaccgtaagttccgttgttacc

SEQ ID NO: 208487 - DNA, 695 bp, Homo sapiens
  misc_feature: GYAE6OF02HBSBH.17.25.C03.1.454.CMB.1.raw
  modified_base (193)..(193): a, c, t, g, unknown or other
  misc_feature (193)..(193): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtttcgngggctgaggtgaagaagccgtgggcctcgagtgaaggtctcctgcaggcttctggattctacgtttacctcctatagtatcaacgtggtgcgccgaggccgcgtcggacaacgtaccgtgagtggatggggagtcgggaccgtaaacccgtaacgaccgttgggtactaccgacgtagttcgttaccttaccaaccccgtacgttcccgtaccggggaacctaacgtaaccctttaaccgacgtttcgaaccctaacccgtaaacctcccctaaccaaacgttaaaacccacgtacgtaccctaacgtacgtacggtagttacggacgtacgcctagacctatcgtacgaccgtacgaccggtaccgttcttaacgtttcgtacggtacgtaccgtacggtaccgtccccgaacggtaccggtacccgggtaggtaaccggtacccgtacggtccgacgggtcccggttacccgttttacggaccggttcccggtaccgggg

SEQ ID NO: 208488 - DNA, 592 bp, Homo sapiens
  misc_feature: GYAE6OF02JBXHF.17.25.C03.1.454.CMB.1.raw
  modified_base (367)..(367): a, c, t, g, unknown or other
  misc_feature (367)..(367): n is a, c, g, or t
  modified_base (427)..(427): a, c, t, g, unknown or other
  misc_feature (427)..(427): n is a, c, g, or t
  modified_base (435)..(435): a, c, t, g, unknown or other
  misc_feature (435)..(435): n is a, c, g, or t
tcagcgtagactagcacgaccggtgctcgatttagtagtgtagatttgggtttgggggacgtcgaacaaccacatctgtcctctagagaaaaccctgtgagcacagctcctcaccactggactggacctggaggatcctcttcttggtggcagcagctacaagtgcccactcccaggtgcagctggtcgcagtcgtggggctgaggtgaagaagcctggggcctcagtgaaggtctcctgcaaggtcttgtggaggcaccttcagcgactatagttcaagttgggtgcgacgggcctcgtaggacaaggccttggagtgggagtcggggaaggacgtcgtccctagtcgttgacacaccaaactacncacagaacgttccgagggcagactcaccataaccgcgaacaaataacgaacacagttaanctagggancgtacgaacgacgtctgtactatcgtagacggacgacggtccttcgtacttctagtacgacggtaggtaacgtacgttactaagtaacgtactcgtacctttacccgtttactacccgttaccgttacgtaccgttacggtcgggtaccctacccgg

SEQ ID NO: 208489 - DNA, 704 bp, Homo sapiens
  misc_feature: GYAE6OF02IVYN5.17.25.C03.1.454.CMB.1.raw
  modified_base (350)..(350): a, c, t, g, unknown or other
  misc_feature (350)..(350): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgttttacctcctatagtatcaacgtgggtgcgccaggccgcgtggaaccaacgacctggagtggatggggatgggaccgaaaccctaagacgttggtntacacgagttcgtacttccacccctacgttccgtaccgggaactacggtaacccttaaccgatacgaacccaaccgtaaacccttccccgtaacccgaaaacttaaaaccaccgtaacggtaccccttaaacgagttacgggtaacggtttcggaacgggacctcccgttagaacctattccgtaacggaaccgaccgtaaccggggtccctttaacttaacgtttaaccgtcgggttagacccggtaaggtaccgttccccgaacggttcgttacccgggtagtaacccggtacccgtacggaccgagggttccccggttacgttttacggacccgttttcgggaccgggggg

SEQ ID NO: 208490 - DNA, 644 bp, Homo sapiens
  misc_feature: GYAE6OF02G5VNM.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcgagtgaaggtctcctgcaaggcttctggattcacgtttacctcctatagtatcaactgggtgcgccgaggcccgcgtcggaacaacgacctggagtggatgggagtcgggacgaaaccctaacgacgtggtcgtcacgagttcgtcttccacccatcccgtacgggacagtaccttaccatcgaccacgaacctcctacaataaaccacaacgccctaacaagtacgggtagttacggaaggtacgccgtacgaacctaacgttcgtacggaaccgaaccgtacccgggtcccgttacgttaactttaaccggtgttacggaccggtaacgacggttaccccgacggtaaccgttaccgggtaggtaccgacccgttaaccgggctacggtcccggtccgttttacggaccgttcggtacgggg

SEQ ID NO: 208491 - DNA, 565 bp, Homo sapiens
  misc_feature: GYAE6OF02IUT4N.17.25.C03.1.454.CMB.1.raw
  modified_base (271)..(271): a, c, t, g, unknown or other
  misc_feature (271)..(271): n is a, c, g, or t
  modified_base (322)..(322): a, c, t, g, unknown or other
  misc_feature (322)..(322): n is a, c, g, or t
  modified_base (347)..(347): a, c, t, g, unknown or other
  misc_feature (347)..(347): n is a, c, g, or t
  modified_base (424)..(424): a, c, t, g, unknown or other
  misc_feature (424)..(424): n is a, c, g, or t
  modified_base (429)..(429): a, c, t, g, unknown or other
  misc_feature (429)..(429): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctcctgtctgcctctggtgggggtcagagtcaccatcacttgccggacagtcacggacttaaaactattaaatggtatcagcagaaacctaggaaaacnccccagaccctctgactctcgtggtgcatccactctgcgaagtggcctccntcgagttcagtggcaggtggatcgngggactagtattacatctcactactccaacctctctgacctaaccgtgaggtacttggtgactatccttactactanacaanagtacgttactaccgtttccctctacgtttaccgtttcggaccgtacggggaacctaaggttcggaacgtacttaaaccggaaacgttaacgttcggtacggtactaccgacctaacctacgttacctggttaccc

SEQ ID NO: 208492 - DNA, 528 bp, Homo sapiens
  misc_feature: GYAE6OF02FIZKJ.17.25.C03.1.454.CMB.1.raw
  modified_base (280)..(280): a, c, t, g, unknown or other
  misc_feature (280)..(280): n is a, c, g, or t
  modified_base (338)..(338): a, c, t, g, unknown or other
  misc_feature (338)..(338): n is a, c, g, or t
  modified_base (432)..(432): a, c, t, g, unknown or other
  misc_feature (432)..(432): n is a, c, g, or t
  modified_base (466)..(466): a, c, t, g, unknown or other
  misc_feature (466)..(466): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatggggcgaacctaacactggtntcacagtgtcttcaccctatccgtccgggacacggacttaccatcgaccaacgaactccctaccaataaacacacgcctacagtgagttgaggncctgacatctgacacacggctctatactgtacgngagtcccagtacgtccggtgacgcctacggctacgcggtccttggacttcgtggggtacccg

SEQ ID NO: 208493 - DNA, 586 bp, Homo sapiens
  misc_feature: GYAE6OF02GE920.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctggggcctcagtgaaggtctcctgcaaggcttctggattctacgtttacctctatagtatcaacgtgggtgcgccaggccgcgtggacaacgacctgacggtggatgggagtgggacaacccgtaacgactggtcgtcacgagttcgtcttaccaccctagtcccgtacgggacacggtaccttaccactcgaccacgtaacctcctaccaataaacacacgacctagagtggagttgaaggtcgacctgacatcgagaccgtacgacggtcccgtacttacttacgtgtcgacgacggacgtacccgaggtacgttccggtacggaccgtccgtaccggcacgggtcccggtcctttcggaccgttcggtaccgggg

SEQ ID NO: 208494 - DNA, 733 bp, Homo sapiens
  misc_feature: GYAE6OF02G2YU5.17.25.C03.1.454.CMB.1.raw
  modified_base (283)..(283): a, c, t, g, unknown or other
  misc_feature (283)..(283): n is a, c, g, or t
  modified_base (649)..(649): a, c, t, g, unknown or other
  misc_feature (649)..(649): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggtcttcgtggattcacgtttacctcctatagtatcaactgggtncgccaggccgctggaccaacgacctgacgtggatgggatcgggaccgaaaccctaacgacgttggtacgtacaacgtacgtgttccgttaccaccccgtaactcccggtacccggggaactaacgggtaacccttttaacccgaagttacccgggtaacccctaaacccggtaaaaccctttccccgttaaaccccaaaacgtttaaaaaaccccgaccttaaaccgggtaccccctttaaaacgaacgttaacgggggttaaactttacggggaaacggggtacccggtaccccttaagggaaaccctacgttaccggtacgaaaccggaacccgtaacccgggtccgttactacgtttaaccgngtaccgacgtacgaccgtacccgacggtcgtcggtacgacgtcccgtacggcgtcggtccgttactttgaccgttgggaccggg

SEQ ID NO: 208495 - DNA, 595 bp, Homo sapiens
  misc_feature: GYAE6OF02IWNOI.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagccgtgggcctcagtgaaggtctcctgcaaggcttcgtggtattctacgtttacctcctatagtatcaacgtgggtcgcgccaggccgcgtggacaacgacctggacggtggagtgggagtgggaccgaaacccctaacacgtggtgtacacgagttcgtccttccgacccctatcccgtaccgggacacgtaccttaccatacgaccaacgaacctccctaccaataaaccacacgccctaacagtaggagttagaggacgtccgtgacagtcgtcgacgaccgaccggtccgttacttacttacgtgtgacgagtacgtacccgacgcgtccggtagacgccgtacggccgcggtaccggtcctttaggtaccgttcggtaccgggg

SEQ ID NO: 208496 - DNA, 633 bp, Homo sapiens
  misc_feature: GYAE6OF02ILAR5.17.25.C03.1.454.CMB.1.raw
  modified_base (242)..(242): a, c, t, g, unknown or other
  misc_feature (242)..(242): n is a, c, g, or t
  modified_base (259)..(259): a, c, t, g, unknown or other
  misc_feature (259)..(259): n is a, c, g, or t
  modified_base (278)..(278): a, c, t, g, unknown or other
  misc_feature (278)..(278): n is a, c, g, or t
  modified_base (289)..(289): a, c, t, g, unknown or other
  misc_feature (289)..(289): n is a, c, g, or t
  modified_base (327)..(327): a, c, t, g, unknown or other
  misc_feature (327)..(327): n is a, c, g, or t
  modified_base (377)..(377): a, c, t, g, unknown or other
  misc_feature (377)..(377): n is a, c, g, or t
  modified_base (457)..(457): a, c, t, g, unknown or other
  misc_feature (457)..(457): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgagaagcctggggcctcagtgaaggtctctgcaaggcttcnggattcacgttttaccnctatagtatcaactgggtncgccaggccgntggacacgactgagtggatgggatgggacgaccctaanctggtgcacgagtgtccttcgacccatcctcgacggacacgtacttaccntaccgaccaccgtaacccgtcctaccgaaataaaccacgtacgtacctacagtagggagttacggagtacgcctagtacnttacgacgtacgaaccgacgggtcccttacttaagttaccttaggtccgtaaccggaggtaacccgtaccccgaagggttaccctacccgggggttaagccgggttaacccccggacggggtacctacccgggtcccggggtttacctttttaccgggcccggttttacccggggg

SEQ ID NO: 208497 - DNA, 557 bp, Homo sapiens
  misc_feature: GYAE6OF02F73BP.17.25.C03.1.454.CMB.1.raw
  modified_base (345)..(345): a, c, t, g, unknown or other
  misc_feature (345)..(345): n is a, c, g, or t
  modified_base (440)..(440): a, c, t, g, unknown or other
  misc_feature (440)..(440): n is a, c, g, or t
  modified_base (450)..(450): a, c, t, g, unknown or other
  misc_feature (450)..(450): n is a, c, g, or t
  modified_base (476)..(476): a, c, t, g, unknown or other
  misc_feature (476)..(476): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctctatagtatcaactgggtgcgccaggccgcgtggacacgacctgagtggatgggagtgggaccgaaccctaacgacgtggtgtcangtgtcttccaccctatccgtccgggacacgtaccttacatcgaccacgaacctcctaccaactaaacacagaccctacaatggagttgaggtacnctgacagtcngaaccgcgaccggccgtctaagttcnggtcgacgacgacgtcccacggtcgtccggtagaccgaccgtacggccacggccgttccctttggacctttcggaccgggg

SEQ ID NO: 208498 - DNA, 551 bp, Homo sapiens
  misc_feature: GYAE6OF02GZ3X5.17.25.C03.1.454.CMB.1.raw
  modified_base (434)..(434): a, c, t, g, unknown or other
  misc_feature (434)..(434): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcaacctaacgactgggtgtcacgtagtgtcttcaccctatccgtccgggacacgactttaccatcgaaccacgaacctcctccaataaacacagccctacatcggattgaggancctgacatctagacacgacggcctatactttacgtgtcgcgagacgtcccgaggtacttccgggtgaacgtcccgtagggcctagggtccgtccccgttttaggacttccggcgggg

SEQ ID NO: 208499 - DNA, 573 bp, Homo sapiens
  misc_feature: GYAE6OF02IN0AA.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacggacctggagtggatgggatggggcgaaccctaacacctggtgtcacagtagtcgttcaccgatcccgtcgggacagacttaccatcgaccacgaacctccaccataaacacagcctacatggattggagcgcctgactatcgtagacgacacggccgttctaagttactggtacgcgtaacgacgttcccgaacggtacgttccgggagtaccggtacccgtaacgggcctacgggcccggttaccgttttcggtaccggttcgtaccgggggg

SEQ ID NO: 208500 - DNA, 565 bp, Homo sapiens
  misc_feature: GYAE6OF02ITF7I.17.25.C03.1.454.CMB.1.raw
  modified_base (334)..(334): a, c, t, g, unknown or other
  misc_feature (334)..(334): n is a, c, g, or t
  modified_base (341)..(341): a, c, t, g, unknown or other
  misc_feature (341)..(341): n is a, c, g, or t
  modified_base (420)..(420): a, c, t, g, unknown or other
  misc_feature (420)..(420): n is a, c, g, or t
  modified_base (449)..(449): a, c, t, g, unknown or other
  misc_feature (449)..(449): n is a, c, g, or t
  modified_base (480)..(480): a, c, t, g, unknown or other
  misc_feature (480)..(480): n is a, c, g, or t
  modified_base (504)..(504): a, c, t, g, unknown or other
  misc_feature (504)..(504): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctggagtggatggggatgggacgaaccctaanacgtggngtcacgagtgtcttcacccatcccgtccgggacacgacttaccatgaccacgaactccctcaataaaccacagccctanactgggagttggaggacgcctgacatcgngaaccgacaccgggtccgtctaactttacgngttcgacgtagacgtcccacggtnttcccgggtgaacgcccgtaaggccgacggtccggtcctttaggacccgttcgtacggggg

SEQ ID NO: 208501 - DNA, 684 bp, Homo sapiens
  misc_feature: GYAE6OF02G457O.17.25.C03.1.454.CMB.1.raw
  modified_base (279)..(279): a, c, t, g, unknown or other
  misc_feature (279)..(279): n is a, c, g, or t
  modified_base (302)..(302): a, c, t, g, unknown or other
  misc_feature (302)..(302): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaagtggtncgcaggtcgctggacaacgaccngagtggagtgggagtcgggacgtaaacccgtaactacgtggtcgtacgacgtagtcgtcttaccaccctatcccgtaccgggacacgtactttaaccgagttacgaacccgtaacgtaaccctcccgtaccctaaacgttaaaacccaccgaaccggtacccttaaacgacggttaccgggtaaggtttacggacggaacgtcccgtaaggaacctattccgaacggtaacccgtaaccggtaaccgggtcccgttacgttacgtttacgaggttcggacgtacgtaccgttacccgacggtacgtcccgggtaggtaaccggtacccgtaccgggcgtacgggtacccggttccgtttacggtaccgttcgggtaccgggg

SEQ ID NO: 208502 - DNA, 814 bp, Homo sapiens
  misc_feature: GYAE6OF02HDDK4.17.25.C03.1.454.CMB.1.raw
tcagcgtagactagcacgaccggtgctcgatttagtagtgtagatttgggtttggggactcgaacaaccacacctcctggttccctcgtagtagaaaaccctgttggagcacagctcctcaccatggactaggacctggaggatccgtctttcgttggtgggcagtcgttacgtcgttacgaacgttagttacccgacttccccaaggttgcgaggtctggtagctaggttcgtggggtcttgggaggtgtaagaacgccgtcggggccggttcaggtagaacggtcctccgtgcaaggtcttctggattctaccgtttacctctaattagttatctaacgtgggtcgcgccgaggcccgcgtggaccaaccggaccgtaggtacggtaggtaagtgggtacgtcggggtaaccgaaacccgttaaactacggttacgggtacgtacgaacgtaagttacgttacctttaacctaacccgttatcccggtaaccgggtaactacggtaaccttaaccgaagtccgtaacccgtaacgttaaccctcccgtaacctaaaataaaaccccgacgtaactaccccttaaacgaagttaccgggaagtttcggaaggtaccgtcccttaggaaaccttacggtctaaccgaacccgggtaacgtaaccggggcccttttacgtaaacgtttccggacggttacgccgtaaaggttcccgtaaccctaggtacgggtttccgggaagaccggtacccgttaacgggcgaaccgggttcccgggtttccgttttaagggtacccgttccgggacgggggg

SEQ ID NO: 208503 - DNA, 924 bp, Homo sapiens
  misc_feature: GYAE6OF02ITQOD.17.25.C03.1.454.CMB.1.raw
tcagcgtagactagcacgaccggtgctcgatttagtagtgtagatttgggtttggggactcaacaaccacatctgtcctctagagaaaccctgtgagcacagctcctcaccatggactggacctggaggactccgtcttctaggtgctagcagctacaagtcgccatcccaggtcgcagcctggtcgcgagtcgtggggcctaggaggttcgaacgtacggcccgtaggggccttacgacgttaggaacggttcctccgttgaccgtaagggtcttaccgtggtaacttccgtaaccggttttaacctcccgttaagttaacggttacgtaccgtaaaaccggttttcggggcgtaacccgtcccgtaaaggggttcccccggtaagtttacggggaaaccccttaaaccgggtaccggttacggtaaaccggttaccgggtaacgttaccgggggtaacgttaccgggggtacccgtaaaaaccccccgttaaggaaccggtttccgggttaccggttaacccgtaaaccgttaacgggtttacccgttaccggtttaacccgaacccggttaacggtttccccgggtaaccgggtaaaccgtaacggtaaccccgttttaaacccggaattttacccggggaaccccttaaacggtaaaacccgtttcccgtaaaccggtaaaccgttaaaaacccggcccgttttaccgggaacccctttaaccggggaacgttaccgggttaaggtttaacccggacggttacccgtaccgtaacgtaaccggtacttaccgtacggtacgaacccggtcggttaccgtacttaacgttctagtaccggtataccggtacgtccgaacgtcgtaccggtactacgtaccgtggtacccgacgtacgggtcctaggtacgttcggaaccgg

SEQ ID NO: 208504 - DNA, 524 bp, Homo sapiens
  misc_feature: GYAE6OF02IJUPJ.17.25.C03.1.454.CMB.1.raw
  modified_base (411)..(411): a, c, t, g, unknown or other
  misc_feature (411)..(411): n is a, c, g, or t
  modified_base (424)..(424): a, c, t, g, unknown or other
  misc_feature (424)..(424): n is a, c, g, or t
  modified_base (434)..(434): a, c, t, g, unknown or other
  misc_feature (434)..(434): n is a, c, g, or t
  modified_base (483)..(483): a, c, t, g, unknown or other
  misc_feature (483)..(483): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacacgtggtcgtcacagtgtcttcacccatccgtcgggacagaccttacatcgaccacgactccacaataacacacgcctanatggagttgaggncctgacatcngacgacacggcctactattacgtgtcgcgagcgtcccgacgcgtccggngacgcccgtacggcacggccggtcctttgccttcggtcggg

SEQ ID NO: 208505 - DNA, 551 bp, Homo sapiens
  misc_feature: GYAE6OF02GR7FK.17.25.C03.1.454.CMB.1.raw
  modified_base (280)..(280): a, c, t, g, unknown or other
  misc_feature (280)..(280): n is a, c, g, or t
  modified_base (332)..(332): a, c, t, g, unknown or other
  misc_feature (332)..(332): n is a, c, g, or t
  modified_base (418)..(418): a, c, t, g, unknown or other
  misc_feature (418)..(418): n is a, c, g, or t
  modified_base (435)..(435): a, c, t, g, unknown or other
  misc_feature (435)..(435): n is a, c, g, or t
  modified_base (446)..(446): a, c, t, g, unknown or other
  misc_feature (446)..(446): n is a, c, g, or t
  modified_base (500)..(500): a, c, t, g, unknown or other
  misc_feature (500)..(500): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtgtcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggacgaaccctaanacgtggtgtcacgagtgtcttcacccatcctccgggacagacttaccatcgaccacgaacctcctaccaataaaccacacgcctanacgtggagttgaggacncctgacattcnggaccacgcgtcctctacttactgtagacgagacgtcccaacggcgttccgggngacgccgtacggcgacggtccggtccttttacggacctttcggtaccgggg

SEQ ID NO: 208506 - DNA, 521 bp, Homo sapiens
  misc_feature: GYAE6OF02IRLKO.17.25.C03.1.454.CMB.1.raw
  modified_base (280)..(280): a, c, t, g, unknown or other
  misc_feature (280)..(280): n is a, c, g, or t
  modified_base (291)..(291): a, c, t, g, unknown or other
  misc_feature (291)..(291): n is a, c, g, or t
  modified_base (329)..(329): a, c, t, g, unknown or other
  misc_feature (329)..(329): n is a, c, g, or t
  modified_base (335)..(335): a, c, t, g, unknown or other
  misc_feature (335)..(335): n is a, c, g, or t
  modified_base (343)..(343): a, c, t, g, unknown or other
  misc_feature (343)..(343): n is a, c, g, or t
  modified_base (362)..(362): a, c, t, g, unknown or other
  misc_feature (362)..(362): n is a, c, g, or t
  modified_base (386)..(386): a, c, t, g, unknown or other
  misc_feature (386)..(386): n is a, c, g, or t
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
  modified_base (442)..(442): a, c, t, g, unknown or other
  misc_feature (442)..(442): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgntggacaacgcctggagtggatgggatgggcgaacctanactggntcacagtntctcacccatcctcggganagacttacatcgacacgaacctcncaataacacancctanatggagttgagagcctgactatctgacgacgacggccgtntaattcgtgtgcgagacgtcccaagtctccggtgacgcccgtaacggcacggtccgtccgtttgaccttcggtacgggg

SEQ ID NO: 208507 - DNA, 526 bp, Homo sapiens
  misc_feature: GYAE6OF02FJ1M6.17.25.C03.1.454.CMB.1.raw
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcgacaataacgaacacagtaatactggagctagaacacgctgtacatctagacggacgacgggcttctacttctgtgcgagtagtatactataacactgtcttccttttacacccttccttcgtacttcgtcgggcctacgg

SEQ ID NO: 208508 - DNA, 660 bp, Homo sapiens
  misc_feature: GYAE6OF02HNKKF.17.25.C03.1.454.CMB.1.raw
  modified_base (286)..(286): a, c, t, g, unknown or other
  misc_feature (286)..(286): n is a, c, g, or t
  modified_base (460)..(460): a, c, t, g, unknown or other
  misc_feature (460)..(460): n is a, c, g, or t
tcagcgtagactagcacgaccggtgctcgatttagtagtgtagatttgggtttgggggactcaacaaccacatctagtacctctagagaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctccgtgacaaggcttcgtggattcaccgtttacctcctatagtatcaactgggtncgccaggccgctcggacaacgcctgacgtggatggggatcggggaccaaacccgtacacgtggtcgtcacgtagttcgtcttccaacccctatccccgtacgggactacgtaccttaccaagtcgaacccaacgtaaccctcccgtaccaactaaaccgaccaacgtaccctanaacgtggtagttggacggtactccgtacgaactacgttacctaagggaccgaacgtacccgggtacccggttactttaacgtttaaccgtggttacgcgaacggtaccgttccccaacggtctcccggggttagacgtacccgtaccgggactaccgggtcccggttacccgtttaggtacccgtttccggtaccggggg

SEQ ID NO: 208509 - DNA, 649 bp, Homo sapiens
  misc_feature: GYAE6OF02JAHOE.17.25.C03.1.454.CMB.1.raw
  modified_base (298)..(298): a, c, t, g, unknown or other
  misc_feature (298)..(298): n is a, c, g, or t
tcagcgtagactagcacgaccggtgctcgatttagtagtgtagatttgggtttggggtacgtcaacaaccacatctgtcctctagagaaaaccctagtgagcacagctcctcacccatggactggacctggaggatcctcttcttggtggcagcagctacaagtgcccactcccaggtgcagctggtgcagtctggggctgaggtgaagagcctggggcctcagtgaagggtctcctggcaaggtcttctggattcacgtttacctcctatagtatcaactgggtgcgccaggcccgntcggacaacggaccctggagttgggatgggggaatgggggaccgtaaacccctaaacgtcgtagggtgtaccactaggttcgtctttaccacccaagtcccgtaccggggacagaccttacccatgacccacgaactcctccgaaataaaccacagtccctaacagtcggtaggttacgaggacgacctgacattaccgtgaccgaacgaccgggacccgttacttaacgttacctcggttacgacggacgtaccggttaccccaacgggtacgttccgggtcgacgtaccccggtacgggaccacgggtacccggttccccttttaggaccgttttcccggaccgggggg

SEQ ID NO: 208510 - DNA, 607 bp, Homo sapiens
  misc_feature: GYAE6OF02JRPJN.17.25.C03.1.454.CMB.1.raw
  modified_base (349)..(349): a, c, t, g, unknown or other
  misc_feature (349)..(349): n is a, c, g, or t
  modified_base (362)..(362): a, c, t, g, unknown or other
  misc_feature (362)..(362): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcaggtgaaggtctcctgcaaggtcttctggattcacgtttacctctatagtatcaacgtgggtgcgccaggccgctggacaacgacctgagtggatgggagtcgggacgaacctaacacgtggtgtcacngtgtcttcacccntccgtccgggacacgtacttaccgatcgaccacgaactcctaccaataaaccacaacgccctaacgataggagttcgaggacgtccctagaactactcgtacggaaccgaacgaccggtacccgttcttaacgttacgtggcgtaccggaagtaccgtcccaacggtccgttacgggttcgaacggtaccccgttacggggcacgggcccggttaccttttcggaccgttttccgggaccggggg

SEQ ID NO: 208511 - DNA, 738 bp, Homo sapiens
  misc_feature: GYAE6OF02IGXKF.17.25.C03.1.454.CMB.1.raw
  modified_base (291)..(291): a, c, t, g, unknown or other
  misc_feature (291)..(291): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctcagtgaaggtctcctgcaaggcttctggattcaccgtttacctcctatagtatcaacgtgggtgcgccaggccgntcggacaacgacctggagtggagtgggatcggggaccgtaaccccgtaacgacgtggtgtcgaacgtagttcgttaccttccgaacccctacgttcccgtaccggggtaacctaacggtaaccctttaacccgaagtttacccggaacccgtaaaccggtaaaccctttaccccgttaaccctaaaaccgttaaaaaccccgacgttaaaccggtaccccttaaacgtaacggtttacggggtaaggtttacgggaaaccgggtaacgtaccccgttaggaaacctacgttacgttacgggaaaccgtaccgtaacccggggtcccgttacttaacgtttaccgtggtacggtacgtaacgtaccgtaccccgacgtacggttcccggtagaaccgtcccgtacggcgaacggtcccggttccgtttacgccgttcggtaccggggg

SEQ ID NO: 208512 - DNA, 584 bp, Homo sapiens
  misc_feature: GYAE6OF02I3BH0.17.25.C03.1.454.CMB.1.raw
  modified_base (278)..(278): a, c, t, g, unknown or other
  misc_feature (278)..(278): n is a, c, g, or t
  modified_base (287)..(287): a, c, t, g, unknown or other
  misc_feature (287)..(287): n is a, c, g, or t
  modified_base (328)..(328): a, c, t, g, unknown or other
  misc_feature (328)..(328): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactggtncgccaggcnctggacaacgacctgagtggatgggatgggcgaaccctaanactggtgtcacagtgtcttcacccatccgtaccgggacacgtaccttaccgatcgaacctaccgaaactccctaccaagtaaaccaccagtaccctacaagtcggagttcgaggacgtccctgactatacgtagaccgacgaccggcccgttctaattaccgtggttacgcggtaacgacgtaccccaggaccgttccgggtgacgtaccgtaccggcacgggtccgtaccgttttcaccggtttcgtaccggggg

SEQ ID NO: 208513 - DNA, 553 bp, Homo sapiens
  misc_feature: GYAE6OF02HGS1T.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggagtgggatcgggacgaaccctaacgacgtggtgtcacagtgtccttcaccccagtcccgtccgggacagaccttaccatcgaccacgaacctcctaccaataaaccacacgaccctacagtggagttgaggcgcctgacagttcaggaaccgacaccgggtccgtacttattacgtgtgacgagacgtcccacgctccggtgacgccgtaggcacggccgtcctttggtaccttcgtacgggg

SEQ ID NO: 208514 - DNA, 632 bp, Homo sapiens
  misc_feature: GYAE6OF02IV2KY.17.25.C03.1.454.CMB.1.raw
  modified_base (281)..(281): a, c, t, g, unknown or other
  misc_feature (281)..(281): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattctacgtttacctcctatagtatcaactgggtncgcaggccgcgtggacaacgcctggaggtggagtgggagtggggaccgtaaacccctaacacgtggtgtaccacgtagttcgttccttccaccctacgtcccgtccgggaacacgtaccttaccacgtcgaccaaccgtaacctccctaccaactaaaccacacgtacctactacgtggtagttcggaaggacgccgtacggaacacgttacgtacgaaccgacgaccgggtccgttactactttacgtcgtacggacggacgtacgtaccccgacggtacgttcccgggtaggaccggtacccgtacggcgtacgggccggttaccgtttcggaccgttcggtaccgggg

SEQ ID NO: 208515 - DNA, 606 bp, Homo sapiens
  misc_feature: GYAE6OF02HM9K9.17.25.C03.1.454.CMB.1.raw
  modified_base (277)..(277): a, c, t, g, unknown or other
  misc_feature (277)..(277): n is a, c, g, or t
  modified_base (290)..(290): a, c, t, g, unknown or other
  misc_feature (290)..(290): n is a, c, g, or t
  modified_base (360)..(360): a, c, t, g, unknown or other
  misc_feature (360)..(360): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatccctccctgtctgcctctggtgggggtcagagtcaccatcacttgccggacaagtcacggacgttaaaacctatttaaatggtatcagcaagaaacctggaaaacnccccagacctccngatctctggtgcatcccactctgacgaagtcggccgtcccagtcgaggttcagtggctaggtggactcgngggacagtatttacaatctacaccataccaccactcacgctaacgtgaggtattgtagactaattaccttaacgtacttacgaacctaacgtaacggtaacgtttaaccaccggtttaccccctacgtaccgttaaccgttttcggaaccgtaacggggtaacctaaagggttgaacggtaaactaccgaaaacgtaaccgttaggtcggtaccgtacgaccctaaccgtacttacgtccgttacc

SEQ ID NO: 208516 - DNA, 530 bp, Homo sapiens
  misc_feature: GYAE6OF02JDOVA.17.25.C03.1.454.CMB.1.raw
  modified_base (432)..(432): a, c, t, g, unknown or other
  misc_feature (432)..(432): n is a, c, g, or t
  modified_base (439)..(439): a, c, t, g, unknown or other
  misc_feature (439)..(439): n is a, c, g, or t
  modified_base (466)..(466): a, c, t, g, unknown or other
  misc_feature (466)..(466): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgcctgagtggatgggatgggccgaaccctacacgtggtcgtcacagtgtcttcacccatcctaccgggacacgaccttaccatcgaccacgaacctcctccaactaaacacagacctacatcggagttgagcncctgacntctagacgacgacgccgtcttattacngtgcgacgacgtcccacgtactccggtgacgccgtacgcacggccgtcttcgacgttcgcgggg

SEQ ID NO: 208517 - DNA, 553 bp, Homo sapiens
  misc_feature: GYAE6OF02IJG8N.17.25.C03.1.454.CMB.1.raw
  modified_base (283)..(283): a, c, t, g, unknown or other
  misc_feature (283)..(283): n is a, c, g, or t
  modified_base (426)..(426): a, c, t, g, unknown or other
  misc_feature (426)..(426): n is a, c, g, or t
  modified_base (457)..(457): a, c, t, g, unknown or other
  misc_feature (457)..(457): n is a, c, g, or t
  modified_base (513)..(513): a, c, t, g, unknown or other
  misc_feature (513)..(513): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattctacgtttacctccttatagtatcaactgggtcncgccaggccgctggacaacgacctgagtggagtgggatcggggacgaaaccctaacgacgtgggtgtccaacgtagtcgtcttccaccctactccgtccgggacacgtactaccatcgaccacgacctcctaccaataaaccncacgcctaacatggagttgaggcgactgacntcgacgacacgacgtccgtctattcgtgacgcgagacgtcccacggtactcccggngaccgccgtacggcacggccgtcctttggccttggccggg

SEQ ID NO: 208518 - DNA, 534 bp, Homo sapiens
  misc_feature: GYAE6OF02F2EAI.17.25.C03.1.454.CMB.1.raw
  modified_base (466)..(466): a, c, t, g, unknown or other
  misc_feature (466)..(466): n is a, c, g, or t
  modified_base (483)..(483): a, c, t, g, unknown or other
  misc_feature (483)..(483): n is a, c, g, or t
  modified_base (491)..(491): a, c, t, g, unknown or other
  misc_feature (491)..(491): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggcgaaccctaacactggtgtcacagtgtcttcacccatccctccggggacagacttaccatcgaccacgaacctcctaccaataaaccacagccctaacatggagttgagacgcctgacatctgacgacaccggcctactattacngtgcgagcgtcccacgntccgggtnacgccttacggcacggccggtacctttgaccgttcgtacgggg

SEQ ID NO: 208519 - DNA, 635 bp, Homo sapiens
  misc_feature: GYAE6OF02JHFU2.17.25.C03.1.454.CMB.1.raw
  modified_base (279)..(279): a, c, t, g, unknown or other
  misc_feature (279)..(279): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctgggcctcagtgaaggtctcctgcaaggcttctggattcacgtttacctcctatagtatcgaactgggtcncgccaggccgcgtcggacaacgcctagagtggagtgggatgggaccgaaccctaacgacgtcggtgtacacgtagttcgtccgttaccaccctactccgtaccgggactacgtacttaccatcgaaccacgtacctaccctaccaactaaaccacaacgtaccctaacgtacgtagggtaacgttcggaagtacgtacccgtgaacctacttacgtacggaaccgaccgaccgggtccgttacttacgttacgtcggtacgacgtacgtaccgtacccgtacggtaccgttccggtacgaacggtcccgacggtcgacggtccggttccctttacggaccgtttcggtaccggggg

SEQ ID NO: 208520 - DNA, 592 bp, Homo sapiens
  misc_feature: GYAE6OF02JYD1F.17.25.C03.1.454.CMB.1.raw
  modified_base (260)..(260): a, c, t, g, unknown or other
  misc_feature (260)..(260): n is a, c, g, or t
  modified_base (279)..(279): a, c, t, g, unknown or other
  misc_feature (279)..(279): n is a, c, g, or t
  modified_base (330)..(330): a, c, t, g, unknown or other
  misc_feature (330)..(330): n is a, c, g, or t
  modified_base (345)..(345): a, c, t, g, unknown or other
  misc_feature (345)..(345): n is a, c, g, or t
  modified_base (505)..(505): a, c, t, g, unknown or other
  misc_feature (505)..(505): n is a, c, g, or t
tcagcgtagactagcacgaccggtgctcgatttagtagtgtagatttgggtttggggacgtcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctggggcctcgagtgaaggtctcctgcaaggcttctggattcacgtttaccnctatagtatcaactgggtncgcaggccacgtggacaacgcctgagtggatgggatcgggacgaaccctanacgtggtcgtcacgngtctcttcacccatccgaccgggacacggtaccttaccagtcgaaccgtacgtaactccctacaaacgtaaacacgtacgacctaacgagtacggagtttgaacggtactcctagactaacgtctacgaaccgaccgtacggaccttcgtacttaaccgngtacgcgaagtcgtacccgaaggtcgtcccggtgacccgtcgttaaccggcaacggtccggttctttacggtaccgttcggtacggg

SEQ ID NO: 208521 - DNA, 597 bp, Homo sapiens
  misc_feature: GYAE6OF02F8MO9.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggagtggggatggggacgaaccctaacacgtgggtcgtcacgtagttcgttccttccacccctattcccgtacccggggactacgtaccttaccatacgacccacgtaaacctccctaccaataaaccacacgacctaacatggagttgaaggtacgcctgactagtctgaacgacgaccggccgttacttaacttacgtaggtcgacgacgtacgtcccaacggtacgttccgggtagacgtcccgtacggcacggtccggtacctttcggaccgttcggaccggggg

SEQ ID NO: 208522 - DNA, 587 bp, Homo sapiens
  misc_feature: GYAE6OF02H0QS6.17.25.C03.1.454.CMB.1.raw
  modified_base (281)..(281): a, c, t, g, unknown or other
  misc_feature (281)..(281): n is a, c, g, or t
  modified_base (333)..(333): a, c, t, g, unknown or other
  misc_feature (333)..(333): n is a, c, g, or t
  modified_base (341)..(341): a, c, t, g, unknown or other
  misc_feature (341)..(341): n is a, c, g, or t
  modified_base (435)..(435): a, c, t, g, unknown or other
  misc_feature (435)..(435): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctaatagtatcaactgggtncgccaggccgctggacaacgacctgagtggatgggatggggacaaccctaanacgtggtntcacagtgtcttcacccatcccgtcgggacagaccttacatcgaccacgaacctcctccaataaacacaacgcctacagtggagttagaggacncctagacagtctagaccgaccgacggtcctcttattacgtgtgacgacgtacgtcccaacggtacgttacccgggtagaccggacccgttaccgggaccgtaacgggtccccgggttaccttttcgggtacccgtttccggtacccgggggg

SEQ ID NO: 208523 - DNA, 749 bp, Homo sapiens
  misc_feature: GYAE6OF02GGE14.17.25.C03.1.454.CMB.1.raw
  modified_base (281)..(281): a, c, t, g, unknown or other
  misc_feature (281)..(281): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaacgtgggtncgccaggccgctggacaacgacctgagtggagtgggatggggaccgaaccctaacgacgtgggtcgtacgacgtagtcgttcttaccacccctacgtcccgtacccggggaactacggtaaccttacccgaattacggaaccctaaccgtaaaccctccccttaaccaaacgttaaaacccaccgtaacgtaccccttaacgtaacgttcggggtaacgtttacgggaaacgggtaccggtacctacggaacctaacgttccgtaacggaacccggtaaccgacccggggtcccgttacttaaacgttttaccggtaggttaccgggaccggtaacggtacccggtcccccgtaaacgggtaccggttaccccgggggtaagaacccggtacccggttaaccgggaccgtaacggggtaccccggttacccgttttacgggtaacccgtttccgggtacccggggggg

SEQ ID NO: 208524 - DNA, 577 bp, Homo sapiens
  misc_feature: GYAE6OF02IX9LZ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatacgtatctaactgggtgcgccaggccgctggacaacggacctggagtggatggggatggggacgaaccctaacgactggtcgtacactagtgtcttcaacccacgtcctaccggggactacggaccttaccattacgaccaccgaactcctccaactaaaccacacgacctacagtcgagttgaggacgcctgactatctgacagtacggcctctattactgtacgcgacgtagtacccacggtaacgtccgggtagaacgtcccgttacggaccgacggtccggtccctttacggaccttcggtacggggg

SEQ ID NO: 208525 - DNA, 579 bp, Homo sapiens
  misc_feature: GYAE6OF02HTYG8.17.25.C03.1.454.CMB.1.raw
  modified_base (432)..(432): a, c, t, g, unknown or other
  misc_feature (432)..(432): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggcccgctggacaaccggaccgtggagtggagtgggatggggaccgaacccgtaacacgtggtgtacacgagtgtccttcaccccatcccgtccgggacagtacttaccatcgaccacgaacctccacaataaaccacacgacctanagtggagttggaggagccctagacctagtcagaccgacgtaccggccgttactaatttacgtgtcgtacgacgacgtacccacggtacgtccgggtgacgtccgtacggcgtacggccggtcctttacggtaccgttcggtacgggg

SEQ ID NO: 208526 - DNA, 766 bp, Homo sapiens
  misc_feature: GYAE6OF02HTT7L.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagccgtgggcctcagtgaaggtctcctgcaaggcttcgtggattcaccgtttacctcctatagtatcaacgttgggtgcgccaggcccgcgtaggaaccaaccggacctggacgtgggagtggggagtcggggacccgtaaaaccccgtaacgtaacgttgggtacgttaccgacgaacggtttcgtccgtttaccacccctacgtcccggttacccgggaacgtacgtaacccttaaccgagttaccggaaccccgaacggtaacccttcccctaaccctaaactaaaaacccgaccgaacgtaccccttaaacgacgttaggggaacgtttacgggaacggtacgacccgtagaactacgttcgtaaccgggtaaccgacccgggtacccgggtaccgttaccgttaacgtttaaccggtggttaccggtaccgggaacgtacccggtacccccgtaacggccgtttacccggggtaccggtaccgtacccggttaaccgggacccgtaacgggtcccggtttaacccgttttcggtacccgtttcgggtacccgggggg

SEQ ID NO: 208527 - DNA, 586 bp, Homo sapiens
  misc_feature: GYAE6OF02I6LHB.17.25.C03.1.454.CMB.1.raw
  modified_base (244)..(244): a, c, t, g, unknown or other
  misc_feature (244)..(244): n is a, c, g, or t
  modified_base (445)..(445): a, c, t, g, unknown or other
  misc_feature (445)..(445): n is a, c, g, or t
  modified_base (448)..(448): a, c, t, g, unknown or other
  misc_feature (448)..(448): n is a, c, g, or t
  modified_base (452)..(452): a, c, t, g, unknown or other
  misc_feature (452)..(452): n is a, c, g, or t
  modified_base (472)..(472): a, c, t, g, unknown or other
  misc_feature (472)..(472): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcnggattcacgtttacctcctatagtatcaactgggtgcgccaggccgcgtggacaacgacctggagtggatgggagtcgggacgaacctaacacgtggtcgtacacgagtcgtcttcacccatcccgtaccgggacacgtaccttaacatcgaccacgaactcctaccaataaacacagcctaacatggattggaggactcnganctanagacgactaccgggaccttnttaacttcgtgtacgcgaacggtacgtaccccgagtacggtacccgggtgaacggtacccgtacgggacctcgggtcccgggtccttttacgggaccctttcgggtaccggggg

SEQ ID NO: 208528 - DNA, 756 bp, Homo sapiens
  misc_feature: GYAE6OF02J3K7H.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagagccgtggggcctcgagttgaaggtcctccgtgacaaggtcttcgtggtacttccgtacgtttacctcctatagtactccgaacgtgggtcgccggaccgaggcccgtctacggaaccaaccgtaccgtggtaggtcggagtacggggtacgtacggggacctaaaccccgtacgtacgtcggtcgtacctacgtacgttcgttacccttacccgaaccctacgtacccggtaccggggtaactaccggtaacctttacccgacgttaccgaaccccgtaaccgtaaccctacccgttaaccgaaacctaaacccaccgtaccgtacctaaccgtagtacgggtaagttcggaacggtaccgtacctagtaaccgtcgttaccggaccggaaccgttacccggtacccgggtaccttaacgtttacgttaaccgtcggtcgaaccgtacgtacccgtacccgtacggtaccggtccggtacgtaacccggtccgtaccggtaccgtacggtcccggttccgtttacggtaccgttccgggtaccgggg

SEQ ID NO: 208529 - DNA, 555 bp, Homo sapiens
  misc_feature: GYAE6OF02IL9AE.17.25.C03.1.454.CMB.1.raw
  modified_base (280)..(280): a, c, t, g, unknown or other
  misc_feature (280)..(280): n is a, c, g, or t
  modified_base (420)..(420): a, c, t, g, unknown or other
  misc_feature (420)..(420): n is a, c, g, or t
  modified_base (424)..(424): a, c, t, g, unknown or other
  misc_feature (424)..(424): n is a, c, g, or t
  modified_base (504)..(504): a, c, t, g, unknown or other
  misc_feature (504)..(504): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctggagtggatgggatcgggacgaacctaacgacgtggtcgtacacagttgtcttccacccatcccgtaccgggacacgtacttaccatacgaccacgtaacctcctacaactaaacncacncctacatggattgaggcgctagacatcagacgacgaccgtccgtctaattctgtcgacgagacgtccacggcgtcccggngacgcccgtaacggctacggtccggtcctttagtaccgttcggtaccgggg

SEQ ID NO: 208530 - DNA, 597 bp, Homo sapiens
  misc_feature: GYAE6OF02GUDT8.17.25.C03.1.454.CMB.1.raw
  modified_base (289)..(289): a, c, t, g, unknown or other
  misc_feature (289)..(289): n is a, c, g, or t
  modified_base (445)..(445): a, c, t, g, unknown or other
  misc_feature (445)..(445): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactggtgcgccaggccgntggacaacgacctgagtggatgggatcgggaccgtaaccctaacgacgtggtgtcacagtgtcctcaccctatccgtcgggacacgtacttaccagtacgacccacgaacctcctacaactaaacacacgcctagacgtggtagttagacggtacnccgtagacctagtccgtagaaccgacctacgggtacccgttacttagtttaccgtgtacgcgtacgacgtccccgaaggtccgttaccggtaggaccgcccgttacgggactacgggaccgttccgtttcggtaccgttcggtacccggggg

SEQ ID NO: 208531 - DNA, 661 bp, Homo sapiens
  misc_feature: GYAE6OF02H7AL3.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtgggcctcagtgaaggtctcctgcaaggcttcgtggattcacgtttacctcctatagtatcaactgggtgcgccaggtccgcgtaggaccaacgacctggagtggagtggggagtggggaaccgaaacccgtaaacacgtgggtacgtccgaactaggtcgtcctttccaacccctaatcccgtccggggaacagtactttacccagttcgacccacgaacctccctaccaataaaccactacgacctacagtggacgttgaacggtgacctggaactacgtctacggaaccgacgtacccggtacccgttacttaacgttaaccgtggtacgtaccggacgtaccggttacccccaaggtccggttacccgggtaggaacccggttacccgtacgggccgtaacggcccggggttaccctttttcggacccgtttcggtaccccgggggg

SEQ ID NO: 208532 - DNA, 529 bp, Homo sapiens
  misc_feature: GYAE6OF02JDWJY.17.25.C03.1.454.CMB.1.raw
  modified_base (377)..(377): a, c, t, g, unknown or other
  misc_feature (377)..(377): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaacgccccagaccctcctgatctctggtgcatccatctgacgaagtgcgtcccatcgaggttcagtgcagtggatcgtggacagtattcaatctcacatcaccatcngccaacgtgagtatgtgactaatctaactctgtacaacagtacttacgaccgtttccctcgtctacgtttcggaccgaaggggtaacctaagttagacgtaactaccgaaacgtaactcggtacgcttcggacctacctacttctagttccc

SEQ ID NO: 208533 - DNA, 637 bp, Homo sapiens
  misc_feature: GYAE6OF02F8PYF.17.25.C03.1.454.CMB.1.raw
  modified_base (303)..(303): a, c, t, g, unknown or other
  misc_feature (303)..(303): n is a, c, g, or t
  modified_base (313)..(313): a, c, t, g, unknown or other
  misc_feature (313)..(313): n is a, c, g, or t
tcagcgtagactagcacgaccggtgctcgatttagtagtgtagatttgggtttggggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacgttaaaacctatttaaattggtatcagcaagaaacctggaaaacgccccagacctctgatctctggtncatccactcngacgaagtcggctcccatcgaggttcagtggcagtggatcgtgggacagtactttacaattcctacacactaccacctactctacgactaaccgtggacgtattggtactactaattcctacttacgtacgtaccaaacgtagtaacgtttaccgtacccgtttccccgttacgtccgtttaaccgttttccgggaccgttaaccgggggtaaccttaaacgggttcgtaaacggtaacttaaacccggaaaaccggttaaccgttagggttaccggtaccttaccggaacccgttaacctacgtttccgttacgttttacccg

SEQ ID NO: 208534 - DNA, 614 bp, Homo sapiens
  misc_feature: GYAE6OF02ISF99.17.25.C03.1.454.CMB.1.raw
  modified_base (279)..(279): a, c, t, g, unknown or other
  misc_feature (279)..(279): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaaggcttctggattcacgtttacctcctatagtatcaactgggtncgccaggccgctggacaacgcctggagtggatggggatggggaccgaaccctaacacgttgggtgtccaacgaggtcgtccttccaacccctacgtcccgtccgggacacgtaccttacccattcgaacccaccgtaaacctccctaccaactaaaaccaccaacgtccctaacgagtagggaagttcggaagggacgcccttaggaacctagttccgtaggaaccgaccgaccgggtccgtacttactttacgtgtcgacgacgaccgtacccacggtacttcccggtagacgtccgtacggcacggccggtccgtttcgaccgttcgtcgggg

SEQ ID NO: 208535 - DNA, 526 bp, Homo sapiens
  misc_feature: GYAE6OF02IQL8Q.17.25.C03.1.454.CMB.1.raw
  modified_base (393)..(393): a, c, t, g, unknown or other
  misc_feature (393)..(393): n is a, c, g, or t
  modified_base (456)..(456): a, c, t, g, unknown or other
  misc_feature (456)..(456): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggcgaaccctaacactggtgtcacagtgtcttcacccatcctcgggacagacttaccatcgaccacgaactccncataaacacagcctacatggagttgaggagcctgacatctagacgacacggcctctacttacngtagcgagtacgtcccacgtcgtcccggtgacgccctacggcacggcggtcctttggaccttcgtcgggg

SEQ ID NO: 208536 - DNA, 635 bp, Homo sapiens
  misc_feature: GYAE6OF02HNAQ9.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattctacgtttacctcctatagtatcaactgggtgcgccgaggccgctggacaacgacctgagtggagtgggagtggggaccgaaaccctaacgacgtgggtcgtacgaacgtagttcgtccttaccgaacccctagtcccgtaccggggactacggtaaccttaccaagtccgaacccacgtaaaccctccctaaccaactaaaccacacgaccctaacagtggagttagaagggtacgccgtagacctactcgtacggaaccgaccgaccggtaccgttacttaactttacgtgtcgacgacggtaccgtcccgacggtaacgtccgggtgaaccggtcccgtaacggcgtacggtccggttacctttggtacccgttggtccgggg

SEQ ID NO: 208537 - DNA, 549 bp, Homo sapiens
  misc_feature: GYAE6OF02IF2PF.17.25.C03.1.454.CMB.1.raw
  modified_base (279)..(279): a, c, t, g, unknown or other
  misc_feature (279)..(279): n is a, c, g, or t
  modified_base (289)..(289): a, c, t, g, unknown or other
  misc_feature (289)..(289): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
  modified_base (459)..(459): a, c, t, g, unknown or other
  misc_feature (459)..(459): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggagtatcctcttcttggtggcagcagctacaagtgcccactcccaggtgcagctggtgcagtctggggctgaggtgagaagcctggggcctcagtgaaggtctcctgcaaggcttctggattcacgtttacctcctatagtatcaactgggtncgccaggccnctggacaacgacctgagtggatggggatcggggcaaacccctaacactggtgtcacagtcgtcttcacccatcctccgggacagacttaccatcgaccacgactcctcanaaacnacgctacatggagttgagagcctgacatctagacacgacggccgtactattaacngtcgacgagaccgtccctacgaacgttcccggtgtaaccgccgttaaccggcaacggtccggtaccctttaggaccttcggtaccggggg

SEQ ID NO: 208538 - DNA, 898 bp, Homo sapiens
  misc_feature: GYAE6OF02HT3TI.17.25.C03.1.454.CMB.1.raw
tcagcgtagactagcacgaccggtgctcgatttagtagtgtagatttgggtttggggactcacaaccgacatctcgtcctcctagagtaaaccctggtgtacgctacgagctcctcaccatggactggacctggacgactcctcttcgttggttgggcagcagtcgtttacctaagttgcccacttacctaaggtgccagtctggtgcagtctgggctgaggtggaagagtccgtgggactcaggtggacggtctccgtgcaacggtcttcgtggattcctaccgttttaccgtccttacgtacgttatccgaacgttggggtacgtccggaccgtacgggtcccgtacgttaggaacctaaccggtaccgttgggacggttcgggaacggtcggggtaacggtagggggaacccggtaaaccccttaacggtacggttcggggtttcgtaccgtaaccgttaacggttttcgttaccctttaccggtaaccccgttacgttaccccggttacccgggtaactaacgttaacccgtttaccccgaagttaccggtaaccctaaccggtaaccgttacccgtaaccgtaaaccgtaaaacccgtaccgtaaccgtaccttaacccgaggtacgggtaacggtttacgggaaccggtaacgtacccgtagaacctaacgttccgttacggaaacctaacccggtaccgggtaccccgttaacctttaacgtttaacccggtaggtacccgggtaacggaccggttacccgggttaccccgtaacggttaaccgtttcccgggttaacggtaccggtaaccccggttaacggacccggttaacccgggttacccggtttaccccgtttttaggttacccgttttacccgggttaccggggg

SEQ ID NO: 208539 - DNA, 666 bp, Homo sapiens
  misc_feature: GYAE6OF02IQPFE.17.25.C03.1.454.CMB.1.raw
  modified_base (283)..(283): a, c, t, g, unknown or other
  misc_feature (283)..(283): n is a, c, g, or t
  modified_base (391)..(391): a, c, t, g, unknown or other
  misc_feature (391)..(391): n is a, c, g, or t
  modified_base (404)..(404): a, c, t, g, unknown or other
  misc_feature (404)..(404): n is a, c, g, or t
  modified_base (552)..(552): a, c, t, g, unknown or other
  misc_feature (552)..(552): n is a, c, g, or t
  modified_base (596)..(596): a, c, t, g, unknown or other
  misc_feature (596)..(596): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcgagtgaaggtctcctgcaaggcttctggattcacgtttacctcctatagttatctaactggggtncgccagggccgcgtggaccaacgaccgtggagtggatgggagtcgggcaaaccctaacacgttggtcgtacacgagttcgtccttacacccctatcccgtaccggganagtaccttaaccntacgaacctaccgaaacctccctaccaaactaaaaccaccaacgtaccctaacgacgttgggtaacgtttaggaacgggaacgtccctagaaccgtattccgtaggaaccggtaaccgaccgggtaccgttaccttaattttaccggnggtacgacgtaacggaccgtaccccgaaggtccgttacccgggngaaccggtccccggttaacgggccaggggtcccggttacccgttttacggtacccgttcggtaccggggg

SEQ ID NO: 208540 - DNA, 548 bp, Homo sapiens
  misc_feature: GYAE6OF02HDO1F.17.25.C03.1.454.CMB.1.raw
  modified_base (220)..(220): a, c, t, g, unknown or other
  misc_feature (220)..(220): n is a, c, g, or t
  modified_base (261)..(261): a, c, t, g, unknown or other
  misc_feature (261)..(261): n is a, c, g, or t
  modified_base (280)..(280): a, c, t, g, unknown or other
  misc_feature (280)..(280): n is a, c, g, or t
  modified_base (290)..(290): a, c, t, g, unknown or other
  misc_feature (290)..(290): n is a, c, g, or t
  modified_base (331)..(331): a, c, t, g, unknown or other
  misc_feature (331)..(331): n is a, c, g, or t
  modified_base (404)..(404): a, c, t, g, unknown or other
  misc_feature (404)..(404): n is a, c, g, or t
  modified_base (412)..(412): a, c, t, g, unknown or other
  misc_feature (412)..(412): n is a, c, g, or t
  modified_base (426)..(426): a, c, t, g, unknown or other
  misc_feature (426)..(426): n is a, c, g, or t
  modified_base (443)..(443): a, c, t, g, unknown or other
  misc_feature (443)..(443): n is a, c, g, or t
  modified_base (457)..(457): a, c, t, g, unknown or other
  misc_feature (457)..(457): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctnagtgaaggtctcctgcaaggcttctggattcacgtttaccnctatagtatcaactgggtncgccaggccnctggacaacgcctgagtggatgggatgggacgaaccctaanacgtggtgtcacgagtgtcttcacccatccgtcgggacagacttaccatcgaccacgaacctccacataaacncagcctanatggagttgaggancctgacatcagaccacncggtcctctacttngtgacaggacctcccgaacggtcgtacccgggtgaccgtcccgtacggaccgtaggtcccggttccttttacggacctttcgggaccgggg

SEQ ID NO: 208541 - DNA, 677 bp, Homo sapiens
  misc_feature: GYAE6OF02F3K0Z.17.25.C03.1.454.CMB.1.raw
  modified_base (340)..(340): a, c, t, g, unknown or other
  misc_feature (340)..(340): n is a, c, g, or t
  modified_base (520)..(520): a, c, t, g, unknown or other
  misc_feature (520)..(520): n is a, c, g, or t
  modified_base (549)..(549): a, c, t, g, unknown or other
  misc_feature (549)..(549): n is a, c, g, or t
  modified_base (566)..(566): a, c, t, g, unknown or other
  misc_feature (566)..(566): n is a, c, g, or t
tcagcgtagactagcacgaccggtgctcgatttagtagtgtagatttgggtttgggggtaggtcgtagtctcagtcaggacacagcatggacatgagggtccccgctcagctcctcggggctcctgctactctggctccgagctgccagatgtgacatccagatgacccagtcctccatcctccctgtctgccctctggtgggggtacagcgtccacctatcacttcggacggactagtccacggtaccttaaaaacctattttaaattcggtaatcgagtacaagtaaaaccgtacgtaaaacgccccgacgtacctacctagtacttcctctaggtcnctaatcccactcgtacgacgtaacggtcggtaccggtaccccattacggacgtttaccgtaggtcgggacgtaaggtacgggtactaccggtgggtaacaaggttacgttttacaatttccacctacctactacccaacctccttactacgaccttaaacggcggtaacgtattcggtanaacctaacgttctaacgttaactcgtaanaccgtaataacgttacncccgtttccctaccgccttaagttccggtaacggacgtaactaagttgaacgttacaaccaaaggttaccagggttctaccgtacgtacctaaccacttacggttcctacg

SEQ ID NO: 208542 - DNA, 557 bp, Homo sapiens
  misc_feature: GYAE6OF02F4T31.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcacatcacttgccggacaagtcacggcgttaaaacctatttaaattggtatcagcaagaaacctggaaaacgccccagacctcctgatctctggtgcatccactctgcgaagtggcgtccatcgaggttcagtggcagtgatctggacagtatttcaatctcaccatccaccactctcgactaaccgtgaaggtattgtgactaattctactactagtaccaaactagtagttacctacgtttcccctacgttccttaacgttttcggacccgtaacggggtaacctaaggttacgaacgtaactaccgaaaaccggtacgtaggtacgtacgtcgaccacctacttctagttcc

SEQ ID NO: 208543 - DNA, 588 bp, Homo sapiens
  misc_feature: GYAE6OF02JA8BA.17.25.C03.1.454.CMB.1.raw
  modified_base (291)..(291): a, c, t, g, unknown or other
  misc_feature (291)..(291): n is a, c, g, or t
  modified_base (410)..(410): a, c, t, g, unknown or other
  misc_feature (410)..(410): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgntcggacaacgcctgagtggatgggatgggcgaacctaacactggtgtcacagtgtcttcaccctatcctaccgggactacggaccttaccatcgaaccacgaacctcctaccataaacncagcctacagtggagttggagagcctgaccagtctaggaaccgacaccgggtcctacttacttaccgtggtacgacggtaacgcgtaccccgaacggtacttcccgggttagaaccggtcccgttaacgggccgaacggcccggttcccgttttacggacctttccgggtaccggggg

SEQ ID NO: 208544 - DNA, 596 bp, Homo sapiens
  misc_feature: GYAE6OF02IL2FJ.17.25.C03.1.454.CMB.1.raw
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
  modified_base (336)..(336): a, c, t, g, unknown or other
  misc_feature (336)..(336): n is a, c, g, or t
  modified_base (342)..(342): a, c, t, g, unknown or other
  misc_feature (342)..(342): n is a, c, g, or t
  modified_base (351)..(351): a, c, t, g, unknown or other
  misc_feature (351)..(351): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctcctgcaaggcttgtggattcacgtttacctcctatagtatcaacgtgggtcncgccaggccncgtggacaacgacctgagtggatgggatgggacaaccctanactggngtcatagtntcttcaccctatcccgtcgggacacgaacttaccatcgaaccacgaacctccctaccaataaaccactacgaccctacagtacggagtttaggaacggtacgcccgttagacctatccgtaggaaccgtacgaccggtcccgttacttaacttacgtgtacgacgtagaccgtcccgaagtcgtcccggtagaccggtcccgtaaggccgacggtccggtccttttcggaccttcggtaccgggg

SEQ ID NO: 208545 - DNA, 603 bp, Homo sapiens
  misc_feature: GYAE6OF02G7VLU.17.25.C03.1.454.CMB.1.raw
  modified_base (351)..(351): a, c, t, g, unknown or other
  misc_feature (351)..(351): n is a, c, g, or t
  modified_base (355)..(355): a, c, t, g, unknown or other
  misc_feature (355)..(355): n is a, c, g, or t
  modified_base (454)..(454): a, c, t, g, unknown or other
  misc_feature (454)..(454): n is a, c, g, or t
tcagcgtagactagcacgaccggtgctcgatttagtagtgtagatttgggtttggggtacgtcaacaaccacatctgtcctctagagaaaaccctagtgagcacagctcctcaccatggactggacctggaggatcctcttcttggtggcagcagctacaagtgcccactcccaggtgcagctggtgcagtctggggctggaggtgaagaagctgggggcctcagtgaaggtctcctgcaaggtccttgtggattcacgtttacctctatagtatcaacgtgggtgcgccaggcccgcgtggaccaacggacctgagtggatggggatggggactaaccctacacgtggtntcanagtgtcttcgacccactccgtcgggactacgaccttaccatcgaccacgaactccctacaactaaacgacgactaccctaacagtcgggtagttaacgngggtactacccgagactaacgtgtaacggaacgaccacccggggtcttaccttagttacctggtcgacgtagacggtcccaacggtacgtccggtagaccgtccgtaacgggcaccggtccggtccctttaggacctttcggaccgggg

SEQ ID NO: 208546 - DNA, 580 bp, Homo sapiens
  misc_feature: GYAE6OF02I22BF.17.25.C03.1.454.CMB.1.raw
  modified_base (475)..(475): a, c, t, g, unknown or other
  misc_feature (475)..(475): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacacgacctgagtgatgggatgggcaacctacactggtgtcacagtgtctcaccatccgtcggacagacttacatcgaccacgaactcctacataaacacagcctaacataggagttagaggtactcccgtgacctagtccgtagaaccgtacgaccgggcccgttacttacgttacttgnggaccgagtacgtccccgaagtacgttcccgggtaggtaccggtacccgttaacgggccgacgggtccggttacccgttttacggaccgtttcggtaccgggggg

SEQ ID NO: 208547 - DNA, 543 bp, Homo sapiens
  misc_feature: GYAE6OF02G410C.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcggtccctatcgttgacacaccaaactacgacacagaacgttccagggcagactacaccataaccgcggaacaaattaacgaacacattaatcaggagctagaacagcctgtcatctgagacacggtcttctactctgtgcgagagtatactataacactgcttcttttaccaccttcccttcgtacttcgtcgggtcctacgtcggtacccggtctacccg

SEQ ID NO: 208548 - DNA, 554 bp, Homo sapiens
  misc_feature: GYAE6OF02F9VCR.17.25.C03.1.454.CMB.1.raw
  modified_base (339)..(339): a, c, t, g, unknown or other
  misc_feature (339)..(339): n is a, c, g, or t
  modified_base (357)..(357): a, c, t, g, unknown or other
  misc_feature (357)..(357): n is a, c, g, or t
  modified_base (428)..(428): a, c, t, g, unknown or other
  misc_feature (428)..(428): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaacgtgggtgcgccaggccgctggacaacgacctgagtggatgggatgggccaaccctaacacgtggtntcacagtgtcttcacccntccgtaccgggacagacttacatcgaccacgaacctcctaccaataaacacacgcctacatggagttgagngcctgacatcgtagaccgacgaccggccgttacttattctggtcgacgagtacgtcccgacggtacgttccggtagacgtccgtacggcacgggccggttccttttcggaccgtttggtaccgggg

SEQ ID NO: 208549 - DNA, 547 bp, Homo sapiens
  misc_feature: GYAE6OF02GOMZB.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaacgccccagacctcctgatctctggtgcatccactctgcgaagtggcctccatcgaggttcagtggcagtggatcgtgggacagtatttcaattctcaccatcaccactctgaccaacctgaggtattgtgactaatctactactgtacaactagagttactacgttcccctcgtacctacgttttcggaccgtacgggacctaaggttagaacggtaactaaccgtaaaccggtaacgttaggtaggtcgtcgacctaccgtacttacctgttcc

SEQ ID NO: 208550 - DNA, 567 bp, Homo sapiens
  misc_feature: GYAE6OF02IK6LJ.17.25.C03.1.454.CMB.1.raw
  modified_base (420)..(420): a, c, t, g, unknown or other
  misc_feature (420)..(420): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggacgaaccctaacacgttggtcgtcacgagtcgtccttccaccctatcccgtccgggacacgtaccttaccatcgaccacgaacctcctaccataaacncacgcctacagtggagttgaggacgcctgacatctgaacgacgccggccttactacttactggtacgcgagaccgtacccgagtacgtcccggtgacgtcccgtacggccacggtccggtcctttacggtaccgttcggtaccgggg

SEQ ID NO: 208551 - DNA, 604 bp, Homo sapiens
  misc_feature: GYAE6OF02HQ84T.17.25.C03.1.454.CMB.1.raw
  modified_base (281)..(281): a, c, t, g, unknown or other
  misc_feature (281)..(281): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattctacgtttacctcctatagtatcaactgggtncgccaggccgctggacaacgacctgagtggatggggagtggggaccgaacccgtaacacgtggtcgtcacgagttcgtcttcacccatccctcgggacacgacttaccatcgaccacgaacctcctacaataaacacacgcctacagtaggagttagaggtacgtcctgactacgtctagaaccgaccgaccggccgttacttaattaccgtgtacggtcgagtaccggtaccccgaacggtaccgttcccgggagaaccggtacccgtaccgggactaccgggtccggttacccgttttgtacccggtttggtaccgggggg

SEQ ID NO: 208552 - DNA, 637 bp, Homo sapiens
  misc_feature: GYAE6OF02I5JY0.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctggtggggtcagagtcaccatcactcgccggacagtcacggtacgttaaaacctatttaatggtatcagcaagaaacctaggaaacgcccccaagtaccctcctgacttcctctggtcacatcccacttcacgacggaaggtcggtccgtccctagtcgtacggttcaggtggctaggtggatcggtaggaacagtattacaactcaccactactaccacctactctacgacctaaccgtaggacggtattcggtacgtacaacttcgttaacctaacgtttcgtaaccaagtaacgtaaccgtttactacccggtttcccgtccgtaccttttaccgtttccggaaccgtaacgggaaccgttaaggttacgtaacggtaactaaccggaaacgttaaccgtacggtaggtaccctacggaccctaaccgtactttccgtcgttacccg

SEQ ID NO: 208553 - DNA, 523 bp, Homo sapiens
  misc_feature: GYAE6OF02F42HI.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagatcaactgggtgcgccaggccgctggacaacgacctgagtggatggggatggggcgaacccctaacactggtgtcacagtgtcttcacccatcctcgggacagacttaccatgaccacgaactcctccataaacacagcctaacatggagttgaggagcctgacatctgaccgacacggccgtctattactgtgcgagacgtcccgagactccggtgacgccgtacggcaggccggtcctttcgacttcgtcgggg

SEQ ID NO: 208554 - DNA, 824 bp, Homo sapiens
  misc_feature: GYAE6OF02JXWMC.17.25.C03.1.454.CMB.1.raw
tcagcgtagactagcacgaccggtgctcgatttagtagtgtagatttgggtttggggtacgtcaacaaccacatctgtcctctagagaaaaccctagtgagcacagctcctcaccatggactggacctggaggatcctcttcttggtggcagcagctacaagtgcccactcccaggtgcagctggtgcagtcgtgggctgaggtgaagagccgtggggcctcagtgaaggtctcctgcaaggcttctggattcacgtttacctctatagtatacaacgtggtgcgcgaggccgcgtcggacaacgacctggagtcggagtggggagtcggggaccgtaaaccccgtaacgacgttgggttcgtaccgacgtaacggttcgttaccgtttacccaaccccgtacgttccccggttaccccgggggaacctaacgggttaacccctttaacccgacggtttaaccggaaaccccgtaaccggtaaacccctttccccgttaaccaaaccttaaaaaccccaccgtaaccggtaccccttaaacgaacggtttacgggtaaacggtttacggaacggggaaccgtcccgttaacgggaacccttaacgttccgttaacgggaacccggtaacccggacccggggttaaccctttacgtttaaaccgttcccgttgggtacggtaccggtaacggtacccggtccccgtaaaccggttccggtttacccgggtacggtaacccggtccccggttaacgggcccggtaaccggggtccccgggttttaccgttttaccgggtacccggttttacccgggcccggggggg

SEQ ID NO: 208555 - DNA, 623 bp, Homo sapiens
  misc_feature: GYAE6OF02I8FKB.17.25.C03.1.454.CMB.1.raw
  modified_base (301)..(301): a, c, t, g, unknown or other
  misc_feature (301)..(301): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaacctatttaaattggtatcagcagaaacctggaaaacgccccagacctcctgactctctggtcncatccactctgcgaagtcggctcccatcggagttcagtcgcagtggatctgggactagtactttacaatcctcaacctactaccacctacttcctcgacctaacctggtaacggtattgtagtactaacttcctaacttactcgtacctaaacgtagtaacgttacctaccgtttcccctacgttaccttaaccggttttcggaccggttaaccggggtaaccgtaaaggtttacgaacggtaactaaccgtaaaaccggtaaccgttacgggttacggtccgtacggtaccgtaacccgtacgttaccgttacgtttaccc

SEQ ID NO: 208556 - DNA, 848 bp, Homo sapiens
  misc_feature: GYAE6OF02JZ3F1.17.25.C03.1.454.CMB.1.raw
  modified_base (774)..(774): a, c, t, g, unknown or other
  misc_feature (774)..(774): n is a, c, g, or t
tcagcgtagactagcacgaccggtgctcgatttagtagtgtagatttgggtttggggacgtcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagaagcctggggcctcagtgaacggtctcgtgactaaggcttcgtggacttcgtacgtttacctcctaagtagtactcaacgtgggtagccgccgacggccgtcgtaggacctaacgacctggaacggtgggtagtggggagtacggggaccgtaaaaccccgttaaacgtaccggttagggttacgtaccgtaacgtaacggttcgggttcctttacccgaacccgtttaacgttccccgggttacccgggggaaacttacgtaaacccgttttaccgaacgtttccggtaaaccccgaaccgttaaacccctacccgtttaaacccgaaacgttaaaaaccccacgtaaaccccggtaaccccttaacgtaaacgttcgggggtaaaggttttacgaaccggggttaaacggccccttttaaggaaccttacgttaacccggttagggtaaacccgaaacccgtttaccgggggaaccccttttagtttaaacgttttcccggtaaggtacccgtacgggtaacccgtacggtacccccctaagggtaaccggttaccgggggttanaaccgggaccccgttaacggggccctacgggtccccggttttcgtttaccggaccgttttccgggaaccggggg

SEQ ID NO: 208557 - DNA, 529 bp, Homo sapiens
  misc_feature: GYAE6OF02F1GJC.17.25.C03.1.454.CMB.1.raw
  modified_base (486)..(486): a, c, t, g, unknown or other
  misc_feature (486)..(486): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatggggcgaaccctaacactggtgtcacagtgtcttcacccatcctcgggacagaccttaccatcgaccacgaactcctccataaacacacgccctacatggagttgaggacgcctgacatctgacgacacggctctattactgtgcgagacgtcccagactccgggtanacggcctacgggcacggccggtcctttcggaccttcgtcgggg

SEQ ID NO: 208558 - DNA, 577 bp, Homo sapiens
  misc_feature: GYAE6OF02J188L.17.25.C03.1.454.CMB.1.raw
  modified_base (270)..(270): a, c, t, g, unknown or other
  misc_feature (270)..(270): n is a, c, g, or t
  modified_base (280)..(280): a, c, t, g, unknown or other
  misc_feature (280)..(280): n is a, c, g, or t
  modified_base (285)..(285): a, c, t, g, unknown or other
  misc_feature (285)..(285): n is a, c, g, or t
  modified_base (288)..(288): a, c, t, g, unknown or other
  misc_feature (288)..(288): n is a, c, g, or t
  modified_base (298)..(298): a, c, t, g, unknown or other
  misc_feature (298)..(298): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctcgtggtgggggtcagagtcaccatcacttgccggacaagtcacggtacttaaaacctattaaattgatcagcagaactgaaacncccagcctcngatcntgncatccactcngacgtagtcggcctccagtcgtaggttcacggtggacaggtggtactcggtagggtacaagtactttacaacttcaccgacactaccacctactctacgacctaaccgtagtagggtatgtacgtactaacgtactactctacgtacgaactacggttacttacctaccgttcccgtacgttccttaacggtttccggaaccgtaacgggtaacctaaggtagtaacgtacgtaacgaacgtaacgtagtcgactcgactaccgtacttccgtattacc

SEQ ID NO: 208559 - DNA, 640 bp, Homo sapiens
  misc_feature: GYAE6OF02G6Y6F.17.25.C03.1.454.CMB.1.raw
  modified_base (337)..(337): a, c, t, g, unknown or other
  misc_feature (337)..(337): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggtcttcgtggacttcacgttttacctcctatagtatcaactgggtgcgccaggccgctggacaacgacctggagtggatggggatgggcgaaccctaanacgtggtgtcacgagttgtcttcacccatccgtccggggacaggaccttaccgacttacgacccaacgaaccttcccgtaccaaataaaaccacaacgccctaacagtacgggagtttacggagggacgtcctagaccagttcacggaaccgcgaaccggtccgtacttaacgtttactggttacgccgtaacggaccgttaccccgaaggtaaccgttcccgggtagaacgggtacccgttaccgggaccgtaacgggtacccgggttcccttttaacggtacccgtttcggtaccgggggg

SEQ ID NO: 208560 - DNA, 617 bp, Homo sapiens
  misc_feature: GYAE6OF02IP8B8.17.25.C03.1.454.CMB.1.raw
  modified_base (245)..(245): a, c, t, g, unknown or other
  misc_feature (245)..(245): n is a, c, g, or t
  modified_base (265)..(265): a, c, t, g, unknown or other
  misc_feature (265)..(265): n is a, c, g, or t
  modified_base (276)..(276): a, c, t, g, unknown or other
  misc_feature (276)..(276): n is a, c, g, or t
  modified_base (288)..(288): a, c, t, g, unknown or other
  misc_feature (288)..(288): n is a, c, g, or t
  modified_base (298)..(298): a, c, t, g, unknown or other
  misc_feature (298)..(298): n is a, c, g, or t
  modified_base (310)..(310): a, c, t, g, unknown or other
  misc_feature (310)..(310): n is a, c, g, or t
  modified_base (340)..(340): a, c, t, g, unknown or other
  misc_feature (340)..(340): n is a, c, g, or t
  modified_base (381)..(381): a, c, t, g, unknown or other
  misc_feature (381)..(381): n is a, c, g, or t
  modified_base (395)..(395): a, c, t, g, unknown or other
  misc_feature (395)..(395): n is a, c, g, or t
  modified_base (471)..(471): a, c, t, g, unknown or other
  misc_feature (471)..(471): n is a, c, g, or t
  modified_base (479)..(479): a, c, t, g, unknown or other
  misc_feature (479)..(479): n is a, c, g, or t
  modified_base (493)..(493): a, c, t, g, unknown or other
  misc_feature (493)..(493): n is a, c, g, or t
tcagcgtagactagcacgaccggtgctcgatttagtagtgtagatttgggtttggggtacgtcgaacaaccacatctgtcctctagagaaaaccctagtgagcacagctcctcaccatggactggacctggaggatcctcttcttggtggcagcagctacaagtcgcccactcccaggtgcagctggtgcagtctggggctgaggtgaagagcctggggctcgagtgaaggtctcctgcaacggnttcgtggattcacgtttacncctatacgtancaacgtgggtcncgccaggccntggacaacgtcngtgtggatgggatggggactaaaccgtaancgtggttgacatagtcgtctcaacccctgtccgtccggganacgtacttaccatnacccgacgactccgtcaaattaaaccacgacgcctaacagtcgggtacttagggacgtagtcccaggactatccgngaacccgngaaccggtcccttnttaaacgtccgttgacgggtcaacgtaccgtaccctaccgggtaattcccggggaatacccggtacccgtaagggccgtaacggtaccccgggtttcttttacgaccggttaccgtcggggggg

SEQ ID NO: 208561 - DNA, 608 bp, Homo sapiens
  misc_feature: GYAE6OF02JD7S0.17.25.C03.1.454.CMB.1.raw
  modified_base (349)..(349): a, c, t, g, unknown or other
  misc_feature (349)..(349): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatacaacgtgggtgccgccaggcccgcgtaggaccaacggacctggagtggatgggagtgggacgaaccctacacgtggtntcacagtcgtcttccacccatcccgtaccgggacacgtaccttaccagtcgacccacgtaacctccctaccaaactaaaccacgacaccttacgatagggacgttaggaggtacgtccgtagacacttcgacggaccacgaccggtccttcttaacgttctggtcgacgacgtaccgtcccaagggtactacccgggtagaccgtacccgttaccgggcacgggtccggtacccttttggacccgtttcgggaccgggg

SEQ ID NO: 208562 - DNA, 676 bp, Homo sapiens
  misc_feature: GYAE6OF02F5PJ5.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtgcgccaggccgctggacaacgacctgagtggatgggatgggcgaaccctagactggtgtcacagtgtcttcaccctatcccgtccgggacacgtacttaccatcgaccacgaactccctaccaattaaaaccaccgacgtccctaacgacgtacgggtaacgtttggaacgggtacgtaccccgttaggaaccctaagttacccgttaggaacccggtaacccgtaacccggggtcccgtttactttaaacgtttacccgttgggtaccggaccgggtaacggtaccgttacccccgaacgggtacgttccccggggtaggaacccggtcccggttaaccgggcctacgggtcccgggttaccctttttacgggaccgtttttccggacccggggggg

SEQ ID NO: 208563 - DNA, 712 bp, Homo sapiens
  misc_feature: GYAE6OF02H1Z82.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtgggcctcagtgaaggtctcctgcaaggcttctggattcacgtttacctctatagtatcaactgggtgcgccaggccgctggacaacgactgagtggatgggatgggacaaacctaacacgtggtcgtcactaggtgtccttacgacccagtcccgtaccgggaactaacggtaacctttacccagttaccgaacccgtaacggtaaccttacccctaccgtaaactaaaaccaaccgtaacgtacccttaaccgagttacgggaacgtttacgggaacgggtaacgtcccgtagaactaccgttacgttacggaaaccgtaaccgacccgggtacccgttaaccgtttaacgttaaccgtaggttaccggtaccggtaacgtaccggttacccccacgggtaaccgttacccgggtacgtaaccggtaccccgtacggggtacctaaccgggtacccggttacccgtttttaggacccgtttccgggtaacccgggggg

SEQ ID NO: 208564 - DNA, 577 bp, Homo sapiens
  misc_feature: GYAE6OF02JCVQO.17.25.C03.1.454.CMB.1.raw
  modified_base (279)..(279): a, c, t, g, unknown or other
  misc_feature (279)..(279): n is a, c, g, or t
  modified_base (290)..(290): a, c, t, g, unknown or other
  misc_feature (290)..(290): n is a, c, g, or t
  modified_base (327)..(327): a, c, t, g, unknown or other
  misc_feature (327)..(327): n is a, c, g, or t
  modified_base (334)..(334): a, c, t, g, unknown or other
  misc_feature (334)..(334): n is a, c, g, or t
  modified_base (489)..(489): a, c, t, g, unknown or other
  misc_feature (489)..(489): n is a, c, g, or t
  modified_base (523)..(523): a, c, t, g, unknown or other
  misc_feature (523)..(523): n is a, c, g, or t
  modified_base (541)..(541): a, c, t, g, unknown or other
  misc_feature (541)..(541): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtncgccaggccgntggacaacgacctgagtggatgggatgggcaacctanactggtntcacagtgtcttcgaccctatccgtaccggacacgaccttaccatcgaaccacgaaactccctacgaataaaccacagtccctaacagtcggagttgaacggagccctagaccaagttctacgaccgaacaccgggaccttacgttaatttacgngttgaccgagtacgtcccaacggtcttccgggtnaccgtcccgtacgggacncgggtccggtccttttcggactttccggtaccgggg

SEQ ID NO: 208565 - DNA, 535 bp, Homo sapiens
  misc_feature: GYAE6OF02G0C5Y.17.25.C03.1.454.CMB.1.raw
  modified_base (405)..(405): a, c, t, g, unknown or other
  misc_feature (405)..(405): n is a, c, g, or t
  modified_base (414)..(414): a, c, t, g, unknown or other
  misc_feature (414)..(414): n is a, c, g, or t
  modified_base (438)..(438): a, c, t, g, unknown or other
  misc_feature (438)..(438): n is a, c, g, or t
  modified_base (457)..(457): a, c, t, g, unknown or other
  misc_feature (457)..(457): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtgcgccaggccgctggacaacgacctgagtggatgggatggggccgaaccctaacactggtgtcacagtgtcttcacccatccgtcgggacagacttaccatcgaccacgaactcctaccaataaacncacgcctanagtggagttgaggacgcctagacntcgtgacgacgcggccttntattcgtgtcgcgtagccgtacccacggtctccggtgaccgccgtacggcacggccgtcctttaggccttcggcgggg

SEQ ID NO: 208566 - DNA, 595 bp, Homo sapiens
  misc_feature: GYAE6OF02HZ7KO.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcagtgaaggtctcctgcaaggcttctggattctaacgtttacctcctatagttatcaactgggtgcgcaggccgctggacaacggacctggagtggatggggatggggacgaaaccctaagacgtggtgtcacagttcgtccttcacccatccgtccgggaacagaccttaccatcgaaccacgaacctccctaccaataaaccacacgacctacataggagttaggaggacgtcctagactatcgtagaaccgacgacggtccgtacttaattctgtcgacggagtacgtccccgaaggacgttccgggtagaaccggtccgtaacgggacggtcccggttccgtttacggacccgtttcggacggggaacccg

SEQ ID NO: 208567 - DNA, 592 bp, Homo sapiens
  misc_feature: GYAE6OF02F6M9J.17.25.C03.1.454.CMB.1.raw
  modified_base (177)..(177): a, c, t, g, unknown or other
  misc_feature (177)..(177): n is a, c, g, or t
  modified_base (454)..(454): a, c, t, g, unknown or other
  misc_feature (454)..(454): n is a, c, g, or t
  modified_base (459)..(459): a, c, t, g, unknown or other
  misc_feature (459)..(459): n is a, c, g, or t
  modified_base (471)..(471): a, c, t, g, unknown or other
  misc_feature (471)..(471): n is a, c, g, or t
  modified_base (475)..(475): a, c, t, g, unknown or other
  misc_feature (475)..(475): n is a, c, g, or t
tcagcgtagactagcacgaccggtgctcgatttagtagtgtagatttgggtttgggggactcaacaaccacatctagtacctctagagaaaccctgtgagcacagctcctcaccatggactggacctggaggatcctcttcttggtggcagcagctacaagtgcccactcccaggtncagctggtgacagtctggggctggaggtgaagaagcctggggcctcagtgaaggtctcctgcaaggcttctggattctaccgtttacctctatagtactcaacgtgggtcgccgccgacggccgtcgtacggaaccaaccgccgtggaggtgggagtggggagtcggggacccgaaaccctaacgacgttggtcgtaccgacgtaggtcttccttaccaccctactcccgaccggacacgtaccttacatcgaccacgacctccacaataacacacncctangtgtagtgagcnctanacatctagacgacgcggtccgtacttacttactgtcgacgtagaccgtacccgacgtacgtccggtgaccgtcccgtacggcgtacggtcccggttctttcggaccgttcggcgggg

SEQ ID NO: 208568 - DNA, 688 bp, Homo sapiens
  misc_feature: GYAE6OF02I9FE9.17.25.C03.1.454.CMB.1.raw
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctgaggtgaagaagccgtgggcctcagtgaacggtctctgcagtcttctggacttcacgtttacctctatagtatcaacgtgggtgccgccgaggccgtctcggaacaaccggtacctggtaggtggaggtggggagtcggggaaccaacccgtaagtcgtaggtcgtacacgtaggttgtcctttccacccgtacgttccccggtaccggggactaacggtacccttaaccaacgttccgaccgaaccggtaaacccttcccgtaaaccctaaacgtaaaacccactaaccgtaccctaactaagtcggtaagttcggaacgggtacgtacctacgactactacgttacgaacccgacgacccggtaccttacctaacgtttacgtggtacgacggtagacccgtacccgacggtaccggtcccggtagtaccggtccgtaaccggcgtaccggttccggtacctttcggtaccgttccgggtaccgggg

SEQ ID NO: 208569 - DNA, 622 bp, Homo sapiens
  misc_feature: GYAE6OF02GYZRN.17.25.C03.1.454.CMB.1.raw
  modified_base (283)..(283): a, c, t, g, unknown or other
  misc_feature (283)..(283): n is a, c, g, or t
  modified_base (508)..(508): a, c, t, g, unknown or other
  misc_feature (508)..(508): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattcacgttttacctcctatagtatcaacgtgggtncgccaggccgctggacaacgcctggagtggatgggagtcgggacgaaccctaacgacgtggtcgtcacagttcgtccgttacacccctagtcccgtaccgggaaccagtaccttaccactcgaaccacgtaaccctccctaccaaataaaccacgaaccgtcctaacacgtggtaaggttcgaacgggtacgcctagactattcgtagaccgacaccgtccgttntacgttacgtgtcgacgtaggtaccgtacccgacggtccgttccgggtacgaccggtcccgttaacgggccgtacgggtcccgggttcctttacgtaccgtttcggcccggggg

SEQ ID NO: 208570 - DNA, 597 bp, Homo sapiens
  misc_feature: GYAE6OF02IARSH.17.25.C03.1.454.CMB.1.raw
  modified_base (238)..(238): a, c, t, g, unknown or other
  misc_feature (238)..(238): n is a, c, g, or t
  modified_base (243)..(243): a, c, t, g, unknown or other
  misc_feature (243)..(243): n is a, c, g, or t
  modified_base (262)..(262): a, c, t, g, unknown or other
  misc_feature (262)..(262): n is a, c, g, or t
  modified_base (283)..(283): a, c, t, g, unknown or other
  misc_feature (283)..(283): n is a, c, g, or t
  modified_base (320)..(320): a, c, t, g, unknown or other
  misc_feature (320)..(320): n is a, c, g, or t
  modified_base (406)..(406): a, c, t, g, unknown or other
  misc_feature (406)..(406): n is a, c, g, or t
  modified_base (444)..(444): a, c, t, g, unknown or other
  misc_feature (444)..(444): n is a, c, g, or t
  modified_base (446)..(446): a, c, t, g, unknown or other
  misc_feature (446)..(446): n is a, c, g, or t
tcagcgtagactagcacgaccggtgctcgatttagtagtgtagatttgggtttggggactcaacaaccacatctgtcctctagagaaaaccctagtgagcacagctcctcaccatggactggacctggaggatcctcttcttggtggcagcagctacaagtgcccactcccaggtgcagctggtgcagtcgtggggctgaggtgaagaagcctggggcctcagtgaaggtctcctagnaaggnttctggatcacgtttaccncctatagtatcaactgggtcncgacaggccgctggacaacgacctgagtgagtgggangggaccaacccaatacgtgggtcgtcaacgtgtgtcttacacccatccgtcgggacagacttacatgacccacgacctactccaanaaacacacgactacagtcggagttagagacgcccgtananacttcgacgacgaacgcccggaccgttccttaagttaaccgtcggtgaccggaacgaccgttacccaacgccgtaccgggtacgaacgccccgttaaggggccctaacggggtcgttaccccgttttcggtacccgtttgggtacccgggg

SEQ ID NO: 208571 - DNA, 620 bp, Homo sapiens
  misc_feature: GYAE6OF02H5JIY.17.25.C03.1.454.CMB.1.raw
  modified_base (359)..(359): a, c, t, g, unknown or other
  misc_feature (359)..(359): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattctacgtttacctcctatagtatcaacgtgggtgcgccaggccgctggacaaccgacctggagtcggagtggggagtggggaccgaaccctaacacgtgggtcgtacacgngttcgtcttccaccctactcccgtccgggacagtaccttaccatacgaccacgaacctcctccaaataaacacacgacctacagttacggagttcggaggacgtcctagaacattcgacgaaccgtaccgacgggtcccttattaacttaccgtgtacgcgtaacgaccggttccccaaggtcgtcccggggtagaacccggtcccgtaaccgggcgtacgggtccccggttcgttttcggacccgtttcggcccgggggg

SEQ ID NO: 208572 - DNA, 750 bp, Homo sapiens
  misc_feature: GYAE6OF02F5WYJ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggtattccacgtttacctcctatagtatcaactgggtgcgccaggccgcgtggaccaacgacctggagtggagtgggatggggaccgaaccctaacgacgttgggtcgtccaacgtaggtcgttacctttaccaccccgtacgttccccgtacccggggaacctaacggtaaccctttacccgaagtttaccggaaccccgtaaccggtaaacccttccccttaacccaaacgttaaaaacccaccgtaaaccgtaccccgttaaaccgaacggttcgggtaacggtttaggaacgggtaaccgtcccgttaagggaacctacgttaccgtacggaacccggtaccgtacccgggtacccgttacttaacgtttacctggttacgaccggtaagtaccgttaccccgacgggtacgttccccggggtaggtaaccggcccggttaaccgggacgtaaccgggtcccggttacccgttttacggtacccggttttccgggaccggggg

SEQ ID NO: 208573 - DNA, 546 bp, Homo sapiens
  misc_feature: GYAE6OF02IWE9W.17.25.C03.1.454.CMB.1.raw
  modified_base (278)..(278): a, c, t, g, unknown or other
  misc_feature (278)..(278): n is a, c, g, or t
  modified_base (312)..(312): a, c, t, g, unknown or other
  misc_feature (312)..(312): n is a, c, g, or t
  modified_base (333)..(333): a, c, t, g, unknown or other
  misc_feature (333)..(333): n is a, c, g, or t
  modified_base (376)..(376): a, c, t, g, unknown or other
  misc_feature (376)..(376): n is a, c, g, or t
  modified_base (398)..(398): a, c, t, g, unknown or other
  misc_feature (398)..(398): n is a, c, g, or t
  modified_base (401)..(401): a, c, t, g, unknown or other
  misc_feature (401)..(401): n is a, c, g, or t
  modified_base (419)..(419): a, c, t, g, unknown or other
  misc_feature (419)..(419): n is a, c, g, or t
  modified_base (428)..(428): a, c, t, g, unknown or other
  misc_feature (428)..(428): n is a, c, g, or t
  modified_base (456)..(456): a, c, t, g, unknown or other
  misc_feature (456)..(456): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaggcttctggattcacgtttacctctatagtatcaactgggtncgccaggccgctggacaacgctgagtggatgggntgggcaaccctagacgtggtntcacgagtagtccttcacccatcccgtcgggacagtacctacntcgacacgacctccacataacncancctacatggagttagagncctagactncgtagacacgcggtcctactattaccgntacggcgtagccgttaccccaggacgttccggtagtcgacccgtacggacgtacgggcccggtccctttaggtacccttggtacccgggg

SEQ ID NO: 208574 - DNA, 530 bp, Homo sapiens
  misc_feature: GYAE6OF02G6HER.17.25.C03.1.454.CMB.1.raw
  modified_base (278)..(278): a, c, t, g, unknown or other
  misc_feature (278)..(278): n is a, c, g, or t
  modified_base (288)..(288): a, c, t, g, unknown or other
  misc_feature (288)..(288): n is a, c, g, or t
  modified_base (329)..(329): a, c, t, g, unknown or other
  misc_feature (329)..(329): n is a, c, g, or t
  modified_base (407)..(407): a, c, t, g, unknown or other
  misc_feature (407)..(407): n is a, c, g, or t
  modified_base (428)..(428): a, c, t, g, unknown or other
  misc_feature (428)..(428): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttactcctatagtatcaactggtncgccaggccnctggacaacgacctgagtggatgggatgggcgaaccctaanactggtgtcacagtgtcttcacccatcctcgggacagacttaccatgaaccagaactcctaccataaacacagcctanatgattgagagctgacatctnaacgacacgccgtctattacgtgtgacgtagacgtcccgaacgacgtccggtaggaagtcccgtaacggccaggccggtccctttgaccgttactcgggggg

SEQ ID NO: 208575 - DNA, 536 bp, Homo sapiens
  misc_feature: GYAE6OF02GVLGS.17.25.C03.1.454.CMB.1.raw
  modified_base (280)..(280): a, c, t, g, unknown or other
  misc_feature (280)..(280): n is a, c, g, or t
  modified_base (330)..(330): a, c, t, g, unknown or other
  misc_feature (330)..(330): n is a, c, g, or t
  modified_base (336)..(336): a, c, t, g, unknown or other
  misc_feature (336)..(336): n is a, c, g, or t
  modified_base (431)..(431): a, c, t, g, unknown or other
  misc_feature (431)..(431): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtgatgggatgggcgaaccctaanactggngtcacagtgtcttcacccatcctcgggacagacttacatgaccacgaactcctaccaataaacacagcctaacagtggagttgagacgctgactntcgtgacgacacggcctactattactgtcgacgagtacgtcccaacgactccggtagacgccctacggcacggtaccggtcctttaggtaccttcgtaccggggg

SEQ ID NO: 208576 - DNA, 539 bp, Homo sapiens
  misc_feature: GYAE6OF02F9SZ3.17.25.C03.1.454.CMB.1.raw
  modified_base (465)..(465): a, c, t, g, unknown or other
  misc_feature (465)..(465): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggcgaaccctaacactggtgtcacagtgtcttcacccatcctcgggacagaccttaccatgacccacgaacctcctaccataaaccacacgacctacagtggagttgaggagcctgacatctgacgacacggccgttctacttacngtgacgagacgtcccacgtatcccggtaggacgaccgtacggcacggccggtccctttggaccttcgtacgggg

SEQ ID NO: 208577 - DNA, 789 bp, Homo sapiens
  misc_feature: GYAE6OF02HIMNO.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggtattcacgtttacctcctatagtatctaacgtgggtgcgccgaggccgcgtggacctaacgacctgaggtggagtgggagtcgggaccgaaaccgtaacgacgtgggtcgtaccacgtaaggttcgttaccgtttcccaaccccgtacgttccccggtacccggggaactaccggtaacctttacccgaagttacgaaccccgtaaccgtaaacccttcccctaaccaaacctaaaaacccaccgtaaacggtaccctaaacctaaggttacgggtaacggtttagggaacggggtaaccgtacccgttagtaaacccgtacgttaccggtaacggtaacccggaaaccgtacccggggtaccccgttaacgttaaccgtttttacggtacggttcgggaaccggtacggacccgttacccgtaaccggtaaccgggttacccggttacgggaacccggttaccccggttaaccgggtccctaaccggggtacccgggtttaccccttttacgggttaccccggttcgggttaacccgggggg

SEQ ID NO: 208578 - DNA, 581 bp, Homo sapiens
  misc_feature: GYAE6OF02IWKVU.17.25.C03.1.454.CMB.1.raw
  modified_base (402)..(402): a, c, t, g, unknown or other
  misc_feature (402)..(402): n is a, c, g, or t
  modified_base (412)..(412): a, c, t, g, unknown or other
  misc_feature (412)..(412): n is a, c, g, or t
  modified_base (426)..(426): a, c, t, g, unknown or other
  misc_feature (426)..(426): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctctttttggtggcagcagctacaagtgcccactcccaggtgcagctggtgcagtctggggctgaggtgaagaagcctggggcctcagtgaggtctcctgcaaggcttctggattcacgtttacctcctatagtatcaactgggtgcgccaggccgctggacaacgacctgagtggatgggagtgggacgaaccctaacactggtgtcacagtgtcttcacccatccgtccggacagacttacatcgaccacgactcctaccataaacncacgtcctanatggagttgagganccgtagacagtcctaggaacgaccgaccggcccgttactaagtttaccgtgtcgaggtaacgacggtaccccagtaccggtccgggtacgaacggtccccgtagggccacgggcccggttacctttagggaccgtttccgggacggggtacccgg

SEQ ID NO: 208579 - DNA, 596 bp, Homo sapiens
  misc_feature: GYAE6OF02GXEEH.17.25.C03.1.454.CMB.1.raw
  modified_base (447)..(447): a, c, t, g, unknown or other
  misc_feature (447)..(447): n is a, c, g, or t
  modified_base (463)..(463): a, c, t, g, unknown or other
  misc_feature (463)..(463): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaacgtgggtgcgccgaggccgcgtggaaccaacgacctgaggtggacgtgggagtggggaccgaacccgtaacacgtggtcgtcacgagttcgtccttaccacccctatcccgtccgggacacgtaccttaccacgtcgaccacgtaacctcctaccaataaaccacacgccctanagtggagttgaggacncctagacagttcgtagaccgaaccgaccggtccgtacttacttacgtcggtgacgagacgtcccgacggtcgtccggtacgacgtcccgtaaggccgtaggtccggtacctttgtaccgtttcggtaccgggg

SEQ ID NO: 208580 - DNA, 545 bp, Homo sapiens
  misc_feature: GYAE6OF02FYWLC.17.25.C03.1.454.CMB.1.raw
  modified_base (279)..(279): a, c, t, g, unknown or other
  misc_feature (279)..(279): n is a, c, g, or t
  modified_base (415)..(415): a, c, t, g, unknown or other
  misc_feature (415)..(415): n is a, c, g, or t
  modified_base (451)..(451): a, c, t, g, unknown or other
  misc_feature (451)..(451): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaaggcttctggattcacgtttacctcctatagtatcaactgggtncgccaggccgctggacaacgacctgagtggatgggatgggaccgaaaccctaacgactgggtgtcacgagtgtcttcgactcactccgtcgggacagtaccttaccatcgaaccacgaacctcctaccaataaacncacgtacctacatggagttaggaggacgcctgaacnttcgagacgacgaccggtccttatattacgtgtgacgagacgtacccacgagtccggtagacgtccgacggcacggccgtctttagccgttcgg

SEQ ID NO: 208581 - DNA, 640 bp, Homo sapiens
  misc_feature: GYAE6OF02I86B3.17.25.C03.1.454.CMB.1.raw
  modified_base (201)..(201): a, c, t, g, unknown or other
  misc_feature (201)..(201): n is a, c, g, or t
  modified_base (221)..(221): a, c, t, g, unknown or other
  misc_feature (221)..(221): n is a, c, g, or t
  modified_base (244)..(244): a, c, t, g, unknown or other
  misc_feature (244)..(244): n is a, c, g, or t
  modified_base (359)..(359): a, c, t, g, unknown or other
  misc_feature (359)..(359): n is a, c, g, or t
  modified_base (447)..(447): a, c, t, g, unknown or other
  misc_feature (447)..(447): n is a, c, g, or t
  modified_base (453)..(453): a, c, t, g, unknown or other
  misc_feature (453)..(453): n is a, c, g, or t
tcagcgtagactagcacgaccggtgctcgatttagtagtgtagatttggtttggggtacgtcgaacaaccacatctgtcctctagagaaaaccctagtgagcacagctcctcaccatggactggacctggaggatcctcttcttggtggcagcagctacaagtgcccactcccaggtgcagctggtgcagtctggggctgnggtgaagagcctggggcctnagtgaagtctcctgcaggcttcnggattcacgtttacctccgtatagtatcaacttgggtcgcgccgtaggcccgtcgtgggacaacgtaccctggaacgtcggatggggagtgggaccgaacccgtacacgtgggtntcgacaggtcgtcttccgacctactccgtaccgggactacgacttaccgacgtcgaacccgacgtaacctccctaccaaactaaaccnccgaancccgtaatacgtacggagttaggaaccggtacgccgtagtaccgacttcgacggaccgaccgaccggggcctactttaacgttaaccgtgttcggacgtacggacgttccccaacggacggttcccggaaggtaccgtcccggtacgacgtcggaccggtccctttggtacccgttgtacccggggg

SEQ ID NO: 208582 - DNA, 832 bp, Homo sapiens
  misc_feature: GYAE6OF02HR2VX.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagccgtgggcctcgagtgaaggtctccgtgcaaggtcttcgtggtatttctaccgttttacctcctatagtatcaacgttgggtcgccgaccgagggcccgcgtaggaaccaaccgtaccgtggacggtaggaggtaggggtacgtcggggacccgtaaaaccccgtaacgtacggttcgggttacgtaccgtaacgtacggttcgttaccgttaccgtaaccccgtacgttacccggtacccgggaactaacgtaacccgtttaacccgtagtacccgaacccgtaaacggtaaccccttccctaaacccgtaaaactaaaacccgaccgtaaccgtacccctaaacgtacgttacgggtaacggttacgggaacgggtaccgtacccgttaaggaacctaacgttaccgtaacgggtaaacccggaacccggttaaccggggtacccctttattaaaccgtttccggtacgtaccgggaccgggttaaaccgtccccggttaaccccgtacgggtaaccgttacccgggttacgaacccggttaaccccggttaccgggaccgttaaccgggtccccggttttcccgttttaacgggtaccccggtttacggggtaacccggggg

SEQ ID NO: 208583 - DNA, 564 bp, Homo sapiens
  misc_feature: GYAE6OF02IGGT7.17.25.C03.1.454.CMB.1.raw
  modified_base (280)..(280): a, c, t, g, unknown or other
  misc_feature (280)..(280): n is a, c, g, or t
  modified_base (338)..(338): a, c, t, g, unknown or other
  misc_feature (338)..(338): n is a, c, g, or t
  modified_base (412)..(412): a, c, t, g, unknown or other
  misc_feature (412)..(412): n is a, c, g, or t
  modified_base (480)..(480): a, c, t, g, unknown or other
  misc_feature (480)..(480): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggacaaccctaacactggtntcacgagtgtcttcaccctatcccgtccgggacacgtacttaccagtcgaccacgaacctcccacaataaaccncacgcctaacagtggtagttggaggacgcctagacatcgagaccgacacgggcctacttagttaccgnggtacgcgagtacgtcccaggcgttcccggtagacgtcccgtacggcagggtcccgttacctttcggacctttcggaccggggg

SEQ ID NO: 208584 - DNA, 560 bp, Homo sapiens
  misc_feature: GYAE6OF02HVJWG.17.25.C03.1.454.CMB.1.raw
  modified_base (279)..(279): a, c, t, g, unknown or other
  misc_feature (279)..(279): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtncgccaggccgctggacaacgacctgagtggagtgggatcggggccgaaccctaacactgggtgtaccacgagtgtcttccaccctatccctcgggacagacttaccatcgaccagaaccttcctaccaataaacgacacgcctacatggagttggagacgcctgacatctagacgtacacggtccgtctatttctgtcgcgagtacgtccccaggacgttccgggtgaacgtcccgtacgggcctaggcccggttcccttttaggtaccgttcggtcgggg

SEQ ID NO: 208585 - DNA, 629 bp, Homo sapiens
  misc_feature: GYAE6OF02IMOJY.17.25.C03.1.454.CMB.1.raw
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctgggaccaacgacctggaggtggagtgggatcggggaccgtaaaccctaacgacgtggtcgtacgaacgtagttcgtccttaccaccccgtagtcccgtaccgggaactacgtaccttaccatacgaaccacgtaacctccctaccaaactaaaccacacgaccctaacgaagtgggaaggttaggaacggtacgaccgttgaacctagtcgtacggaaccgaccgacggccgttacttacttaacgtgtacgcgtagaccgtacccaacggtcgtaccggagaccgtcccgtaaggccgacggtccggtacctttacggaccgttcggtaccgggg

SEQ ID NO: 208586 - DNA, 643 bp, Homo sapiens
  misc_feature: GYAE6OF02FF6S5.17.25.C03.1.454.CMB.1.raw
  modified_base (431)..(431): a, c, t, g, unknown or other
  misc_feature (431)..(431): n is a, c, g, or t
  modified_base (442)..(442): a, c, t, g, unknown or other
  misc_feature (442)..(442): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctgggggcctcagttgaaggtctcctgcaaggcttctggattcacgtttacctcctatagtatcaactgggtgcgccaggcccgctggacaacggacctgagtgggatgggatgggaccgaaccctaacgactgggtctcgacagtgtccttccgaccctactcccgaccggggtacaggtacccttaccgatcgacccacgaacctccgtaccaataaacccncacgccctaanatgggagttggacggagccctagacgatcgtaggaccgtaccgaacgggtcccgtacttagttaactgttcgacgacggtacgtaccccaagggtaaccgttcccgggtaacggtaaccggtacccccgttaaacggggccctaacggggtccccgggtttacccgtttttccggtaaccgtttttccggacccggggggg

SEQ ID NO: 208587 - DNA, 731 bp, Homo sapiens
  misc_feature: GYAE6OF02IW1EY.17.25.C03.1.454.CMB.1.raw
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttcgtggattctacgtttacctcctatagtatcaacgtgggtgccgccaggccgcgtcgggacaacggaccgtggaggtggagtcgggagtcggggaccaaccctaacgacgtggtcgtacagagttcgtcttaccaccctatcccgtacgggacacgtaccttacgactacgaaccacgtaacctccctaacaactaaaccacacgtaccctaacgtaacgtagggtaagttacggaagggtaccgtccgtacgaaccgtacgttccgtaacggaaccgtaaccggtaacccggggtacccgtttaacgttaacgttttaaccgttcggtaccgtaccgggaaccggtacccggttaccccggtaaacgggttcccggttacccggggttaacggaaccggttaccccggttaaccgggacccgttaaccggggtacccgggtttccccgttttacgggttaccccggtttccgggtaacccgggggg

SEQ ID NO: 208588 - DNA, 637 bp, Homo sapiens
  misc_feature: GYAE6OF02F6SUP.17.25.C03.1.454.CMB.1.raw
  modified_base (248)..(248): a, c, t, g, unknown or other
  misc_feature (248)..(248): n is a, c, g, or t
  modified_base (353)..(353): a, c, t, g, unknown or other
  misc_feature (353)..(353): n is a, c, g, or t
  modified_base (448)..(448): a, c, t, g, unknown or other
  misc_feature (448)..(448): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcgtggnttcacgtttacctcctatagtatcaacgtgggtgcgccacggccgctggacaacgacctgagtggagtgggagtcgggacgaaccctaacgacgtggtgtcgagngttcgtccttaccaccctacgtccgtaccggaactacgtaccttacacgtcgaacctacgaacctccctaccaactaaaccacacgtaccctaanagtcgggtagttggacggagtccgtacgactacttcgtacggaaccgacgtacccgggtccgttacttaactttcgtggtcgacggtaacgaccgttccccacggtaacgtccgggtacgaaccggtacccgttacgggctacgggtcccggttccgttttaccgggaccgtttccggggtacccgggg

SEQ ID NO: 208589 - DNA, 665 bp, Homo sapiens
  misc_feature: GYAE6OF02GP17E.17.25.C03.1.454.CMB.1.raw
  modified_base (283)..(283): a, c, t, g, unknown or other
  misc_feature (283)..(283): n is a, c, g, or t
  modified_base (448)..(448): a, c, t, g, unknown or other
  misc_feature (448)..(448): n is a, c, g, or t
tcagcgtagactagcacgaccggtgctcgatttagtagtgtagatttgggtttggggacgtcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagaagccgtggggcctcagtgaaggtctcctgcaaggcttctggattcacgtttacctctatagtatcaacgtgggtncgccaggccgctggacaacgcctgagtggatgggatgggaccgaaacccgtaacactggtgcacgagtgtcttcaccctagtcccgtccggacacgtacttaaccgatacgaaccctaaccgaaccttcccctaccaaacgtaaaccacgaaccgtacccttaanacgtcgggtaaggttgaacgggtactaccgtagtacctagttcgtacgaaccggacctaccgggtcccttacgttaacgttttaaccgtggttaccggacgtacggtacccgtaaccccgtaacggaccggttacccggggttcgaacccggtcccgttaacggggacctaccgggtccgggttcccttttacgggtaccgttcggtacccgggggg

SEQ ID NO: 208590 - DNA, 580 bp, Homo sapiens
  misc_feature: GYAE6OF02GND2Q.17.25.C03.1.454.CMB.1.raw
  modified_base (412)..(412): a, c, t, g, unknown or other
  misc_feature (412)..(412): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctcgtggtgggggtcagagtcaccatcacttgccgacaagtcacggacttaaaacctatttaaattggtatcagcaagaaacctggaaaacgccccagaccctcctgactctcgtggtgcatccactctgacgaagtcggccgtacccagtcgaggttcaggtgacagtggatcgtgggacagtatttcatctacaccatccaccactctacgcaacgtgtagtatgngacaatctactactatacaacagtacgttactaccgttcccctacgtcttacgtttcggaccgtaacgggtaacctaaggttcggaacgtaagtaaccgtaaaaccggtaacgttcggtacggttaccgtacggtaaccctaccgtaacgttccgttacgtttacccg

SEQ ID NO: 208591 - DNA, 621 bp, Homo sapiens
  misc_feature: GYAE6OF02IZED4.17.25.C03.1.454.CMB.1.raw
  modified_base (345)..(345): a, c, t, g, unknown or other
  misc_feature (345)..(345): n is a, c, g, or t
  modified_base (446)..(446): a, c, t, g, unknown or other
  misc_feature (446)..(446): n is a, c, g, or t
  modified_base (522)..(522): a, c, t, g, unknown or other
  misc_feature (522)..(522): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaaccggacctggaggtggacgtggggatcggggaccgaaaccccgtaanacgttgggtgtccgaacaggttcgtccttccaacccctatcccgtccgggacacgaccttaccatcgaccacgaactcccacaataaaccacagccctaanactcgggtaagttcgaagggacgccgtagacctagtctagaaccgacgtaacccgggccgttactacgtttaccgnggtacgacgtaacggacgttacccgagtacgtcccggggtagaccggtccgtaaccgggcaacggtcccggtccctttaggtcccgtttggaccggggg

SEQ ID NO: 208592 - DNA, 623 bp, Homo sapiens
  misc_feature: GYAE6OF02FOGMC.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggagtgggatgggcgaaccctaacactggtgtcactagtgtccttcacccactcctccgggacagacttaccatcgacccacgaactcctaccaataaaccacacgccctaacagtaggtagttacggaggtacgcccgtagaacctacgttaccgtcgaaccgaccgaaccggtcccggttacttaacgttactggtacggaccggtaacgtacgtaccccgaacggtaacgttccccggggtagaaccggtcccgttaacggggcctaacgggcccgggttaccctttggtacccgttcgggtacccgggggg

SEQ ID NO: 208593 - DNA, 734 bp, Homo sapiens
  misc_feature: GYAE6OF02INMTM.17.25.C03.1.454.CMB.1.raw
tcagcgtagactagcacgaccggtgctcgatttagtagtgtagatttgggtttggggactcaacaaccacatctgtcctctagagaaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctccgtgcaaggcttcgtggattcacgtttacctccttaatacgtactcaacgtgggtgcgccaggccgctggacaacgccgtggaggtggatggggagtcgggaccgaaacccgtaacacgttggtacgtacgacgtagtcgtccttaccgacccctatcccggttaccggggaactaacggtaacctttaaccgaagttaccgaacccgtaaccgtaacccttaccctaaccccgtaaacgtaaaacccaccgtaaaccgacccttaaacgtaacgttagggtaacgtttcggaacggtaccgtaccgttagaacccgtacgttaccgacggaaccggaacgtaacccgggtacccgttacgtttaacgttaaccgtcggtaacgccggtaacgtaccggtacccgaccggtacggttacccgggtacgaaccggtacccgtaaccggaccggtaccggtcccggttacccgttttacggtacccgtttcggtacccggggg

SEQ ID NO: 208594 - DNA, 517 bp, Homo sapiens
  misc_feature: GYAE6OF02F2Q0E.17.25.C03.1.454.CMB.1.raw
  modified_base (203)..(203): a, c, t, g, unknown or other
  misc_feature (203)..(203): n is a, c, g, or t
  modified_base (352)..(352): a, c, t, g, unknown or other
  misc_feature (352)..(352): n is a, c, g, or t
  modified_base (399)..(399): a, c, t, g, unknown or other
  misc_feature (399)..(399): n is a, c, g, or t
  modified_base (415)..(415): a, c, t, g, unknown or other
  misc_feature (415)..(415): n is a, c, g, or t
  modified_base (435)..(435): a, c, t, g, unknown or other
  misc_feature (435)..(435): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtcctccatcctccctgtctgcctctgtgggggtcagngtcaccatcacttgccggacaagtcacggacttaaaaacctatttaaattggtatcagcaagaaacctggaaaacgccccaagacctcctagactctcgtggtgcactcccactctcgcgaagtggcgtcccatcgaggttcagtggcnggtggatcgtgggacagtatttacaattctacacatccaccactctnctacctgaggtatgtnactatctactactgtacaanagtattactacgttccctcgtctactttcggacgacgggaactagtagagtatacaacgagtgtgctcgcactatctgttcc

SEQ ID NO: 208595 - DNA, 668 bp, Homo sapiens
  misc_feature: GYAE6OF02IEWS9.17.25.C03.1.454.CMB.1.raw
  modified_base (305)..(305): a, c, t, g, unknown or other
  misc_feature (305)..(305): n is a, c, g, or t
  modified_base (472)..(472): a, c, t, g, unknown or other
  misc_feature (472)..(472): n is a, c, g, or t
tcagcgtagactagcacgaccggtgctcgatttagtagtgtagatttgggtttggggagtcagtctcagtcaggacacagcatggacatgagggtccccgctcagctccgtgggctcctgctactctggctcgagctgccagagtgtgacatccagatcgaccctagtctccatccctcctgtctcgcccttgtgggtcggggtcagtcgtacacctatctacttcggaccgaacaagtccaacggtaactttaaaaccttatttaaagttggtactcgagactaagtaaaccgtaggaaaaccnccccgaacgtaccttccgagtacttcgtacgtggtcactactcctacgtctgacgtagtcggtacctcccaggtcgtagttcgaggtcggacgagtgtactcggtacggactagtacttacaacgtctaccactatccaacctctcgtacacgtaacctggaacgtntttaggctaactacgttctaacctatacgtaaccaagtaacgttacgttaacctaccgttcccgtacgtacgtttaccggtttcggaccgggtaaacgggtaacccttaagggttcgaacggttaccaaaccgttaaacggtacggtttacgtccggtacgtaccgaccgttactaacgtttcgtactttaacccg

SEQ ID NO: 208596 - DNA, 633 bp, Homo sapiens
  misc_feature: GYAE6OF02F3QQ9.17.25.C03.1.454.CMB.1.raw
tcagcgtagactagcacgaccggtgctcgatttagtagtgtagatttgggtttggggactctaacgaaccacatctgtcctctagagaaaaccctgtgagcacagctcctcaccatggactggacctggaggactcctcttcttggtggcagcagctacaagtgcccactcccaggtgcagctggtgcagtcgtgggctgaggtgaagaagcctggggcctcagtgagtctccgtgacaggcttctggtattcacgtttacctcctatagtactcaacgtgggtcgcgaccacggcccgctcggaactaacggacctggaggtggagtgggcgtcgggaccgtaacctacgacgtggtcgtctactaggtcgtctaccacctacgtcccgtacggacgtacgtacctaccactcgaccacgtactccctaccaataaaccacgagacctagatggtacgttagacggcgtacctagactagtacgtagaaccgtaccgaacgggtaccgttaacgttacgttacgtggtacgacgtacggacccgtacccgacggtaaccgtcgggttacgaaccgtcccggtaaccggcctacgggtcccgtttaccgttcgtaccggttcgggtaccgggg

SEQ ID NO: 208597 - DNA, 624 bp, Homo sapiens
  misc_feature: GYAE6OF02FMCMM.17.25.C03.1.454.CMB.1.raw
  modified_base (298)..(298): a, c, t, g, unknown or other
  misc_feature (298)..(298): n is a, c, g, or t
  modified_base (436)..(436): a, c, t, g, unknown or other
  misc_feature (436)..(436): n is a, c, g, or t
  modified_base (450)..(450): a, c, t, g, unknown or other
  misc_feature (450)..(450): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtctccgtgcaaggcttcgtggattcacgtttacctcctatagtatcaactgggtgcgccgaggccgntggaccaacgacctggagtggagtggggagtcggggacctaaacccgtaacgacgttaggtcgtacacgtagttcgttccttaccgaccctactcccgtaccgggacacgtacctacgatcgaccacgactccacaanaacacacgcctaanagtgtagttagaggcgacctgactatcgtacgaccgacgacggtcctacttattaacgtggttcggacgtacggtaccgtcccgaacggtaccgtaccgggttacgacccggtaccggtacgggccgtaccggggtccggtttaccgtttcggtaccgtttcgggtaccggggg

SEQ ID NO: 208598 - DNA, 783 bp, Homo sapiens
  misc_feature: GYAE6OF02JT598.17.25.C03.1.454.CMB.1.raw
  modified_base (275)..(275): a, c, t, g, unknown or other
  misc_feature (275)..(275): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtgcccactcccaggtgcagctggtgcagtcgtggggactgaggtgaaggaacgccgtggggcctcgagtagaaggtctaccgtgcgaaggcttcgtggatttccgacgtttaccncgttatagtatccaagtgggtcgcgtccgacggcccgtacgtacgggacctaaaccgtaccgtggaacggtggaacggtcgggagttacggggaaccgtaacccctaacgtaacgtgggtctaccgacgtagttcgtctaccgaaccgtacgtcccgtaccggggtaactacggttaaccctaccgaacgtaccgaacccgtaacggtaaccctacccgtaacccctaaaggtaaaacccactaacggaacccttaccgtaaggtgggtaaacgttagggacgtaacgtccgttaaggacttaccgtagtaccgggaaccgtacccgtaaccggggtccgtttaaccgtaactttaccgggtacgttaaggtaccggaaccggtaccgttaaccccggtaccgtaaccgggtaacccggttaccgggaaccgtacccgttaaccggggaccctaacgggttaccccgggttcttttacccgggtaccggttccggttaacccgggggg

SEQ ID NO: 208599 - DNA, 761 bp, Homo sapiens
  misc_feature: GYAE6OF02H7L98.17.25.C03.1.454.CMB.1.raw
  modified_base (239)..(239): a, c, t, g, unknown or other
  misc_feature (239)..(239): n is a, c, g, or t
  modified_base (252)..(252): a, c, t, g, unknown or other
  misc_feature (252)..(252): n is a, c, g, or t
  modified_base (287)..(287): a, c, t, g, unknown or other
  misc_feature (287)..(287): n is a, c, g, or t
  modified_base (493)..(493): a, c, t, g, unknown or other
  misc_feature (493)..(493): n is a, c, g, or t
tcagcgtagactagcacgaccggtgctcgatttagtagtgtagatttgggtttggggtacgtcaacaaccacatctgtcctctagagaaaaccctagtgagcacagctccctcacccatggactggacctggaggatcctcttcttggtggcagcagctacaagtgcccactcccaggtcgcagctggtgcagtctggggctggaggtgaagaagccgtggggctcgaggtgaaggtcnctgcaggcttcgnggattcacgtttacctctatagtatcaactgggtncgcctaggccgctggacaacgacctggagtggattggggagtcggggaccgtaaaccctacgacgtgggttgtaccgacgtaaggttcgtcctttaacccgaccccgtacttccccggtaccggggaacctagggtacccttaaccctagttccgaaccaacccggtactcccctaaccaagtaaaacccagaaccgtccctaaanagttcgggaacgttggaaacggacgtcccttagggaactcgttaccgttacggaaacccgtcggaacccggggttaccttacccgtttaagttttacccggaggttcccgggaaccgaaggggttaccccttcccccggtaacgggaacccgttttcccggggggagaacccgggtaacccccggttcccggggacgttaaaccccggggtccccgggttaccccgttttttacgggtaacccggttcccggggttacccgggggggg

SEQ ID NO: 208600 - DNA, 527 bp, Homo sapiens
  misc_feature: GYAE6OF02F4B6D.17.25.C03.1.454.CMB.1.raw
  modified_base (332)..(332): a, c, t, g, unknown or other
  misc_feature (332)..(332): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggcgaaccctaanactggtgtcacagtgtcttcacccatccgtcgggacagacttaccatcgaccacgaactcctccaataaacacagcctacatggagttgaggagcctgacatcgtgacgacaccggccgtctattactgtgcgagacgtcccacgacgtccggtgacgtcctacggcacggtccgtcctttcgacttcgtcgggg

SEQ ID NO: 208601 - DNA, 629 bp, Homo sapiens
  misc_feature: GYAE6OF02GGS4R.17.25.C03.1.454.CMB.1.raw
  modified_base (228)..(228): a, c, t, g, unknown or other
  misc_feature (228)..(228): n is a, c, g, or t
  modified_base (237)..(237): a, c, t, g, unknown or other
  misc_feature (237)..(237): n is a, c, g, or t
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
  modified_base (275)..(275): a, c, t, g, unknown or other
  misc_feature (275)..(275): n is a, c, g, or t
tcagcgtagactagcacgaccggtgctcgatttagtagtgtagatttgggtttggggacgtcaacaaccacactctgtaccctctagagaaaaccctcgtgagcacacgctcctcaccatggactcggacctggaggagtcctcttcttggtcggcagcagctacaagtgcccactcccgaggtcgcacgcgtggtgcagtctggggctgaggtgaagagctgggctnagtgagtcnctgcagctngatcngttacnctatagtatcaactggtncgccaggccgcgtggacaacgcctggagtggatgggatgggacgaacccgtaagaccgtggtcgtaccgaccgtagtacgtcgttaccaacccgatacccgtacggggaacacgtaaccttaccgaattcggtaaccccaacggtaacctccgtaccaacgtaaaccaccacgaccctaacaacgtcggagttacgacggacgtacgtgaacagtacgtagacgacgtacggaccgtacttacgttactaggttcgaccgtagtacgtacccgtacggtaccgtccggtacgtaacggtacccgttaacggcgtacggtaccggttccgttttcggtaccgtttgtaccggggg

SEQ ID NO: 208602 - DNA, 595 bp, Homo sapiens
  misc_feature: GYAE6OF02FJES2.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgcgtggacaacgacctgagtggatgggatggggcaaccgtaacactggtctcacagtcgtctcacccagtccctcgggacacgacttaccgatcgaccacgaactcctaccattaaacacacgcctacagtcggagttaggagggtactcccgtgacgtatcgtacgaacgtacaccggggccgttacttaattaccgtagttcgccgtaagtacgtaccccgacggtaagttcccgggtaggtaacccgtacccgtaacgggtccacgggtccgggtcccttttcggaccttttcggaccggggg

SEQ ID NO: 208603 - DNA, 546 bp, Homo sapiens
  misc_feature: GYAE6OF02IWZ2L.17.25.C03.1.454.CMB.1.raw
  modified_base (342)..(342): a, c, t, g, unknown or other
  misc_feature (342)..(342): n is a, c, g, or t
  modified_base (408)..(408): a, c, t, g, unknown or other
  misc_feature (408)..(408): n is a, c, g, or t
  modified_base (417)..(417): a, c, t, g, unknown or other
  misc_feature (417)..(417): n is a, c, g, or t
  modified_base (432)..(432): a, c, t, g, unknown or other
  misc_feature (432)..(432): n is a, c, g, or t
  modified_base (441)..(441): a, c, t, g, unknown or other
  misc_feature (441)..(441): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtgcgccaggccgctggacacgacctgagtggatgggagtgggcaaccctaacgacgtggtgtcanagtcgtcttccacccatccgtaccgggacacgtacttacatcgaccacgaactcctacactaaacncacgcctanagtggagttgagganccgtagacntctagacgacgacggccgtacttattactgtgacgtagacgtcccacgtacgtcccggtagacgaccgtacggcacggccgttccgtttcgtacgttcgtcgggg

SEQ ID NO: 208604 - DNA, 797 bp, Homo sapiens
  misc_feature: GYAE6OF02JXHIT.17.25.C03.1.454.CMB.1.raw
  modified_base (252)..(252): a, c, t, g, unknown or other
  misc_feature (252)..(252): n is a, c, g, or t
  modified_base (270)..(270): a, c, t, g, unknown or other
  misc_feature (270)..(270): n is a, c, g, or t
  modified_base (292)..(292): a, c, t, g, unknown or other
  misc_feature (292)..(292): n is a, c, g, or t
tcagcgtagactagcacgaccggtgctcgatttagtagtgtagatttgggtttggggtacgtcgaacaaccacatctgtcctctagagaaaaccctagtgagcacagctcctcaccatggactggacctggaggatcctcttcttggtggcagcagctacaagtgcccactcccaggtgcagctggtgcagtctggggctggaggtgaagaacgcgtggggcctcagtgaaggtctccgtgcaaggtcttcnggtattcacgttttaccncctatagtatcaacgtcgggtnccgtccaggtccgcgtcggacaacgcctgacggttaggactggggatggggacccgaaccgttaacacgtgggttcgtaccgacgtaacggttgttccgttccaaccccgaacttccccgttcccgggggaacctaagggaccccttttaaacccgagttacccggaaccccgtaaccggtaaacccttccccgttaccctaaacttaaaacccgaccttaaacggcccctttaaacgaagtcggggtaacggtttcggaaacgggacgtacccttacggactaaccgttccgtagaaacccgggtaccaacccggggttccgttaccctttaatttaaccggtcggtccgtacggggtaacgtacccgttacccggacccggtaaccggtttcggggttaacggacccgggtttacccccgtaaacgggggttcccaaacgggggttccccgggttaccccttttttaacgggacccgggtttttccccggggtaaccgggggg

SEQ ID NO: 208605 - DNA, 641 bp, Homo sapiens
  misc_feature: GYAE6OF02IKH3M.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcctggggcctcagtgaaggtctcctgcaaggcttctggattctacgtttacctcctatagtatcaactgggtgcgccgaggccgctggacaacgacctgaggtggagtgggagtgggacgaaaccctaacacgtggtcgtacacgtagtcgtcttccacccactccgtccggacacgacttaccgatcgaaccacgtaaccctccctacctaataaaccaccgtacgaccctaacagtgggtaagttcggagggaacctccgtagactacgtcgttacggaaccgaccgtacccggtacccgttacttaacgtttaccgtggttacgaccggtagtacccgtcccctacggtacgttcccgggtagaacccggtcccgtaaccgggctaccgggtcccggttacctttcgggtaccgttcgggtaccggggg

SEQ ID NO: 208606 - DNA, 542 bp, Homo sapiens
  misc_feature: GYAE6OF02HCJ4O.17.25.C03.1.454.CMB.1.raw
  modified_base (243)..(243): a, c, t, g, unknown or other
  misc_feature (243)..(243): n is a, c, g, or t
  modified_base (279)..(279): a, c, t, g, unknown or other
  misc_feature (279)..(279): n is a, c, g, or t
  modified_base (331)..(331): a, c, t, g, unknown or other
  misc_feature (331)..(331): n is a, c, g, or t
  modified_base (408)..(408): a, c, t, g, unknown or other
  misc_feature (408)..(408): n is a, c, g, or t
  modified_base (495)..(495): a, c, t, g, unknown or other
  misc_feature (495)..(495): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttcnggattcacgtttacctcctatagtatcaactgggtncgccaggccgctggacaacgacctgagtggatgggatggggacaaccctaanactggtgtcacgagtgtcttcacccatcccgtcgggacagaccttaccatcgaccacgacctcctaccaataaaccncagcctaacagtggagttgaggacgcctagacatctgaccgacgaccggccttactacttactgtgcgagcgtcccacgcgtccggngacgtacccgtaggccacggccggtcctttggacccttggtacgggg

SEQ ID NO: 208607 - DNA, 546 bp, Homo sapiens
  misc_feature: GYAE6OF02FZVE8.17.25.C03.1.454.CMB.1.raw
  modified_base (331)..(331): a, c, t, g, unknown or other
  misc_feature (331)..(331): n is a, c, g, or t
  modified_base (411)..(411): a, c, t, g, unknown or other
  misc_feature (411)..(411): n is a, c, g, or t
  modified_base (444)..(444): a, c, t, g, unknown or other
  misc_feature (444)..(444): n is a, c, g, or t
  modified_base (469)..(469): a, c, t, g, unknown or other
  misc_feature (469)..(469): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgcctgagtggatgggatgggccaaccctaacncgtggtcgtcacagtgtcttcaccctatccctaccgggacagtaccttaccatcgaccacgaactccctccaataaaccncacgccctaacatggagttgaggacgcctgacntctagacgacacggcctctattacngtgcgagcgtcccacgtcgtccggtgacgtacccgtacgggctacggcccggttcctttggaccgttcggtacgggg

SEQ ID NO: 208608 - DNA, 544 bp, Homo sapiens
  misc_feature: GYAE6OF02FF2XK.17.25.C03.1.454.CMB.1.raw
  modified_base (279)..(279): a, c, t, g, unknown or other
  misc_feature (279)..(279): n is a, c, g, or t
  modified_base (290)..(290): a, c, t, g, unknown or other
  misc_feature (290)..(290): n is a, c, g, or t
  modified_base (340)..(340): a, c, t, g, unknown or other
  misc_feature (340)..(340): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgttacctcctatagtatcaactgggtncgccaggccgntggacaacgacctgagtggatgggatgggcaaccctaacactggtgtcanagtgtcttcacccatcctccgggacacgacttaccgatcgaacccacgaacctcctaccaactaaaccacacgcctaacatcggagttgaggacgcctgacatctgacgacacggcctcttatactgtgcgtagacgtcccacgtactccggtagacgaccgtacggcgacggtcccggtcctttcgaccgttcggtaccgggg

SEQ ID NO: 208609 - DNA, 554 bp, Homo sapiens
  misc_feature: GYAE6OF02GY2CO.17.25.C03.1.454.CMB.1.raw
  modified_base (335)..(335): a, c, t, g, unknown or other
  misc_feature (335)..(335): n is a, c, g, or t
  modified_base (343)..(343): a, c, t, g, unknown or other
  misc_feature (343)..(343): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgcctgagtggatgggatgggcaacctacacgtggtntcacagtntcttcaccctatccgtacgggacagacttaccatcgaccacgacctcctaccactaaacacacgacctacagtggtagttgacggacgccgtagacatctaggaccgacgaccgggtcctacttattacgtgtcgcgagtcgtacccgacgtcgtccggtgacgtcccgtaggccgaggccggttaccgtttgtaccgttcggtaccgggg

SEQ ID NO: 208610 - DNA, 632 bp, Homo sapiens
  misc_feature: GYAE6OF02IKGDR.17.25.C03.1.454.CMB.1.raw
  modified_base (279)..(279): a, c, t, g, unknown or other
  misc_feature (279)..(279): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggcctcagtgaaggtctcctgcaaggcttctggattcacgtttacctcctatagtatcaactgggtncgccaggccgctggacaacggacctgagtggagtgggatgggacgtaaaccctaacacgtggtgtcacgagtgtccttcacccatccgcgggacacgtactaccatcgaccacgtaactcccacaataaacactacgcctaacagtcgggtaattcggaaggactaccgttgaactagttctacggaaccgaccgtaccggcccgttacttaacgtttacgtcggtacgtaccgaaggtacccgtaaccccgtaggtaaccgttacccggggtcgaaccggtaccccgttaacggggcctaacgggtccccggttaccggtttttacggcccgttttacgggaacccgggggg

SEQ ID NO: 208611 - DNA, 583 bp, Homo sapiens
  misc_feature: GYAE6OF02I6OX7.17.25.C03.1.454.CMB.1.raw
  modified_base (268)..(268): a, c, t, g, unknown or other
  misc_feature (268)..(268): n is a, c, g, or t
  modified_base (288)..(288): a, c, t, g, unknown or other
  misc_feature (288)..(288): n is a, c, g, or t
  modified_base (429)..(429): a, c, t, g, unknown or other
  misc_feature (429)..(429): n is a, c, g, or t
  modified_base (442)..(442): a, c, t, g, unknown or other
  misc_feature (442)..(442): n is a, c, g, or t
  modified_base (450)..(450): a, c, t, g, unknown or other
  misc_feature (450)..(450): n is a, c, g, or t
  modified_base (476)..(476): a, c, t, g, unknown or other
  misc_feature (476)..(476): n is a, c, g, or t
  modified_base (552)..(552): a, c, t, g, unknown or other
  misc_feature (552)..(552): n is a, c, g, or t
tcagcgtagactagcacgaccggtgctcgatttagtagtgtagatttgggtttggggacgtcaacaaccgacgatctgtcctctagagaaaaccctgtgagcacacgctcctcaccatcggacctggacctggaggatcctcttcttggtggcagcagctacaagtgcccactcccaggtgcagctggtgcagtctgggggctgaggtgaagaagcctggggcctcagtgaaggtctcctgccaaggcttctggattcacgtttaccncctatagtatcaactgggtnacgccaggccgctggacaacgacctgagtggagtgggatcggacaaccctaagactggtgtaccacagtgtccttacaccctatcccgtacgggaactagtaccttaccatacgaccacgaacctcctacaaactaaaccncgaacgtcctaanactagggntttaggacggtagccctagactatcncggaaccgacgaccggtccttataacgttttacagtcgacgtagacgtcccagacgtccggagactccgaccggtnacgggtcggtaccttggtacctagtccgggg

SEQ ID NO: 208612 - DNA, 627 bp, Homo sapiens
  misc_feature: GYAE6OF02I3LV5.17.25.C03.1.454.CMB.1.raw
  modified_base (443)..(443): a, c, t, g, unknown or other
  misc_feature (443)..(443): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctggagtggatggggatcggggaccgaaccctaacacgtgggtcgtcacagtcgtccttccacccatcccgtaccgggactacgtaccttaccatacgaccaacgtaacctccctacaaactaaaccacacgtaccctaanagttcggtagttacggaggtacgcctagactactcgtagaaccggaccaccggggtccttacttaacgtttacgtggttacgacgtacgtacgttaccccgacggtaacgtcccgggttagaacccgtacccgtacggccgaacggtcccggttaccgtttcgaccgtttccgggtaccggggg

SEQ ID NO: 208613 - DNA, 653 bp, Homo sapiens
  misc_feature: GYAE6OF02GUMT8.17.25.C03.1.454.CMB.1.raw
  modified_base (332)..(332): a, c, t, g, unknown or other
  misc_feature (332)..(332): n is a, c, g, or t
  modified_base (418)..(418): a, c, t, g, unknown or other
  misc_feature (418)..(418): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgcgtggacaacgacctgagtggatgggatgggcgaaccctaanacgtggtgtcacgtagtcgtcttcaccctactccgtccggacacgtaccttaccactcgaccacgaacctcctacaactaaaaccncacgtacctaacgagtacggtaggttcggaaggtacgtccgtaggaacctacgttccgtacggtaacccggaccgtacccggggtccctttacgttaacgttaccgtacggtcggaccgtaacggtaccgtaccccgtaacggtaacggttcccgggtaaggaaccggtaccccgtaacgggacccgacgggtcccggttcccttttagggaccccgttttccgggaccgggggg

SEQ ID NO: 208614 - DNA, 604 bp, Homo sapiens
  misc_feature: GYAE6OF02G7F89.17.25.C03.1.454.CMB.1.raw
  modified_base (244)..(244): a, c, t, g, unknown or other
  misc_feature (244)..(244): n is a, c, g, or t
  modified_base (280)..(280): a, c, t, g, unknown or other
  misc_feature (280)..(280): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcnggattcacgtttacctctatagtatcaacgtgggtncgccaggccgctggacaacgacctgagtggatgggatggggaccaacccgtaacacgtggtgtaccacgaggtcgtcttccacccctatcccgtaccgggactacgtaccttaccatcgacccaacgtacctaccctaccaaataaacacacgtacctaacatcggagttagaggacgtccgtacgactatcgtacgaccggacgtaccggccgtacttaacgttacgtcgtacgaccgtaggaccgtacccgacggtcgtaccggtggacgtcccggtaggaccgaggtcccggttccgtttacgtaccgttcggtaccgggg

SEQ ID NO: 208615 - DNA, 584 bp, Homo sapiens
  misc_feature: GYAE6OF02GJ180.17.25.C03.1.454.CMB.1.raw
  modified_base (243)..(243): a, c, t, g, unknown or other
  misc_feature (243)..(243): n is a, c, g, or t
  modified_base (298)..(298): a, c, t, g, unknown or other
  misc_feature (298)..(298): n is a, c, g, or t
  modified_base (330)..(330): a, c, t, g, unknown or other
  misc_feature (330)..(330): n is a, c, g, or t
tcagcgtagactagcacgaccggtgctcgatttagtagtgtagatttgggtttgggagtcagtctcagtcaggacacagcatcggacaatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctntttaaattggtatcagcagaacctggaaagccccagacctcctgactctctggtncatccactctgcgaagtgctccatcgagttcngtgcagtgatcgtggacagtatttcaatctacacctataccacctactctagacctaaccgttggaacggtattaggtgactaaacgttacgttaacctaacttcggtaacaaacgtacgtaacgtttaccgtacgtttacccctccggttccttaccgtttacggtaccgacgggtaacgtaagttacgtaggaacttaccgaaacgtaacgtacgttaggacgttacgtaccacctaactccgtgtttaccg

SEQ ID NO: 208616 - DNA, 535 bp, Homo sapiens
  misc_feature: GYAE6OF02HC2PS.17.25.C03.1.454.CMB.1.raw
  modified_base (278)..(278): a, c, t, g, unknown or other
  misc_feature (278)..(278): n is a, c, g, or t
  modified_base (328)..(328): a, c, t, g, unknown or other
  misc_feature (328)..(328): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaaggcttctggattcacgtttacctctatagtatcaactgggtncgtcaggtccgctggacactacctgagtggatgggatgggacaaccgtanacgtggtgtcacagtgtcttcacccatcctcggacagacttacactagaccacgaactcccgtacaagtaaaccacacgcctaacatagggagttggaggagcctagacatcaggaccacacggcctactagttctgtgacgagacgtacccagcgtaccggtgacgaccgtacggcacggccgtacttttcggaccttgtacgggg

SEQ ID NO: 208617 - DNA, 604 bp, Homo sapiens
  misc_feature: GYAE6OF02GQBXM.17.25.C03.1.454.CMB.1.raw
  modified_base (283)..(283): a, c, t, g, unknown or other
  misc_feature (283)..(283): n is a, c, g, or t
  modified_base (294)..(294): a, c, t, g, unknown or other
  misc_feature (294)..(294): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcgtggattcacgtttacctccttaatagtatcaactgggtncgccaggccgntggacaacgcctgagtggagtgggatggggaccaaaccctaacacgttgggtctcacgtaggttcgtccttacacccctattcccgtaccggggacaacggtacctttaccgatacgaacccaacgtaacctccctacctaactaaaaccacacgacctaacagtaggagttagaggtacgcctagacactcgtagaccgacgaccggtccgttactagttctgtacgcgagtacgtcccgacggacgtccggtggaccgtccgtaaccggcgacggtccggttaccctttggaccgttcggtaccgggg

SEQ ID NO: 208618 - DNA, 534 bp, Homo sapiens
  misc_feature: GYAE6OF02JP4KU.17.25.C03.1.454.CMB.1.raw
  modified_base (226)..(226): a, c, t, g, unknown or other
  misc_feature (226)..(226): n is a, c, g, or t
  modified_base (266)..(266): a, c, t, g, unknown or other
  misc_feature (266)..(266): n is a, c, g, or t
  modified_base (277)..(277): a, c, t, g, unknown or other
  misc_feature (277)..(277): n is a, c, g, or t
  modified_base (427)..(427): a, c, t, g, unknown or other
  misc_feature (427)..(427): n is a, c, g, or t
  modified_base (433)..(433): a, c, t, g, unknown or other
  misc_feature (433)..(433): n is a, c, g, or t
  modified_base (501)..(501): a, c, t, g, unknown or other
  misc_feature (501)..(501): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttgtgcagcagctacaagtgcccactcccaggtgcagctggtgcagtctggggctgaggtgagaagcctgggggcctcagtgaggtntcctgcaaggcttctggattcacgtttacctcctatagtntcaactgggtncgccagccgcttggacaacgacctgagtggatggggatggggcgaaccccttaacactgggtgtcacagtgtctttcacccatccctcggggacagactttaccatgacccacgaacttcctccataaaccacagcccttacatggattnaacggncccttgacatcgtgacgcacgggccgttcttatactgtgcgagtagtccccacggtaatcccgggtancgcctacggcagtccgtctttgacttcgtcggg

SEQ ID NO: 208619 - DNA, 622 bp, Homo sapiens
  misc_feature: GYAE6OF02HT52W.17.25.C03.1.454.CMB.1.raw
  modified_base (283)..(283): a, c, t, g, unknown or other
  misc_feature (283)..(283): n is a, c, g, or t
  modified_base (309)..(309): a, c, t, g, unknown or other
  misc_feature (309)..(309): n is a, c, g, or t
  modified_base (504)..(504): a, c, t, g, unknown or other
  misc_feature (504)..(504): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatccctccctgtctgcctctggtgggggtcagagtcaccatcacttcgccggaacaagtcacggtacgttaaaactatttaaatggtaatcagcaagaaacctaggaaaacnccccaagccctctagactctctggtncactccactcgtgacgtaagtcggccgtaccagtccgtaggttacaggttcggactaggtcggactcggtagggactagttatttacaactcctacaacctactaccacctactctacgactaaccgtaggagtacttgacgactaatcctaactacgtacaactaacgtaagtaacgtttacaccgtttccccngtacctttaggttccggaaccggtaagggtaacctaaggtttcggaacgtaactaaccgaaaaccgtagttaccggtaggtacgttacgaaccctaaccgtactttccgtagttaccc

SEQ ID NO: 208620 - DNA, 550 bp, Homo sapiens
  misc_feature: GYAE6OF02I7WXK.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaacgtgggtgcgccaggccgctggacaacgacctggagtggatggggatgggacgaaccctaacacgtggtgtcacagtgtccttcacccatcccgtccgggacacgacttaccatcgaccacgaactcctaccaataaacacacgcctacatggtagttagaggacgcctgacatcgtacgacgacacggccgtacttacttactgtgacgagtcgtcccacgcgtccggtgacgtccgtacggcacggtccggtcctttcggaccgttcgtccgggg

SEQ ID NO: 208621 - DNA, 586 bp, Homo sapiens
  misc_feature: GYAE6OF02HI2TE.17.25.C03.1.454.CMB.1.raw
  modified_base (529)..(529): a, c, t, g, unknown or other
  misc_feature (529)..(529): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgtagtctggggctgaggtgaagaagcctgggcctcagtgaaggtctcctgcaaggcttctggattcacgtttacctcctatagtatcaactgggtgcgccaggccgctggacaacgcctgagtggatgggatgggcgaaccctacacgtggtcgtcacagtgtctcaccatccctcggacagaccttaccatacgaccacgaacctccctaccaataaaccacacgacctaacgattcgggaagttggaacggtacgccctagacattccgtacgaccgtacgacccgggtccttactaatttacccgtggtcgaccgtagaccgtccccaggtaccgtccggganacgtcccgtaaggcccaggtcccggtaccgtttagacccgtttcgacggggtacccg

SEQ ID NO: 208622 - DNA, 759 bp, Homo sapiens
  misc_feature: GYAE6OF02JSVAT.17.25.C03.1.454.CMB.1.raw
  modified_base (249)..(249): a, c, t, g, unknown or other
  misc_feature (249)..(249): n is a, c, g, or t
  modified_base (266)..(266): a, c, t, g, unknown or other
  misc_feature (266)..(266): n is a, c, g, or t
  modified_base (286)..(286): a, c, t, g, unknown or other
  misc_feature (286)..(286): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgagggtgaagaagcctggggcctcgagtgaaggtctccgtgccaagggcttcnggtattcacgtttaccncctatagtatcaactgggtncgcaggccgcgtggacaacgacctggagtggatgggatgggaccgaaacctagaccgtgggtgacagacgtgtacttccaacccgtaacttccgtaccggggtaacctacggtaaccttaccctaagttaccgaaccctaaccggtaaacccttcccgttaaccaacttaaaaacccgactaccggtaaccctaagtaaccgtagggaacgtttacgggaacggtaagtcccgtagtaaacccgtaacgttcctaagggaacccggtaaccgacgggttaaccccggttacctttaaagtttaacccggtggtacccggtaacgggtaaccggaccgtttaaccccgaacgggtaaccggtttcccggggtataaacccggggaccccggtttaaaccgggccgtaaccgggggttccccggttttaccccgttttacggggtaaacccctttttccggggaaaccggggggg

SEQ ID NO: 208623 - DNA, 582 bp, Homo sapiens
  misc_feature: GYAE6OF02F5487.17.25.C03.1.454.CMB.1.raw
  modified_base (506)..(506): a, c, t, g, unknown or other
  misc_feature (506)..(506): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaaggtctcctgcaaggcttctggattcacgtttacctcctatagtatcaacgtgggtgcgccagggcccgcgtggaacaaccgacctggagtgggagtggggagtcggggaccgaaccctaacgacgttgggtcgtacaacgtaggtgtccttaccacccctattcccgtaccgggacacgtaccttaccatacgaccacgaacctccctacaactaaacacacgcctacagtggagttggagacgccagacagtcagacgacgacgccgtactattctgngacgagtacgccacgtcgtccggtacgacgcccgtaggcacggccggttccgtttcggtaccgttcggtaccgggg

SEQ ID NO: 208624 - DNA, 688 bp, Homo sapiens
  misc_feature: GYAE6OF02HY4S0.17.25.C03.1.454.CMB.1.raw
  modified_base (292)..(292): a, c, t, g, unknown or other
  misc_feature (292)..(292): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtaccccactcccaggtgcagtctggtgcgagtcgtgggctaggaggtagaagacgccgtgggcctgagtgagtctcgtgcgagtcttgagtacttctacgtttacctctaatagtactacgaaggttgggacnccgaccgacggccgtcgtacgaaccgtaacggtacgtgggaggtaggaggtagggacgtaccggggaaacctaaccttagcggttggttacacgaaacgtcgttccgttccctaccgaacccgtcgtacccggtaaccggactaacgttacctacaccgtaccgaaaccctacctaacctacccgtaaccaaacgtaaacaccgtactacctacgagtaggtagtacgacggtacacgtacgtacgtacgtactacggaaccgtacgtaccggtacgttacgtacgttagtacgtagacgtacgaccgtaccgtcgtaccggtcggtaaccgtcggtaccgtaccggtcgtaccggttcggttaccgttacggtacggttccgggacggtaccggg

SEQ ID NO: 208625 - DNA, 655 bp, Homo sapiens
  misc_feature: GYAE6OF02IVLZ9.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacgttaaaacctatttaaattggtatcagcaagaaacctaggaaaacgccccagaccctctagacttctctggtgcactccactctgcgaaggtcggcctccagtcggaggttcaggtggcaggtggatcgtagggactagtatttcaatctaccacctataccacctactcgtcgacctaaccgtggaacgttgttcggtaacgacctaaactttcccgttaaacttaaccgttacgtaaccaaacgtaagggttaaacctttaaccctacccgtttacccccgtagttacccgttttaaccgggttttaccggaacccgggttaacgggggtaaaccctaaggtttacgaacggttaactaaccgaaaacggtacggttacggtcgttaccacgtaccctaaccgtacgttcctagtttaccc

SEQ ID NO: 208626 - DNA, 607 bp, Homo sapiens
  misc_feature: GYAE6OF02H0VJ9.17.25.C03.1.454.CMB.1.raw
  modified_base (282)..(282): a, c, t, g, unknown or other
  misc_feature (282)..(282): n is a, c, g, or t
  modified_base (293)..(293): a, c, t, g, unknown or other
  misc_feature (293)..(293): n is a, c, g, or t
  modified_base (317)..(317): a, c, t, g, unknown or other
  misc_feature (317)..(317): n is a, c, g, or t
  modified_base (422)..(422): a, c, t, g, unknown or other
  misc_feature (422)..(422): n is a, c, g, or t
  modified_base (442)..(442): a, c, t, g, unknown or other
  misc_feature (442)..(442): n is a, c, g, or t
  modified_base (449)..(449): a, c, t, g, unknown or other
  misc_feature (449)..(449): n is a, c, g, or t
  modified_base (451)..(451): a, c, t, g, unknown or other
  misc_feature (451)..(451): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagcctggggcctcagtgaaggtcctcctgcaaggcttctggattcacgtttacctcctatagtatcaacgtgggtncgccagggccnctcggacaacgctgagtgatgggntgggaccaacctatacgtggtcgtcacgtgtcgtcttccaaccctactccgtaccgggactacgaccttaccagtcgaacctacgactccctaacaataaaccanacgctacagtgagttgagcnctagacntnacgacgacgcggtcctactacgttacgtgtacgcggtaacgtaccgtaccccgtaagggtacgtccccggggttagaacccggtacccgtaccgggaccgaccgggttcccggttacccgtttttacggtacccggttttcgggaaccccgggggg

SEQ ID NO: 208627 - DNA, 759 bp, Homo sapiens
  misc_feature: GYAE6OF02J2NDY.17.25.C03.1.454.CMB.1.raw
  modified_base (232)..(232): a, c, t, g, unknown or other
  misc_feature (232)..(232): n is a, c, g, or t
tcagcgtagactagcacgaccggtgctcgatttagtagtgtagatttgggtttgggggtagtcagtctcagtcaggacacagcatggacatgagggtccccgctcagctcctgggctcctgctactctggctccgagctgccagatgtgacatccagatgacccagtctccatccctcctgtctcgcctctggtcgggggtcaggtacgtccaccatccacttgcccggaanaacgtcaccggtaacgttaaaacctatttaaattggtaactacgacgacgaacgtaaaccgtaaggaaaccgaccccgaacgtacccttaccgtacgacttaccgtcgttaggtcacctaacttccgtacttccgtaggaccgtaaggtccggtaccctaccgtacgtaccggttacggtccgacggtcggtaccgtagggtacgtacgttacggttacgggaactaacggttacttttaccgaaactccgtaacctaccgtaaccttacccaacccgttacctaccgtaccgaacctaaccggtacgtaacgggttacttcggaacttactaacttactacctacgtataaccgaacgtaacgttacgttaaccgttaccctcccgttacgttaccgttacggtttaccggaaccggtaacgggtaaacctaagggttccgaacgtaaaccggttaaccgaaacgtttaccggtacggtccgttaccgtacgaaccccgtcgtaacgttcccgtaccgttaacccg

SEQ ID NO: 208628 - DNA, 580 bp, Homo sapiens
  misc_feature: GYAE6OF02GQMO5.17.25.C03.1.454.CMB.1.raw
  modified_base (459)..(459): a, c, t, g, unknown or other
  misc_feature (459)..(459): n is a, c, g, or t
  modified_base (463)..(463): a, c, t, g, unknown or other
  misc_feature (463)..(463): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggagtgggatcggggacaaccctaacacgtggtcgtacacagtgtccttacaccctactcccgtaccgggactacgaccttaccatacgaccacgaacctcctaccaactaaacacagacctacagtaggtagttacgaggacgccagacntacngaccgacgaccggtccgtattacgttacgtgtcgcgagtacgacccacggtacggtccggtacgacgtcccgtacggaccgtacggacccggtcctttcggaccgtttggaccgggg

SEQ ID NO: 208629 - DNA, 627 bp, Homo sapiens
  misc_feature: GYAE6OF02HZ3JR.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattctacgtttacctcctatagtatcaactgggtgcgccaggccgctggacaacgacctgagtggagtggggatcggggacgaaccctaacgacgtgggtgtaccacgtaggttgttcttaccacccctactcccggtcccggggaacaacggtaaccctttaacccgaagttaccgaacccctaacgaaacccttcccctacccaaacttaaaacccacctaacgaccctacaagtacggtaagttaggaacgggacgtcccgtagaccacgttctacggaaccgaccgaccggtccgtactactttactgtcgcgagcgtcccacgtcgtccggtgacgccgtacggcacggtccgtcctttgtaccgttcggtcgggg

SEQ ID NO: 208630 - DNA, 982 bp, Homo sapiens
  misc_feature: GYAE6OF02H8G6Q.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggcctcagtgaaggtctccgtgcaaggcttctggattcacgtttacctcctaatagtatcaacgtgggtgcgccgacggccgcgtcggtaaccaaaccggacccgttaggacggttgggagtacgggggagtcgggggaccgtaaaaccccgtaaacgaccgttgggtacgtccgaaccgtacggttcgttcctttaccgtaccccaagttccccgttacccgggggaaccaacggtaaccctttaaccccgaagttaccggaaaccccgtaaccggtaaacccgttacccctaacccctaaacgttaaaaacccaaacctaaccggtaccccttaaaaccgtaacggttacggggtaaacggttttacgggaaacggggtaaacggtaccccgtttaagggtaaacccgtaaagtttacccggttaacggggtaaaccccggaaaccccgggttaaaccccgggggtacccccgggtttttaaacccttttaaaaccgtttttaaacccggtttaccgggtttaaacggggtaacccgggttaaacgggtaaaccccgggttaccccccggtaaacccggttaaaccggggtttacccccgggggtttaacgggtaaaccccggggtttaaccccccggggttaaaaccccgggggtacccgggttaaaacccgggggtttacccccggggggttttaaaccccccggtttttttccggggtttaaacccccggttttttcccggggttaaaccccccggggggggggg

SEQ ID NO: 208631 - DNA, 738 bp, Homo sapiens
  misc_feature: GYAE6OF02J1G00.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagccgtgggcctcagtgaggtctctgcaggcttgtgtattcacgttacctctatagtatcaacgtgggtgcgccgacggccgcgtaggaccaaccgtacctgtacgttggacgtggggacgtacggggaccgaaaccctaacgacgtgggtacgtacgtacgtaggttcgttaccttacccgaaccccgtacgttcccggtacccggggtaactaacggttaacccttacccgacgttaccgaaaccccgtaaccggtaacccttacccgtaacccgtaaaacttaaaacccgaaccgaaccgtacccttaacgtaacggttacgggtaaggtttacgggaaacgggtacgtaccccgttaagtaaccgtacgttccgtacggaaccgtaccggtacccggtaccgttacttacgttacggtgtacgacgaacgtaccgtacccgacgtaccggttaccgggtacgtacggtacccgtacgggaccgtacggtccggtttcccgtttacggtaccgttccgggtaccggggg

SEQ ID NO: 208632 - DNA, 547 bp, Homo sapiens
  misc_feature: GYAE6OF02G7U11.17.25.C03.1.454.CMB.1.raw
  modified_base (280)..(280): a, c, t, g, unknown or other
  misc_feature (280)..(280): n is a, c, g, or t
  modified_base (414)..(414): a, c, t, g, unknown or other
  misc_feature (414)..(414): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatggggacgaaccctaagactggtgtcacgagtgtcttcacccatccgtccgggacagacttaccatcgaccacgactcctaccataaacacagcctanatggagttgaggacgcctagacatcgtagacgaccgacgccgttactattaccgtgtcgcgagacgtcccacggactaccggtgacgaccgtacggcacgggccggtacctttcggtaccttcggtacggggg

SEQ ID NO: 208633 - DNA, 574 bp, Homo sapiens
  misc_feature: GYAE6OF02IV0CE.17.25.C03.1.454.CMB.1.raw
  modified_base (434)..(434): a, c, t, g, unknown or other
  misc_feature (434)..(434): n is a, c, g, or t
  modified_base (446)..(446): a, c, t, g, unknown or other
  misc_feature (446)..(446): n is a, c, g, or t
  modified_base (468)..(468): a, c, t, g, unknown or other
  misc_feature (468)..(468): n is a, c, g, or t
  modified_base (498)..(498): a, c, t, g, unknown or other
  misc_feature (498)..(498): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatggggcgaaaccctaacgacgtggtcgtacacgaagtcgtccttaccaccctaacgtccgtaccggggacacgtaacttacccagtcgaccgacgtaacctcctaccaataaaccncaacgtcctaanacgtggacgttggacgacgccngacatctgacacgacgtcgtactattacgngtgcgagacgtcccacgaacgtcggtacgacgtccgtacggacgacggccgttccttaggtaccttggtaccgggg

SEQ ID NO: 208634 - DNA, 535 bp, Homo sapiens
  misc_feature: GYAE6OF02FXW7S.17.25.C03.1.454.CMB.1.raw
  modified_base (439)..(439): a, c, t, g, unknown or other
  misc_feature (439)..(439): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatggggcgaaccctaacactggtgtcacagtgtcttcacccatcctccgggacagacttaccatcgaccacgaactcctaccaataaacacagcctacatggagttgaggagcctgacatcgngacgacacggcctcttatactgtgcgagacgtcccagtacgtccggtagacgtccgtacggcgacggtccggtcctttcggtaccttcgtacgggg

SEQ ID NO: 208635 - DNA, 644 bp, Homo sapiens
  misc_feature: GYAE6OF02IC5OU.17.25.C03.1.454.CMB.1.raw
  modified_base (286)..(286): a, c, t, g, unknown or other
  misc_feature (286)..(286): n is a, c, g, or t
  modified_base (338)..(338): a, c, t, g, unknown or other
  misc_feature (338)..(338): n is a, c, g, or t
  modified_base (380)..(380): a, c, t, g, unknown or other
  misc_feature (380)..(380): n is a, c, g, or t
  modified_base (421)..(421): a, c, t, g, unknown or other
  misc_feature (421)..(421): n is a, c, g, or t
  modified_base (452)..(452): a, c, t, g, unknown or other
  misc_feature (452)..(452): n is a, c, g, or t
  modified_base (464)..(464): a, c, t, g, unknown or other
  misc_feature (464)..(464): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctgagtgaaggtctcctgcaaggtcttcgtggattctaccgtttacctcctatagtatcaacgtgggtncgcacggccgctggaccacgactgagtgagtgggatgggaccgaacctaacncgtggtgtcacgtagtcgtctcaccctatcccgtccgggaanacgtaaccttccagtcaccgacgtactcctaccaataaacncacgacctacagtcggagtttacggaggtancccgtagaaccncttcgtaacggaccgtaccgtaccgggtacccgttaccttaacgttaccggtgttaaccggcgtaacgacccgggttaccccacgggttaacgttcccgggtagtaacccggtcccgtaaaccgggccgtaacgggtcccgggttcccttttacgggtaccgttcccgggtaaccggggg

SEQ ID NO: 208636 - DNA, 713 bp, Homo sapiens
  misc_feature: GYAE6OF02GYYYY.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctggggcctcagtgaggtctcctgcaaggcttctggattcacgtttacctcctatagtatcaactgggtgcgccaggccgctggacaacgacctgaggtggagtgggagtggggaccgaacccctaacgacgttgggtgtacacgagtcgtcctttaccacccctacgtcccgttaccggggacctacgtacctttacccatacggaaccctaacgtaacccttccctaccaaactaaaacccaacgaccgtacccttaacgaacttacggggtaacggtttacggaacgggtaaccgtcccgttaacggaacctaacttccgtaacggacccggaaccggtaacccgggtcccgttaccgttaagtttaccgtaggttacggaccggaacggtaccgttaccccggaacggtaccgttacccggggttacgaacccggtacccgttacggggcccgtacgggtcccgggttacccgttttggacccgttttcgggtaccgggggg

SEQ ID NO: 208637 - DNA, 667 bp, Homo sapiens
  misc_feature: GYAE6OF02IFPJ0.17.25.C03.1.454.CMB.1.raw
  modified_base (294)..(294): a, c, t, g, unknown or other
  misc_feature (294)..(294): n is a, c, g, or t
  modified_base (315)..(315): a, c, t, g, unknown or other
  misc_feature (315)..(315): n is a, c, g, or t
  modified_base (343)..(343): a, c, t, g, unknown or other
  misc_feature (343)..(343): n is a, c, g, or t
  modified_base (438)..(438): a, c, t, g, unknown or other
  misc_feature (438)..(438): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcgtggattcacgttttacctcctatagtatcaacgtgggtgcgccaggccgntggacaacggacctgagtggntgggagtcggggacgaaacccctaaacncgtggtcgtacactaggtgtctttccaccctactccgtaccgggacacggtaccttaccagtcgaccctaacgaacctccctaccaataaaaccntaaccgccttaacacgtagggtacttggacggtacgtccctagacaacgttctacggaaccggtaccgaaaccgggtcccgttacgttaacgtttaaccgtacggttaaccgacgtaaccggtcccccaacgggttaccggtcccggggtaccgacgggtaacccttacgggcgtaccggtccggttacccgttttaggtacccgttttccgggacgggggtacccggg

SEQ ID NO: 208638 - DNA, 629 bp, Homo sapiens
  misc_feature: GYAE6OF02HLQLL.17.25.C03.1.454.CMB.1.raw
  modified_base (279)..(279): a, c, t, g, unknown or other
  misc_feature (279)..(279): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctggtggggtcagagtcaccatcacttcgaccggacaagtcacggtacgttaaaacctatttaaattggtatcagcagaaacctaggaaaacnccccagtaccctctagtactctcgtggtgacactccactcgtgacgtaaggtcggccgtcccagtcggtagttcaggtgactaggtgatcggtagggaacagttattacaacttcctacacctactccacctactctacgacctaacgtagtaggtacttgtacgtactaacttcgtaactactacgtacctaagtaacgttacgttaaccgtaccgttcccctacgttacccgttaacgtttaccgggaccggtaacgggtaacctaggttacgacggtaactaaccggaaacggttaaccgttggtacggtcgttacgaccttaaccgtacgttacgttacttacccg

SEQ ID NO: 208639 - DNA, 818 bp, Homo sapiens
  misc_feature: GYAE6OF02HPSNR.17.25.C03.1.454.CMB.1.raw
  modified_base (245)..(245): a, c, t, g, unknown or other
  misc_feature (245)..(245): n is a, c, g, or t
  modified_base (294)..(294): a, c, t, g, unknown or other
  misc_feature (294)..(294): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtgggcctcagtgaaggtctccgtgcaaggcttcgnggattcacgtttacctctatagtatcaacgtgggtcgcgccagggccgngtacggaacaacgtacctggagtggaagtggggactacggggaccgtaaacccctaagtacgttcgggtacgtaccaacgtaggttcgttacccttaccaaccccgacgttcccggtaccggggaactaacgtaacctttaacccgaagtttaccgaaccccgtaacgtaacccgttacccctaaccgtaaataaaaacccgaccgaaccggtacccttaaccgaaggttaccggggtaagttacgggaacgggtaaccgtcccgtttaacgaaccgttacgttccgtaaccggaaaccgggtaaccccggtaaccggggttacccctttaaccgtttaaacgtttaacccgggtttaggtaacccgggtacgggtttaaacggaccccgtttacccccggaacgggttaacggttaccccggggttagaacccggttacccggttaacccgggacggttaccggccccggggtttaacccgttttttacggaacccgggttttcccgggttaacccggggggg

SEQ ID NO: 208640 - DNA, 608 bp, Homo sapiens
  misc_feature: GYAE6OF02IHORS.17.25.C03.1.454.CMB.1.raw
  modified_base (352)..(352): a, c, t, g, unknown or other
  misc_feature (352)..(352): n is a, c, g, or t
tcagcgtagactagcacgaccggtgctcgatttagtagtgtagatttgggtttgggggactcaacgaaccacatcttgtcctctagagaaaaacccgtaggtgagccacagcttcctcacccactcggactggacctggaggatctcttcgttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccgaggccgctggacaacgacctggagtggatgggatgggcaaccctaacacgtggtntcacagtgtcttccacccatcccgtcgggactagtacttaccatcgaccaacgtaacctcctaccgaaataaaccacgtacgtaccctaacagttgggaagtttggaacgggtacgcctaggaaccagttcctacggaaccgacgaccgggtccttactactttaccgtgtcgcgtaagacgttccgaacggtctccgggtagccggtaccctaacggcgtacggtcccggttcgtttcgaccgttggtaccgggg

SEQ ID NO: 208641 - DNA, 787 bp, Homo sapiens
  misc_feature: GYAE6OF02GKZPE.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagccgtggggcctcgagtgaaggtctcctgcaaggcttcgtggattctacgtttacctcctatagtactcaactgggtgcgccgaggcccgcgtggaccaacgaccgtggaggtggagtgggagtcggggaccgaacccgtaacacgtggtacgttcgacgtacgtcgttccttaccacccctacgtacccgtaccggggaaccacgtaaccttaacccgacgtacgaacccgtaaccgtaacctccctaaccgaaactaaacccaacaacggtacccttaaacgacgttacgggtaacgtttacgggaacgggtaccgtcccggtacgaacccgttaactttacccggtaacggaacccgggtaaacccgtaccccggggtaccccgtttaccgttttaaacctttacccggttacggttaccggtaaccgggtaccgtacccggttaccccccgaacggtaccggttaaccccggggttcgaaccccgggttacccggtaaccgggccgttaaccggggtaccccgggtttaccccgtttttacgggtaacccccggttttgggtaacccccggggggg

SEQ ID NO: 208642 - DNA, 660 bp, Homo sapiens
  misc_feature: GYAE6OF02I1UVW.17.25.C03.1.454.CMB.1.raw
  modified_base (276)..(276): a, c, t, g, unknown or other
  misc_feature (276)..(276): n is a, c, g, or t
  modified_base (301)..(301): a, c, t, g, unknown or other
  misc_feature (301)..(301): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctcctgtctgcctctggtgggggtcagagtcaccatcacttgccggacaagtcacggtacttaaaacctatttaaattggtatcagcagaaacctaggaaaacnccccagacctctgactctctggtcncactccactcgtgcgaacgtcggcctccagtcgaggttcaggtgacaggtgatcgagggactagtactttacaattctacaacctactacccaacctacttcgtacgaccctaaccgttggaacggtagtttacggtacgtaacctaaactttccgttaaccttaaccgttacgtaaccgtaaacgtaacggttaaccgtttaaccgtaacccgtttccccgtacggttaccctttaaccggtttaccgggaacccggtaacggggtaacctaaggttacggaacgtaacgtaaccgaaaacggtacgttagggtacggtacgtacgaccctaaccgtacgtttaccgttacgttaccg

SEQ ID NO: 208643 - DNA, 831 bp, Homo sapiens
  misc_feature: GYAE6OF02JKCOU.17.25.C03.1.454.CMB.1.raw
  modified_base (243)..(243): a, c, t, g, unknown or other
  misc_feature (243)..(243): n is a, c, g, or t
  modified_base (261)..(261): a, c, t, g, unknown or other
  misc_feature (261)..(261): n is a, c, g, or t
  modified_base (281)..(281): a, c, t, g, unknown or other
  misc_feature (281)..(281): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcctgggcctcagtgaaggtctcctgcaggcttcnggtattctacgtttaccncctatagtatcaactgggtncgcctaggccgtcgtaggaccaacgacctggagttggagtgggagtcggggtaccaaacccgtaacgacgttagggtcgtaccagtaagttcggttccttacccgaaccctacgtcccgtaccggggaactacggtaccttaaccgataccgaacccaacgtaaccttcccgtaaccaaacttaaaacccgaccgtaacggtaccctaaacgtaacgttacgggtaacgggttttacggaaacgggaacgttccccgttaggtaaaccctaacggtttccgtaaaccgggtaacccgtaaacccggtacccgggtacccggtttaacttttaaaccgggttttaacccggttagggttaccggttaacccggggtaaccgtaacccgggtttaccccccgaaagggtaaacccgggttttccccgggtaaggtaaccccggtaaaccccggggtttaacccgggacccggttaaaccggggtcccccgggttttaaaccccgtttttcggggtaaaccccgggttttttccggggaaccccggggggggg

SEQ ID NO: 208644 - DNA, 558 bp, Homo sapiens
  misc_feature: GYAE6OF02G3V3M.17.25.C03.1.454.CMB.1.raw
  modified_base (280)..(280): a, c, t, g, unknown or other
  misc_feature (280)..(280): n is a, c, g, or t
  modified_base (340)..(340): a, c, t, g, unknown or other
  misc_feature (340)..(340): n is a, c, g, or t
  modified_base (442)..(442): a, c, t, g, unknown or other
  misc_feature (442)..(442): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgcaggccgctggacaacgacctgagtggatgggatggggcaacctacactggtgtcacngtgtccttcaccccatcctccgggacagacttaccatcgaccacgaacctcctaccaataaaccacaacgcctacatggagttgagggacgcctgacatcgngaccgacacggcctcttattacgtgtcgcgagtacgtcccgagtacgtcccgggtagacggtcccgtacgggcgtacggcccggtaccgttttacggaccgtttcggtaccggggg

SEQ ID NO: 208645 - DNA, 593 bp, Homo sapiens
  misc_feature: GYAE6OF02HY48G.17.25.C03.1.454.CMB.1.raw
  modified_base (332)..(332): a, c, t, g, unknown or other
  misc_feature (332)..(332): n is a, c, g, or t
  modified_base (338)..(338): a, c, t, g, unknown or other
  misc_feature (338)..(338): n is a, c, g, or t
  modified_base (434)..(434): a, c, t, g, unknown or other
  misc_feature (434)..(434): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcaaaccctaacnctggtntcacagtgtcttcacccatcctcgggacagaccttaccatcgaaccacgaactcctaccaataaacacacgacctacagtaggagttaggaggacncctagactagtctacgaacgacgaccggtccgttactaactttacgtggtcgacgaaggtaccgtacccaacggtacgttacccgggtgaaccggtcccgttaacgggccgtaacggtcccgggttacccttttacggtaccgtttcggtacccggggg

SEQ ID NO: 208646 - DNA, 543 bp, Homo sapiens
  misc_feature: GYAE6OF02GMNUW.17.25.C03.1.454.CMB.1.raw
  modified_base (338)..(338): a, c, t, g, unknown or other
  misc_feature (338)..(338): n is a, c, g, or t
  modified_base (435)..(435): a, c, t, g, unknown or other
  misc_feature (435)..(435): n is a, c, g, or t
  modified_base (461)..(461): a, c, t, g, unknown or other
  misc_feature (461)..(461): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacacgacctgagtggatgggatggggcaaaccctaacactggtntcacagtcgtcttcacccatcctcgggacagacttaccgatcgaccacgaactcctcaataaacacacgcctacatggagttggaggacgcctgacntctagacgacgacgcgtcttattacngtagcgtagactcccgagacgtccggtacgacgtcccgacggtcgacggtcccggtccttttacggacctttcggtccgggg

SEQ ID NO: 208647 - DNA, 651 bp, Homo sapiens
  misc_feature: GYAE6OF02I5GN2.17.25.C03.1.454.CMB.1.raw
  modified_base (219)..(219): a, c, t, g, unknown or other
  misc_feature (219)..(219): n is a, c, g, or t
  modified_base (342)..(342): a, c, t, g, unknown or other
  misc_feature (342)..(342): n is a, c, g, or t
  modified_base (364)..(364): a, c, t, g, unknown or other
  misc_feature (364)..(364): n is a, c, g, or t
  modified_base (375)..(375): a, c, t, g, unknown or other
  misc_feature (375)..(375): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctnagtgaagtctcctgcaaggctctggatcacgttacctctatagtatcaacgtgggtgcgccgaggccgcgtggacaacgacctgagtggagtgggagtgggaccgaaccctaagtacgtggtntcacgagttcgtccttcacccntccgtccgganacgtaccttacatcgaccaaccgtaacctccaaccgtaaactaaaccgacctacgaccctaactagtaggtacggttaggaacggacgtaccgtacgacctaagtccgtaggaacccgacgtaccggccgtttaccttaacgtttaaccgtggttacggacgtaacgtacccgttacccgaacggttaccgtacccgggtacggtaccggtacccgtaacgggaccctacggggtcccggttaccttttcggtacccggtttccgggacccggggg

SEQ ID NO: 208648 - DNA, 539 bp, Homo sapiens
  misc_feature: GYAE6OF02FI3AD.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatggggcgaaccctaacactggtgtcacagtgtcttcacccatcctccgggacagaccttaccatcgaccacgaactccctaccaataaaccacacgcctaacatggagttgaggagcctgacatctgacgacgacggcctactattactggtcgcgagacgtcccgacgactccggtagacgtccctacggcacggtccggtcctttggaccttcgtcgggg

SEQ ID NO: 208649 - DNA, 602 bp, Homo sapiens
  misc_feature: GYAE6OF02GIZ0F.17.25.C03.1.454.CMB.1.raw
  modified_base (332)..(332): a, c, t, g, unknown or other
  misc_feature (332)..(332): n is a, c, g, or t
  modified_base (350)..(350): a, c, t, g, unknown or other
  misc_feature (350)..(350): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaacgtgggtgcgtcaggccgctggacaacgacctgagtggatggggatggggcaaccctaanacgtggtcgtcacaggtntcttcaccctatcccgtccgggacacgtaccttaccatcgaccacgaacctcctaccaaataaaccacacgaccctaacaacgtggagttagaggacgcctagacacttctgaaccgaccgtaccgggcccgttacttaactttacgtggtacggaccgaaggtaccgtaccctaacggtacggttcccggtagaccggtaccgtacggcgacggtcccggttaccgtttacggtacgttcggtaccggggg

SEQ ID NO: 208650 - DNA, 784 bp, Homo sapiens
  misc_feature: GYAE6OF02JO9M2.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaacgtgggtgcgccaggccgctgggaccaacggacctggagtggaacttggggaagtcggggaccgaaaccctaacgacgttgggtcgtaccaaccgtaggtttcggtcctttaccgaccccgtaactccccggttaccgggggaactaacgggtaccctttaacccgagttacccggaacccgaaaccggtaaaccctttccccgtaacctaaaacttaaaacccgaaccgtaacgtaccctaaactaacgttacgggtaagtttacgggaacggtacggtccctaacggtacctaacgtttcgacgggtaaacccggaccgtaacccggggttcccgtttactttaaacgttaacgttcggtacgtacccgggaacgttaacccgggttcccctaaacgggtccggtttacccggtacgggtaaccggtaccccggttaaccggggaccgttaccgggtcccggggttacccgtttttccgggtaaccgttttccggggtaacccgggggg

SEQ ID NO: 208651 - DNA, 727 bp, Homo sapiens
  misc_feature: GYAE6OF02ITIEP.17.25.C03.1.454.CMB.1.raw
  modified_base (271)..(271): a, c, t, g, unknown or other
  misc_feature (271)..(271): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgcaaggcttctggattcacgtttacctcctatagtancaactgggtgcgccaggccgctggacaacgacctgagtggagtgggatggggaccaaacccgtaacacgttggtcgtccaacgtagttcggtaccttaccaacccctacttccccgtcccgggggaactaacggtaaccctttaacccgaattaccggaaccctaaccgtaaaccttcccctaaccaaactaaaaacccactaaacgtaccctaacgtaacgtagggtaacggttaggaacgggtacgcccttaaggaacctagttcgtacggtaaccggaccgtaaccgggtcccgttacgttaacgttttaccgtcggttacgaccggtaacggtaccggttaccccgaacgggtaaccgttcccggggtaacggtaacccggtacccggttaaccgggcgtaacggggtcccggttacccgttttacggtaccgtttccgggtacccgggggg

SEQ ID NO: 208652 - DNA, 550 bp, Homo sapiens
  misc_feature: GYAE6OF02IQ7NI.17.25.C03.1.454.CMB.1.raw
  modified_base (416)..(416): a, c, t, g, unknown or other
  misc_feature (416)..(416): n is a, c, g, or t
  modified_base (425)..(425): a, c, t, g, unknown or other
  misc_feature (425)..(425): n is a, c, g, or t
  modified_base (444)..(444): a, c, t, g, unknown or other
  misc_feature (444)..(444): n is a, c, g, or t
  modified_base (448)..(448): a, c, t, g, unknown or other
  misc_feature (448)..(448): n is a, c, g, or t
  modified_base (458)..(458): a, c, t, g, unknown or other
  misc_feature (458)..(458): n is a, c, g, or t
  modified_base (513)..(513): a, c, t, g, unknown or other
  misc_feature (513)..(513): n is a, c, g, or t
  modified_base (540)..(540): a, c, t, g, unknown or other
  misc_feature (540)..(540): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcggccgggccgctggaccaacgacctggagtggagtgggatgggaccgaaccctaacgactgggtgtcacgagtcgtcttccacccagtcctccgggacacgaccttacatcgaccacgaactcctacaataaacncacgcctanatggattaggagacgcctnactntctgacgacncggcctctattactgtagcgagacgtccacgtcgtccggtgacgtccgtacggcncggtccggtcctttaggaccgttcggngggtacccgg

SEQ ID NO: 208653 - DNA, 566 bp, Homo sapiens
  misc_feature: GYAE6OF02JHWM8.17.25.C03.1.454.CMB.1.raw
  modified_base (282)..(282): a, c, t, g, unknown or other
  misc_feature (282)..(282): n is a, c, g, or t
  modified_base (332)..(332): a, c, t, g, unknown or other
  misc_feature (332)..(332): n is a, c, g, or t
  modified_base (338)..(338): a, c, t, g, unknown or other
  misc_feature (338)..(338): n is a, c, g, or t
  modified_base (342)..(342): a, c, t, g, unknown or other
  misc_feature (342)..(342): n is a, c, g, or t
  modified_base (345)..(345): a, c, t, g, unknown or other
  misc_feature (345)..(345): n is a, c, g, or t
  modified_base (440)..(440): a, c, t, g, unknown or other
  misc_feature (440)..(440): n is a, c, g, or t
  modified_base (527)..(527): a, c, t, g, unknown or other
  misc_feature (527)..(527): n is a, c, g, or t
tcagcgtagactagcacgaccggtgctcgatttagtagtgtagatttgggtttggggacgtcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatctaactgggtncgccaggccgctggacaacgacctgagtggatgggatgggcaaccctaanctggtntcangtntctcacccatcctcgggacagacttaccatgaccagtaacctcctcaataaacacagcctacagtcggagttagaggacgtccctggacagttcnggaaccgacgaccggccttactattaacgtcgtagcgaagtacgtacccgacgtacgtcccgggtagacggttccctaacggaccgnggtacccgggccttttacggaccgtttcggtaccggggg

SEQ ID NO: 208654 - DNA, 585 bp, Homo sapiens
  misc_feature: GYAE6OF02HBZPL.17.25.C03.1.454.CMB.1.raw
  modified_base (240)..(240): a, c, t, g, unknown or other
  misc_feature (240)..(240): n is a, c, g, or t
  modified_base (277)..(277): a, c, t, g, unknown or other
  misc_feature (277)..(277): n is a, c, g, or t
  modified_base (375)..(375): a, c, t, g, unknown or other
  misc_feature (375)..(375): n is a, c, g, or t
  modified_base (414)..(414): a, c, t, g, unknown or other
  misc_feature (414)..(414): n is a, c, g, or t
  modified_base (432)..(432): a, c, t, g, unknown or other
  misc_feature (432)..(432): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggctcagtgaggtctcctgcaaggcttntggattcacgtttacctcctatagtatcaactgggtncgccaggccgctggacaacgacctgagtggagtgggatgggacgaaccctaacacgtggtgtcacagtcgtcttcacctatcctcgggacagactacntgaccacgtacctcctacaagtaaaccacacgaccctanatacgggagttgaggacnccgtagacctagtctacggaacgtacgaccgggccttacgttattacgtcgtacggacgaggaccgtccgaaccggtcgtcccggggtagcccggaccgtaaccggccgaacggtcccgggttccgttttcggacggtttcggtaccgggggg

SEQ ID NO: 208655 - DNA, 586 bp, Homo sapiens
  misc_feature: GYAE6OF02F0FTF.17.25.C03.1.454.CMB.1.raw
  modified_base (290)..(290): a, c, t, g, unknown or other
  misc_feature (290)..(290): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccnctggacaacgacctgagtggatggggatgggcgaacctaacactggtgtcacagtgtcttcaccatcctccgggacagacttaccatcgaccacgaactcctaccactaaacacacgtaccctacacgtggtacgttagaggacgcctagaacctattccgtacgacgaccgaaccgggtcccgttacttaacgttactgttacggccgaaggtaccgtaccccaggtacctccgggttacgacggcccgttaaccgggcacggtcccggtaccttttggaccttcggtacggggg

SEQ ID NO: 208656 - DNA, 534 bp, Homo sapiens
  misc_feature: GYAE6OF02FJ010.17.25.C03.1.454.CMB.1.raw
  modified_base (433)..(433): a, c, t, g, unknown or other
  misc_feature (433)..(433): n is a, c, g, or t
  modified_base (462)..(462): a, c, t, g, unknown or other
  misc_feature (462)..(462): n is a, c, g, or t
  modified_base (494)..(494): a, c, t, g, unknown or other
  misc_feature (494)..(494): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggacaaccctaacacgtggtgtcacagtgtcttcacccatcctcgagacacgtacttacatcgaccacgaacctcctaccaataaacaaacgcctaacatggagttgaggtacncctagactatctagacgacgacggccgtntattactgtgacgagacgtccagtactccggngaccgtcgtacggcacggccgtctttcgacgttcgacggg

SEQ ID NO: 208657 - DNA, 618 bp, Homo sapiens
  misc_feature: GYAE6OF02HTVY7.17.25.C03.1.454.CMB.1.raw
  modified_base (366)..(366): a, c, t, g, unknown or other
  misc_feature (366)..(366): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtactcaactgggtgcgccaggccgctggacaacggacctggagtggagtgggatggggccgaaccctaacactgggtgtcacagtcgtcttcaccctntcccgtccgggacagtaccttaccatcgaccacgaaccttccctaccaataaaccacaagtaccctaacagttcggaaggttggaacggtagcccgtagaactaacgtccgtaggaacccggacgaaccgggtcccgttacttaaacgtttcgtaggttcgacggagtaccgtcccgaacggtacgttcccgggtgaccggtcccgtacgggcacggtcccggttccttttacggtccgttcggtaccgggg

SEQ ID NO: 208658 - DNA, 544 bp, Homo sapiens
  misc_feature: GYAE6OF02HVOTB.17.25.C03.1.454.CMB.1.raw
  modified_base (280)..(280): a, c, t, g, unknown or other
  misc_feature (280)..(280): n is a, c, g, or t
  modified_base (429)..(429): a, c, t, g, unknown or other
  misc_feature (429)..(429): n is a, c, g, or t
  modified_base (467)..(467): a, c, t, g, unknown or other
  misc_feature (467)..(467): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatggggacgaaacccctaacacgtggtgtcacagtgtcttcacccatccgtccgggacagaccttaccatcgaccagaactccaccaataaacacagcctacatgattgaggancctgacatcgcgacgacgacggtccgtactaacttcgngtgcgagtacgtccccaggtactcccggtgacgccctacgggcaacgggccgtccgtttcgaccgttgtaccggggg

SEQ ID NO: 208659 - DNA, 770 bp, Homo sapiens
  misc_feature: GYAE6OF02IFW8X.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtgggcctcagtgaaggtctcctgcaaggcttcgtggtattcacgtttacctcctatagtatcaactgggtgcgccaggccgctggacaacgtacctagaggtaggagtgggaagttcggggaccgaaacccctaacgtacgttggtcgtacacgtacggttgtcgtttacccaacccgtactccgtccggggaacaacgtacccgttaaccaagttccgaacccgtacgtaaaccttaccccgtaacctaaactaaaacctacgaacgtaccctaacgtaagttacgggtaaggtttacggaagggtaaccgcccgttaggaaacccttaaacgttcccgtaacgggtaaacccggtaacccggaacccggggttaccccgtttaaccgtttaacgtttaacccggttcgggtaccggtaaccgggaacggttaaccggttacccccggtaaacggtcggtttaccccgggtaggtaacccggtaccccgttaacgggccgtaaccggggtcccggtttacccggttttacggacccggttttccgggtaacccggggg

SEQ ID NO: 208660 - DNA, 661 bp, Homo sapiens
  misc_feature: GYAE6OF02INXWQ.17.25.C03.1.454.CMB.1.raw
  modified_base (303)..(303): a, c, t, g, unknown or other
  misc_feature (303)..(303): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcgaggtgaaggtctccgtgcgaaggcttcgtggacttctacgtttacctcctatacgtatcaacgtgggtgcgccgaggcccncgtaggaacaacgacctgagtggagtgggatcgggaccaacctaacagtggtgtcacgtagtgtacttccgacccgtatcccgtccgggaactagaccttaccagtcgaccaacgtaacctccctacaaactaaaccacacgtacctaacgtacgtagggtacgttaggacgggtacacccttagactaacgttcgtaggaacccgtaccgaccgggttacccttacgttaacgtttaaccgtggtaaccggccgtaacggtaccgtacccgtaccggtaacggttcccggtaaggacccgtacccgtaccgggacgtacgggccggttcctttacggtaccgttccggtaccggggg

SEQ ID NO: 208661 - DNA, 661 bp, Homo sapiens
  misc_feature: GYAE6OF02FZ9I1.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaacgtgggtgcgccaggccgctggacaacgacctgagtggagtgggatgggaccgaaccctaacacgtggtcgtcactagtcgtctttccacccctatcccgtaccgggacacggaccttaccagtcgaccaccgaacctccctaccaactaaaccacacgaccctaacagtgggtaagttcggaacgggtacgtcccgtagacctacttccgtacggaccggaccgaacccggggtccgttacttaacgtttaaccgtggtacggaccggtacggtacgttacccccgtaacgggtaccgttaccccggggtagacccggtacccgttaaccgggacccgtacgggcccggttcccgttttacggtaccccggtttggtacccgggggg

SEQ ID NO: 208662 - DNA, 655 bp, Homo sapiens
  misc_feature: GYAE6OF02GZGJX.17.25.C03.1.454.CMB.1.raw
  modified_base (245)..(245): a, c, t, g, unknown or other
  misc_feature (245)..(245): n is a, c, g, or t
  modified_base (290)..(290): a, c, t, g, unknown or other
  misc_feature (290)..(290): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaaggtctcctgcaggcttcnggattctacgtttacctctatagtatcaactggtgcgccaggccncgtggacaacgacctgagtgagtgggagtgggaccaaccctaacgacgtggtcgtacacgtaggtcgtaccttaccaccctacgtcccgtaccgggacacgtacttaccgactaccgaacctaacgaacctcccgtaccaactaaaccacacgacctacacgtaggtaggttacggaacggtcgaccgttagactagtccgtacggaacccgaccggtaccggcccgttacgttaaccgtttaccgtacgttacggtaccgaacggtaccgtacccgtaccggtaacggttccggtacggtaccgtacccggtacggtaccgccggtaccggttcccggttttagaccggttccggtaccggggg

SEQ ID NO: 208663 - DNA, 643 bp, Homo sapiens
  misc_feature: GYAE6OF02I3TUX.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctccgtatagtatcaacgtgggtgccgccgaggtcccgcgtggaaccaaccggacctaggagtggagtggggatcggggaccgaaaccccgtaacgacgtggtgtccgacgtaggttgtccttaccgaccctatcccgtacgggactacgtaccttaaccagtcgaaccaacgtaaccttccctaccaaactaaaccacgtacgacccttaacagtggtaacggttagaacgggaactccgtagaactacgttcgtagaaccgacgacggtacccttattaacttccgtgtcgacgtagaccgtacccgaacggtccgtacggtggaaccgtcccgttacgggactacgggtccgttcctttacggtacctttcgggaaccgggg

SEQ ID NO: 208664 - DNA, 580 bp, Homo sapiens
  misc_feature: GYAE6OF02JQ3LO.17.25.C03.1.454.CMB.1.raw
  modified_base (275)..(275): a, c, t, g, unknown or other
  misc_feature (275)..(275): n is a, c, g, or t
  modified_base (311)..(311): a, c, t, g, unknown or other
  misc_feature (311)..(311): n is a, c, g, or t
  modified_base (395)..(395): a, c, t, g, unknown or other
  misc_feature (395)..(395): n is a, c, g, or t
  modified_base (451)..(451): a, c, t, g, unknown or other
  misc_feature (451)..(451): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaatggtatcagcagaaacctggaaaacnccccagacctcctgactctcgtggtgcatccactcngcgaagtggccgtccagtcgtaggttcagtcggcagtcggatcgtgggacagtactttacaatcctcacctatccaccactctnaccaacgtgagattagtcgactaattcctaactactgtacaactagtacgttaacnccgttaccctcgtcttaccgtttcggacccgtaacgggtaaccgtaagttcggtaacgtacgtaaccgaaaaccgtaacgttacgtacgggtactacggtaccaccgttacttacgttaccgttacccg

SEQ ID NO: 208665 - DNA, 574 bp, Homo sapiens
  misc_feature: GYAE6OF02GCM64.17.25.C03.1.454.CMB.1.raw
  modified_base (281)..(281): a, c, t, g, unknown or other
  misc_feature (281)..(281): n is a, c, g, or t
  modified_base (292)..(292): a, c, t, g, unknown or other
  misc_feature (292)..(292): n is a, c, g, or t
  modified_base (333)..(333): a, c, t, g, unknown or other
  misc_feature (333)..(333): n is a, c, g, or t
  modified_base (341)..(341): a, c, t, g, unknown or other
  misc_feature (341)..(341): n is a, c, g, or t
  modified_base (441)..(441): a, c, t, g, unknown or other
  misc_feature (441)..(441): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaaggcttctggattcaccgtttacctcctatagtatcaacgtgggtncgccaggccgntggacaacgacctgagtggatgggatgggacgaaccctaanacgtggtntcacgtagtgtcttcaccctatccgtcgggacagtaccttacacgtacgaccacgaacctcctacaataaccacacgcctaacagtggaagttgaggacncctgtacattcgtagaccgtaacgaccggtccgttactattaaccgtgtcgaccgagaccgtcccgaacggtagtcccggtgaaccgtcccgtaacggcgtacgccgggtaccttttggaccgtttgacgggg

SEQ ID NO: 208666 - DNA, 625 bp, Homo sapiens
  misc_feature: GYAE6OF02I2M4F.17.25.C03.1.454.CMB.1.raw
  modified_base (449)..(449): a, c, t, g, unknown or other
  misc_feature (449)..(449): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcgagtgaaggtctcctgcaaggcttctggattcacgtttacctcctatagtatcaactgggtgcgccaggccgctggacaacgcctggagtggatgggatcggggacgtaacccctaacgtacgtgggtgtacacgagttcgttccttaccaccctagtcccgtaccgggacacgtacctttaaccgattacggaaccctaaccgaacccttccctaccaaactaaaaccncaacgtacccactagtaggtaacggttgaaggtacgccttagacctatcgacggaaccgaccgacggtccgttactaacgttccgtgtcgacgtacgacgtacccaacggtactccgggtgaaccgtcccggtaaggccgacggaccggttcctttcggtaccttcggtaccgggg

SEQ ID NO: 208667 - DNA, 547 bp, Homo sapiens
  misc_feature: GYAE6OF02G49KH.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagacgcctgggtcctcggtgagggtctcctgcaaggcttctggaggcaccttcagcgactatagttcaattgggtgcgacggcctctggacaaggccttgagtggatgggaagatcgtcctatcgtgacacaccaaactacgcacagaagttcagggcagactcacagtaacgcggaacaaagttaacgaacaacaagttaatactaggagctagaacagcctagtcaatctaggagacgacgggtcttacgtacttctgtgcgtaagtagtaattactaataacgtcgtctacttcctttacacccttcccgttgtaccttcgtacgggtcctagtacccggg

SEQ ID NO: 208668 - DNA, 550 bp, Homo sapiens
  misc_feature: GYAE6OF02GOM4B.17.25.C03.1.454.CMB.1.raw
  modified_base (319)..(319): a, c, t, g, unknown or other
  misc_feature (319)..(319): n is a, c, g, or t
  modified_base (412)..(412): a, c, t, g, unknown or other
  misc_feature (412)..(412): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggaggcaccttcagcgactatagtttcaattgggtgcgacgggcctctggacaaggccttgagtggatgggaagntcgtccctatcgttgacacaccaaactacgcacagaagttccagggcagactcaccataaccgcgacaaataacgaacacagttaatctgganctagaacacgcctgtacatactgacggacacgggtcttcttacttctgtcgcgtaggagttaattactaactaacacttacgtcctttacctttttacacccgtttcccttagtacctttcgttacgggcctaaccgg

SEQ ID NO: 208669 - DNA, 660 bp, Homo sapiens
  misc_feature: GYAE6OF02I4PRR.17.25.C03.1.454.CMB.1.raw
  modified_base (282)..(282): a, c, t, g, unknown or other
  misc_feature (282)..(282): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagctgggcctcagtgaaggtctccgtgcgaaggcttcgtggattcacgtttacctcctatagtatcaacgtgggtncgccaggcccgcgtggaccaaacgaccgtgaggtgggaatggggaatggggaccgaaacccgtaacacgtggtgtaccgacgagtcgtcttaccgaccacgtccgtaccgggactaacgtaccttaccacgtacgaacccaacgaaccgttccctacctaaacgtaaaacccacgacgacccttaacgagttacggaagtttacggagggtactacccggttgaacctacgtccgtagaccgaacaccgggtcccttacgttaagttaccgtaggtacggacgtaccgacgtaccccgaaccgagggtttaacccgaacggtacccgttacgggactacggtccgggtacctttcggacgtttccggcgggtacccgg

SEQ ID NO: 208670 - DNA, 645 bp, Homo sapiens
  misc_feature: GYAE6OF02JLO4B.17.25.C03.1.454.CMB.1.raw
  modified_base (293)..(293): a, c, t, g, unknown or other
  misc_feature (293)..(293): n is a, c, g, or t
  modified_base (333)..(333): a, c, t, g, unknown or other
  misc_feature (333)..(333): n is a, c, g, or t
tcagcgtagactagcacgaccggtgctcgatttagtagtgtagatttgggtttggggtacgtcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgntggacaacgacctgagtggatgggatgggcgaaccctaanactggtcgtcacgagtgtccttcacccatcccgtccgggacacgacttaccatcgaccacgaactcctcaactaaacacacgcctacatacggagttggaggtacgcctagaccacgttctaggaaccgaaccgaccgggtcccgttacttaagtttaaccgttcggtacggtaccggaacggtaccggttccccgaacgggtaaccgtttacccggggtacggaaccggtccccggttaaccgggacccgaacggggtccccgggttaacccttttttcgggaaccccgtttttccgggacccgggggggg

SEQ ID NO: 208671 - DNA, 681 bp, Homo sapiens
  misc_feature: GYAE6OF02IMN65.17.25.C03.1.454.CMB.1.raw
tcagcgtagactagcacgaccggtgctcgatttagtagtgtagatttgggtttggggactcaacaaccacatctgtcctctagagaaaaaccctgtgagcacagctcctcaccatggactggacctggaggatcctcttcttggtggcagcagctacaagtgcccactcccaggtgcagctggtgcagtcgtggggctgaggtgaagaagccgtggggcctcgagtgaaggtctccgtgacgaaggtcttcgtggattctaccgtttacctacctatagtatctaacgtgggtcgcgaccgacggccgcgtacggaccgaaacggtaccgtggagtaggagtgggagtcgggaccgtaaacctaacacgttggtctcaacgagtcgtacttaccaccctacgtcccgtacggtacacgtaccttaccacgtacgaaccacgtaacctccctacgaaactaaaccgacacgtacctacgagttacgggtaagttaggacggacgtccgtacgaacctatacgtacgaccggaaccgtaaccggtcccttagttaaccgttacgtacggtacgaccggtaaggtacccgtacccgaccggtaacgttcccgggtagtacccgtacccgtacgggtaccgacgggtcccggttcggtttaccgtacggttccgggtaccggggg

SEQ ID NO: 208672 - DNA, 322 bp, Homo sapiens
  misc_feature: GYAE6OF02I8DDJ.17.25.C03.1.454.CMB.1.raw
  modified_base (285)..(285): a, c, t, g, unknown or other
  misc_feature (285)..(285): n is a, c, g, or t
  modified_base (294)..(294): a, c, t, g, unknown or other
  misc_feature (294)..(294): n is a, c, g, or t
  modified_base (317)..(322): a, c, t, g, unknown or other
  misc_feature (317)..(322): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgccccactcccaggtgcagctggtgcagtctggggctgagtgaagaagctggggctcaggtgaaggtctcctgacaagggtcttctggattacgacgtttacctcctatacgtatcaactgggtncgcaggccncgtggacaacgacctggatggannnnnn

SEQ ID NO: 208673 - DNA, 715 bp, Homo sapiens
  misc_feature: GYAE6OF02H2B3H.17.25.C03.1.454.CMB.1.raw
  modified_base (235)..(235): a, c, t, g, unknown or other
  misc_feature (235)..(235): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtgggcctcgagtgaggtctccngcaaggtctcgtggattctacgtttacctcttatagtactacaacgtgggtcgcgccacgggccgcgtacggaccgaacgaccgtggagtcgggagtggggatcggggaccgaaacccgtaacgacgttaggtcgtacacgtaggttcgtcttaccgaccctacgttccggtaccgggactaacggtacccttaaccgaacgtaccgaacccgtaacgtaaaccctcccctaaaccgtaaactaaaacccaccgtaacgtccctaaacgtacggttacggggttaagttacgggaaacggtaccgtacccttacggaactaacgttcgtaccgggaacccgtaccgtaaccggggttacccttacgtttacgtttaacgcgggttacgcgtaacggtaccgtaccccaaggtcggttccgggtgaccgtccgtaccgggcgacgggtccgttaccgtttagtacccgttgggtaccgggg

SEQ ID NO: 208674 - DNA, 683 bp, Homo sapiens
  misc_feature: GYAE6OF02JBSI7.17.25.C03.1.454.CMB.1.raw
  modified_base (348)..(348): a, c, t, g, unknown or other
  misc_feature (348)..(348): n is a, c, g, or t
  modified_base (473)..(473): a, c, t, g, unknown or other
  misc_feature (473)..(473): n is a, c, g, or t
  modified_base (609)..(609): a, c, t, g, unknown or other
  misc_feature (609)..(609): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgccccactcccaggtgcagctggtgcagtcgtggggctgaggtgaagaagcctggggcctcgagtgaaggtctcctgcaaggcttctggattcacgtttacctctatagtactcaacgtgggtgcgccaggccgctcggacaaccgaccgtgaggtggagtggggagtacgggaccgaacccgtaacncgttaggtcgtcactaggtcgttccttccgtaaccctactcccgtaccgggactacgtaaccttaccgatcggacccaacgtaacccttccctaccgaaactaaaccaccgtaacgacccttaanacgtggtaacgttgggaaccggtacgccttacgaacctacttacgtacgaaccgtacccgacgggtacccgttacttaacgtttcgtacggtcggtaccggaacgtacccggttacccaacgggtcgttacccggnggtaaccgtaccccgtacgggccgttaacgggcccggttaccttttacgggtacccgtttcgggtacccggggg

SEQ ID NO: 208675 - DNA, 601 bp, Homo sapiens
  misc_feature: GYAE6OF02GQJ1J.17.25.C03.1.454.CMB.1.raw
  modified_base (292)..(292): a, c, t, g, unknown or other
  misc_feature (292)..(292): n is a, c, g, or t
  modified_base (453)..(453): a, c, t, g, unknown or other
  misc_feature (453)..(453): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattcacgtttacctcctatagtatcaatgggtgcgccaggcccgngtggacaacgacctggagtggatgggagtcggggacgaaacccctacacgtggtcgtacacgtagtcgtcttaccaccctatccgtaccgggacacgacttaccatcgaccacgaacctccaccaactaaacacacgcctacagtaggagttaggaggacncctagaccagtctacgacgaccgaccggtccttacttacgttactgtcgacggacgtaccgtacccgaacggtacgttaccggtagtaccggacccgtacgggctacgggtccggttccctttacggtacccgttcggtacccggggg

SEQ ID NO: 208676 - DNA, 748 bp, Homo sapiens
  misc_feature: GYAE6OF02JAO1K.17.25.C03.1.454.CMB.1.raw
  modified_base (635)..(635): a, c, t, g, unknown or other
  misc_feature (635)..(635): n is a, c, g, or t
tcagcgtagactagcacgaccggtgctcgatttagtagtgtagatttgggtttgggggacgtacaacaaccacattcgtcgtcctcgtaacgaagaaaaccgtagtcgagcacagctcctcaccactggactggacctggaggactctcttcttggtggcgagcagctacaagtgccactcccaggtcgcagctggtgcacgtcggtagggctcgacggtgaacgaagccgtggggcctcgacgtgaaggtcgtaccgtgcgaaggcttcgtcggtacgttccaacgtttacctaccgtaagtacggtactacgaacgttcgggtacgccgtccgtacggccgtcgtacggtacaacgtaccgtggaacgttcggaacgtaggggacgttcggggaccgtaaaccctaacacgtcggtcgtacgacgtagttcgtccgttacgtaccgtacgtccgtaccgggtaacgtaacggtaccttaccgtacgtacgaaccctaacggtaacctccgtacgaaactaaaccgacacggtaccttacaggtaggttaacgtttcgggaacgttaacgttccttaggactacgtcgtaacggaaccgtaaccgtacgggtacccgttacttacgtttaccgnggttacgacggaccgtacgtacccgtaacggtacggttccgggaagtacccgtaccgtaaacgggcgtacgggtacccggttccttttacggacccgtttcggtaaccggggg

SEQ ID NO: 208677 - DNA, 560 bp, Homo sapiens
  misc_feature: GYAE6OF02G1CTW.17.25.C03.1.454.CMB.1.raw
  modified_base (278)..(278): a, c, t, g, unknown or other
  misc_feature (278)..(278): n is a, c, g, or t
  modified_base (287)..(287): a, c, t, g, unknown or other
  misc_feature (287)..(287): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctcagtgaaggtctcctgcaaggcttctggattcacgtttacctcctatagtatcaactgggtncgcaggccnctggacaacgacctgagtggatgggatgggcaaccctaacgactggtgtcacagtgtcttcacccatcctcggacacgacttaccagtcgaccacgtaactccctacaataaacacagacctacagtggagttgaggtacgcctagactatcgtagacgaccgacggccgttactacttacgtcggcgacgtaacggcgtacccgacggtaccgtccggtcgacggtcccgtacgacggacgtccggtccgtttcggaccttcggtaccgggg

SEQ ID NO: 208678 - DNA, 664 bp, Homo sapiens
  misc_feature: GYAE6OF02HRVSJ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaggcttctggattcacgttttacctcctatagtatcaactgggtgcgcaggccgctggaccaacgacctggagtggatggggatggggaccgaacccctaacgacgttgggtcgtccaactaggttcgttcctttccaaacccctagttccccgttcccggggactaacggtaccctttaacccagttaccgacccaacggtaaaccctccgtaacccaaacgtaaacccacacggtaccttaacacgtcgggaagtttcggaaggtacgtcctagactagtctacggaaccgacgtaccggtccgttacttaactttaccgtggtacgaccggaacgtacccggttacccgacgtaccggtaccgggtagaccggtacccgtaggccgtaacggcccggttcccgttttaggcccgtttcggtccgggg

SEQ ID NO: 208679 - DNA, 540 bp, Homo sapiens
  misc_feature: GYAE6OF02FPX64.17.25.C03.1.454.CMB.1.raw
  modified_base (439)..(439): a, c, t, g, unknown or other
  misc_feature (439)..(439): n is a, c, g, or t
  modified_base (495)..(495): a, c, t, g, unknown or other
  misc_feature (495)..(495): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgttacctctatagtatcaacgtggtgcgccaggccgctggacaacgacctgagtggatgggatgggcgaaccctaacacgtggtgtcacgagtgtcttcaccctatcccgtcgggacagacttaccatcgaccacgaactcctaccaataaaccacacgcctacactggtagttgaggagcctgacntctagacgacacggtccgtatattacgtgtcgacgtagcgtaccacgcgtaccggngacgtccgtacggcacggtccggtctttacgccgttcgtccgggg

SEQ ID NO: 208680 - DNA, 538 bp, Homo sapiens
  misc_feature: GYAE6OF02FYS0F.17.25.C03.1.454.CMB.1.raw
  modified_base (281)..(281): a, c, t, g, unknown or other
  misc_feature (281)..(281): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggggcctcagtgaaggtctcctgcaaggcttctggattcacgtttacctcctatagtatcaactgggtncgccaggccgctggacaacgacctgagtggatgggatgggcgaacctacactggtgtcacagtgtcttcacccatccgtccgggacagacttaccatcgaccacgaacctcctaccaataaacacagaccctaacatgggagttggaggacgcctgactatctagacgacacggcctcttatactgtgcgagacgtcccaggtctccggtagacgtccgtacggcacggtccggtcctttcggaccgttcggcgggg

SEQ ID NO: 208681 - DNA, 642 bp, Homo sapiens
  misc_feature: GYAE6OF02JI2PC.17.25.C03.1.454.CMB.1.raw
  modified_base (280)..(280): a, c, t, g, unknown or other
  misc_feature (280)..(280): n is a, c, g, or t
  modified_base (291)..(291): a, c, t, g, unknown or other
  misc_feature (291)..(291): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaacgtggtncgccaggccgntggacaacgacctgagtggatgggagtgggccgaaccctaacgactgggtgtcacgtagtcgtcttccgacccatcccgtccggggaacacggtaccttaccagtcgaacccacgaacctccctaccaacttaaaccacacgaccctacgattcgggagttacggaacggtacgcccttaggaacctagtcccgtaggaccgtaacccgacgggtacccgttacttaacttaaccgtcggttaggaccgtaggtacccgttaccccgaacggtacgttccgggtaggacggtacccgttaacgggccgtaagggtcccggtacgttttcggtaccgttccggtaccggggg

SEQ ID NO: 208682 - DNA, 518 bp, Homo sapiens
  misc_feature: GYAE6OF02FH1GO.17.25.C03.1.454.CMB.1.raw
  modified_base (230)..(230): a, c, t, g, unknown or other
  misc_feature (230)..(230): n is a, c, g, or t
  modified_base (277)..(277): a, c, t, g, unknown or other
  misc_feature (277)..(277): n is a, c, g, or t
  modified_base (399)..(399): a, c, t, g, unknown or other
  misc_feature (399)..(399): n is a, c, g, or t
  modified_base (420)..(420): a, c, t, g, unknown or other
  misc_feature (420)..(420): n is a, c, g, or t
  modified_base (427)..(427): a, c, t, g, unknown or other
  misc_feature (427)..(427): n is a, c, g, or t
  modified_base (430)..(430): a, c, t, g, unknown or other
  misc_feature (430)..(430): n is a, c, g, or t
  modified_base (452)..(452): a, c, t, g, unknown or other
  misc_feature (452)..(452): n is a, c, g, or t
  modified_base (510)..(510): a, c, t, g, unknown or other
  misc_feature (510)..(510): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtcncctgcaaggcttctggattcacgttacctctatagatcaactgggtncgccaggccgctggacaacgacctgagtggatgggatgggcgaaccctaacatggtgtcacagtgtcttcaccctatccgtaccggggagtacttacatcgaccacgactcctacataaacncagcctaacatggagttgagncctgacntcngacgacacggccgtctattacngtgcgagcgtcccagacgtccggagacgcccgtagcgagccggtccttgactttcggngggtaccg

SEQ ID NO: 208683 - DNA, 586 bp, Homo sapiens
  misc_feature: GYAE6OF02F0UD4.17.25.C03.1.454.CMB.1.raw
  modified_base (223)..(223): a, c, t, g, unknown or other
  misc_feature (223)..(223): n is a, c, g, or t
  modified_base (297)..(297): a, c, t, g, unknown or other
  misc_feature (297)..(297): n is a, c, g, or t
tcagcgtagactagcacgaccggtgctcgatttagtagtgtagatttgggtttgggggtacgtcaacaaccacatctcgtcctctagagaaaaccctgtgagcacagctcctcaccatggactggacctggaggatcctcttcttggtgtcagcagctacaagtgcccactcccaggtgcagctggtgcagtctggggctgaggtgaagaagcctggggcctnagtgaaggtctcctgcaaggcttctggattcacgtttacctctatagtatcaacgtgggtcgcgccaggcccgntggaacaacgacctgagtggatgggatggggccaaaccctaagactggtcgtaccagtagtcttcttacaccctatcccgtacgggacagtaccttaccatcgaccacgaactcctacaataaacacacgacctacagtaggagttcgaggacgcctgacgatctacgacgactaccgaccttactaattactgacgtacgaacgcgttaccccaacggtcgtccgggtagacggtacccgtacgggactacggacccgtttaccgtttcgtaccttcgggtaccgggg

SEQ ID NO: 208684 - DNA, 575 bp, Homo sapiens
  misc_feature: GYAE6OF02HA00D.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtgcgccaggccgctggacaacgactgagtggatgggatgggccgaaccctaacgacgtggtgtcacgagtcgtcttccacccactcccgtccgggacagtaaccttaccatcgacccacgaacctccctaccaataaaccacacgaccctaacatgggagtttgaggacgcctgacatcgtcgacacgaccggccgtaccttattacctgtcgcgacgacgtcccgacggtacgtccggtaggacgtcccgtaacgggccgacgggtccggtccgtttcggtaccgttcggtcggggg

SEQ ID NO: 208685 - DNA, 549 bp, Homo sapiens
  misc_feature: GYAE6OF02HNXEM.17.25.C03.1.454.CMB.1.raw
  modified_base (394)..(394): a, c, t, g, unknown or other
  misc_feature (394)..(394): n is a, c, g, or t
  modified_base (414)..(414): a, c, t, g, unknown or other
  misc_feature (414)..(414): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaacctatttaaattggtatcagcaagaaacctggaaaacgccccagaccctcctgatctcgtggtgacatccactctgcgaagtcggctccccagtcgaggttcagtcgcgtaggtgatcgtgggacagttatttcaatctcaccactccaccactcngaccaacgtgagtagttganacaattctaactatacgtacaacagtaagttactaccgttcccctcgtaccttcgtttcggaccgtagggaacctaagttgaagtactacgaaacgtaacgtgtacgtcgtacgacctaccgtattcctgttacc

SEQ ID NO: 208686 - DNA, 751 bp, Homo sapiens
  misc_feature: GYAE6OF02IGDDN.17.25.C03.1.454.CMB.1.raw
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctaacaagtcgcccactcccaggtgcagctggtgcagtctggggctggaggtgaagaagccgtggggcctcagtgaaggtctcctgcaaggtcttcgtggtattcaccgtttacctctatagtatcaacgtgggtgcgccacggccgcgtggaccaacgacctggaggtggagtgggatcgggaccgaaaccctaacgacgttggtcgtacacgtacggttcgttccttaccaaccccgtacgtcccggtaccggggaacctaacggtaacccttacccgaagttaccgaaccctaaccggtaaacccctttaccccctaacctaaaacttaaaaacccgaccgtaaaccggtaccccttaaacgtacggtttacgggtaacgggtttacggaacgggtaaccgtccccgttaggaaccctaagtttccgaacggtaacccggaccgtaccgggtcccgtttacgttaacgtttacgtggttaccggacggacgtacccgtacccgtacggtacgttcccgggtagtacccggtcccgtaacggccgaccgggttcccggttacccgttttacggtacccggttcgggtacccggggg

SEQ ID NO: 208687 - DNA, 598 bp, Homo sapiens
  misc_feature: GYAE6OF02H6Q3P.17.25.C03.1.454.CMB.1.raw
  modified_base (438)..(438): a, c, t, g, unknown or other
  misc_feature (438)..(438): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttctggtggcagcagctacaagtgcccactcccaggtgcagctggtgcagtctggggctggaggtgaagaagcccgtggggcctcgagtgaacggtctcctgacaagggtcttctggtacttcaccggtttacctcctatagtatcaacgtgggtgcgccgaggccgctggacaacgacctgagtggagtgggatggggaccaaacccgtaacacgtggtgtcaccgtagtcggtcttaccacccgtactcccgtccgggacagaccttaccatcgaccacgactccctacaactaacacanaccctacagtaggtagtcggaaggacgccgtagactctacgtacgaaccggacaccgggccgtcttaacgtttacgtggtgcgagacgtcccgacgacgtccggtagaaccggtccacgggacgacggtccggtccgtttcgtaccgttcggtaccgggg

SEQ ID NO: 208688 - DNA, 555 bp, Homo sapiens
  misc_feature: GYAE6OF02FU7NS.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggtacgttaaaacctatttaaattggtatcagcaagaaacctggaaaacgccccagaccctcctgatctctggtgcatccactctgcgaagtggccgtccatcgaggttcaggtgcagtggatcgtgggactagtatttcaattcctacacctatccaccactctcgacaaccgtgaggtattgtgactaatctactactgtacaactagtacgttactaccgttccctcgtcttacgtttcggaccgtacggggtaacctaaggttgaagtaactaccaaaacggtacgttcggtaggactcggaccaccgtacttccttgttacc

SEQ ID NO: 208689 - DNA, 684 bp, Homo sapiens
  misc_feature: GYAE6OF02HZ5L7.17.25.C03.1.454.CMB.1.raw
  modified_base (342)..(342): a, c, t, g, unknown or other
  misc_feature (342)..(342): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctggggcctcgagtgaggtctcctgcaaggcttctggattctacgtttacctcctatagtatcaacgtgggtgtcgcaggtccgctaggacctaacgacctggagtggagtggggatcgggaccgaacccgtaancgtaggtgtcagtagttcgtcttaccaccctacgtcccgtaccgggactagtaaccttaccagtaccggaaccctaacgtaaccccttccctaaccgtaaactaaaaccgaccaacgtaccctaaacgcgttaaggggtacttaggaacggtacgtacccgttagaaccgtacttacggtacggaaccgtaccgaccgggtaccgttactttaagttaaccggtggaacgtccggtaacggaccgttaccccgaggtaaccttcccggggtgaaccggtaccccgttagggccctaacgggtcccggtttaccgttttagaccggttttcggaaccgggggg

SEQ ID NO: 208690 - DNA, 533 bp, Homo sapiens
  misc_feature: GYAE6OF02FHLLU.17.25.C03.1.454.CMB.1.raw
  modified_base (364)..(364): a, c, t, g, unknown or other
  misc_feature (364)..(364): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccgacaagtcacggcgttaaaacctatttaaattggtatcagcagaaacctggaaaagccccagacctcctgatctctggtgcatccacttctgcgaagtggcgtcccatcgagttcagtgcagtggatcgtgggacagatttcaattcncaccatcaccactctgccaaccgtgaggattagtgacatactactactgtacaacaagagttactacgttaccccgtcgtctacgttttcggccgacggggtacctaagttagacgtaactaccaaacgaacgttagtacggtactacgaccacctacttcctgttacc

SEQ ID NO: 208691 - DNA, 624 bp, Homo sapiens
  misc_feature: GYAE6OF02F9KRM.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagcctggggcctcagtgaaggtctcctgcaaggcttcgtggattcacgtttacttcctatagtatcaacgtgggtgcgccaggccgcgtggacaacgcctgagtggatggggatgggaccgaaaccctaacacgtgggtgtcacgtagtcgtccttcaaccctagtcccgtccgggaacagtaccttaccatacgaccacgaacctcctaccaaataaaccacacgaccctaagagtaggtaacgttaggaacgacgtcccgtagaacctatcgtaggaaccgtacgtaccgggccttacttaagtttactggtacgacgagtaccgtaccccgaaggtacgtcccgggtagacccggtacccgtacggtcgaccgggtcccggtttacccttttagggaccctttccggtacggggg

SEQ ID NO: 208692 - DNA, 540 bp, Homo sapiens
  misc_feature: GYAE6OF02GETUD.17.25.C03.1.454.CMB.1.raw
  modified_base (416)..(416): a, c, t, g, unknown or other
  misc_feature (416)..(416): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaaacctatttaaattggtatcagcagaaaacctggaaaagccccagacctcctgatctctggtgcatccactctgcgaagtcggcgtcccatcgaggttcagtggcagtggatcgtgggacagtatttcaatctacaccatccaccactctgcaacctgagattgtgcaattctactactntacaaacagattacacgttcccctcgccttacttttcggaccgtacggggtaaccctaagttcgaagtaactacgaaaacggaacttagtcgggtactggacctaacctacttccgttgttacc

SEQ ID NO: 208693 - DNA, 715 bp, Homo sapiens
  misc_feature: GYAE6OF02GVHMV.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattcacgtttacctccttatagtactcaacgttggggtgccgccgacggcccggtctcggaacaaccgacctggaggtgggagtggggattcggggaccgaaacccctaaacgaccgttgggtcgtcgaacgtagttcgttcctttccacccctagttcccgtaccggggaacacggtaacctttacccagttaccgaacccaacgtaacccttccctaacccaaactaaaacccgacctaacgaccctaacgagtacgggtagttaggaacggtacgtcccttaggacctacgttccgtacgaaccggaccgtaaccggggtccccttacgttaaacgtttaccgtcggttacgaccgtaacggtacccgtacccgacggtacgttccccgggttaggacccggtcccgtaacgggccgtacgggtccccggttaccttttacggacccgtttccgggtaccggggg

SEQ ID NO: 208694 - DNA, 605 bp, Homo sapiens
  misc_feature: GYAE6OF02HXHYV.17.25.C03.1.454.CMB.1.raw
  modified_base (291)..(291): a, c, t, g, unknown or other
  misc_feature (291)..(291): n is a, c, g, or t
  modified_base (342)..(342): a, c, t, g, unknown or other
  misc_feature (342)..(342): n is a, c, g, or t
  modified_base (356)..(356): a, c, t, g, unknown or other
  misc_feature (356)..(356): n is a, c, g, or t
  modified_base (369)..(369): a, c, t, g, unknown or other
  misc_feature (369)..(369): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgntggacacgactgagtggatgggatgggacaacctaacacgtggtgtacacngttgtcttcacccntccgtaccggganacgacttacatcgaccacgaactcctaccaataaaccatacgaccctaatacgtaggtagttgaacggacgcccttaggaacctagttacgtacggaaccggtaaccgtacccgggtccgttacttaagtttaccgtaggtcggaccgagtaccgttccccaaggaacgttcccgggtagaccggtcccgtacggctacgggcccggttaccgttttcgccgtttcggtacggggg

SEQ ID NO: 208695 - DNA, 576 bp, Homo sapiens
  misc_feature: GYAE6OF02I4QRJ.17.25.C03.1.454.CMB.1.raw
  modified_base (443)..(443): a, c, t, g, unknown or other
  misc_feature (443)..(443): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgcgtggaccaacgacctggacgtggagtggggatggggaccgaaaccctaacacgtcgggtgtaccacgaggttgtcctttccaccccatccgtccgggacacgaccttaccatcgaaccacgaacctcctaccaactaaacacacgccctaanagtggaagttggagagcctagactatcgtagaccgaccgacggtcccgttactacgttactggtgacgacgtacgtacccgacgtacgtccggagacgccgtacggcaggccgtccttgacgttcggtacggg

SEQ ID NO: 208696 - DNA, 806 bp, Homo sapiens
  misc_feature: GYAE6OF02FET8J.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcgagtgaacggtcctcctgcaaggccttcgtggtacttctacgtttacctctatagtatcaacgtgggtacgccgccgtaggcccgtcgtacggaaccaaccggtaccgtaggaggtcgggtagttcgggggaacgttacggggaacccgaaaccccgttaacgtacgttcgggtacgtcctaacgtacggtttcggttaccctttacccgaaccccgttacgttaccccgggtacccggggtaaacctaaccggttaacccttaacccgtaacgttacccgaaaccccgtaacccggttaaaccctccccgtttaaccaaaacgtttaaacccgacctaacggtaccccttaaagacgggtacgggttaggttacggacgggtacctcccgtagtaacctacgttccgtacggaaccggacccggtacggtcccgtttaacgtttaacgtacgtcggttcggaaccggtacgtacccgtacccgacgggtaacccgttcccgggacgtaacccggttcccgtaaccgggtaccgacgggttcccggtttaccttaccgggttaccggtttccgggaacccggggg

SEQ ID NO: 208697 - DNA, 570 bp, Homo sapiens
  misc_feature: GYAE6OF02I5IQV.17.25.C03.1.454.CMB.1.raw
  modified_base (280)..(280): a, c, t, g, unknown or other
  misc_feature (280)..(280): n is a, c, g, or t
  modified_base (375)..(375): a, c, t, g, unknown or other
  misc_feature (375)..(375): n is a, c, g, or t
  modified_base (417)..(417): a, c, t, g, unknown or other
  misc_feature (417)..(417): n is a, c, g, or t
  modified_base (442)..(442): a, c, t, g, unknown or other
  misc_feature (442)..(442): n is a, c, g, or t
  modified_base (515)..(515): a, c, t, g, unknown or other
  misc_feature (515)..(515): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggccaaccctaacacgtggtgtcacgagtcgtcttcacccctagtcccgtccggganacgtaccttaccatcgaccacgtacctcctaccaactaaacncagtcctaacagtggagttgaggancctagaccatctgaccacgacggtcctcttacttcgtgtagcgtagaccgtcccgaacggtcttcccgggtanaccggtccgtaccgggcacgggtccggtcctttcggaccgtttcggtaccggggg

SEQ ID NO: 208698 - DNA, 593 bp, Homo sapiens
  misc_feature: GYAE6OF02IZ3WJ.17.25.C03.1.454.CMB.1.raw
  modified_base (280)..(280): a, c, t, g, unknown or other
  misc_feature (280)..(280): n is a, c, g, or t
  modified_base (305)..(305): a, c, t, g, unknown or other
  misc_feature (305)..(305): n is a, c, g, or t
  modified_base (328)..(328): a, c, t, g, unknown or other
  misc_feature (328)..(328): n is a, c, g, or t
  modified_base (334)..(334): a, c, t, g, unknown or other
  misc_feature (334)..(334): n is a, c, g, or t
  modified_base (405)..(405): a, c, t, g, unknown or other
  misc_feature (405)..(405): n is a, c, g, or t
  modified_base (418)..(418): a, c, t, g, unknown or other
  misc_feature (418)..(418): n is a, c, g, or t
  modified_base (481)..(481): a, c, t, g, unknown or other
  misc_feature (481)..(481): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggagtatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacacgacctgngtggatgggatgggcaacctaanctggtntcacagtgtcttcacccatccgtaccgggacacgacttaccatcgaccacgaacctcctaccaataaaccncacgtaccctaanacgtggagttgacgggactcctagacctagtctggaaccacgacggtccttactacgtttacnggtcgacgagtacgtccccgaagggtccgtcccgggtagaaccggaccccgttaacgggcgtaacgggtcccgggttaccctttacgggtaccctttcgggtaaccgggggg

SEQ ID NO: 208699 - DNA, 750 bp, Homo sapiens
  misc_feature: GYAE6OF02IM2N1.17.25.C03.1.454.CMB.1.raw
tcagcgtagactagcacgaccggtgctcgatttagtagtgtagatttgggtttggggtacgtcaacaaccacatctgtcctctagagaaaaccctagtgagcacagctcctcaccatggactggacctggaggatctcttcttggtggcagcagctacaagtgcccactcccaggtcgcagctggtgcagtcgtgggctggaggtgaagaagccgtggggcctcgagtgtaaggtctcctgacaaggtcttcgtggatttctacgtttacctcctagtagttatctaactgggtgcgcgtacggccgcgtaggacgaaccgtaccgtgtacgtagggacgttaggggatggggaccgtaaaccctaacgtacggtgggtacgtccacgtagttcgtacttccaacctactccggttaccgggactaacggtaccttaacgacgttacgaacccaacggtaaccttccccgaccgtaaaacttaaaacccgaacctaaacggtacccttaaccgaagttacgggtacgtttacgggaaacggtaccgttccgtaaggaaccttacgttaccgtaaacgggaaccgaaaccccggtacgggacccgtttaccgttaaatttaccggtacggcgttaaccgggaacttaccggtaccccgaacgtaacggttcccgggagtaacccggtcccgttaacgggaccctaggggtcccgttacccgggttttaagccgttttaccgggaccggggg

SEQ ID NO: 208700 - DNA, 547 bp, Homo sapiens
  misc_feature: GYAE6OF02GPZGC.17.25.C03.1.454.CMB.1.raw
  modified_base (245)..(245): a, c, t, g, unknown or other
  misc_feature (245)..(245): n is a, c, g, or t
  modified_base (363)..(363): a, c, t, g, unknown or other
  misc_feature (363)..(363): n is a, c, g, or t
  modified_base (443)..(443): a, c, t, g, unknown or other
  misc_feature (443)..(443): n is a, c, g, or t
  modified_base (467)..(467): a, c, t, g, unknown or other
  misc_feature (467)..(467): n is a, c, g, or t
  modified_base (502)..(502): a, c, t, g, unknown or other
  misc_feature (502)..(502): n is a, c, g, or t
  modified_base (538)..(538): a, c, t, g, unknown or other
  misc_feature (538)..(538): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttcnggattcacgtttacctctatagtatcaacgtgggtgcgccgggcgctggaccaacgcctgagtggagtgggatgggaccgaacccgtaacacgtggtctcacagtcgtcttcaccctntcccgtccgggaacagtacttaccagtcgaaccacgaactcctaccaataaacacacgcctaacatggagttgagcgccngacactcagaccgacgaccggctntacttactgtcgacgagcgtcccagtcgtccggtnacggtccgtacgcgacggccgtccgttgacttcggngggacccgg

SEQ ID NO: 208701 - DNA, 587 bp, Homo sapiens
  misc_feature: GYAE6OF02HDP8D.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctcagtgaaggtctcctgcaaggtcttctggattctacgtttacctcctatagtatcaactggtgcgccaggccgctggacaacgactgagtggagtgggagtcgggacgaaccctaacgacgtggtgtcacgagtgtcttcaccctacgtccctccgggacacgtacttacccagtacgaccacgaacctcctaccaactaaaccacacgacctaacagtggagttgagcgacctagactagtctcgacgacgaccggtccgttactaacgttacgtgtcgtacgacgtacgcccctaaggtcgtccggtacggacgtacccgtacgggccgacggtcccggttaccgtttacggaccgttcggtaccgggg

SEQ ID NO: 208702 - DNA, 591 bp, Homo sapiens
  misc_feature: GYAE6OF02G840B.17.25.C03.1.454.CMB.1.raw
  modified_base (346)..(346): a, c, t, g, unknown or other
  misc_feature (346)..(346): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccgaggccgcgtggacaacgacctgagtgagtgggatgggacaacctaacgacgtggtgtacanagtgtcttaccaccctactcccgtacgggactacgtaccttaccagtacgaacccgaacgtaacctccctactaacgtaaaccaccaacgacctacgactgggagttaggaggacgtcctagactcttcgacgacgacgacggccgttctattcgtagtcgtacgacgacgtcccacggacgtccggtagacggaccgttacggaccgacggtccgtccgttttacggaccgttcggtacggggg

SEQ ID NO: 208703 - DNA, 604 bp, Homo sapiens
  misc_feature: GYAE6OF02INI8U.17.25.C03.1.454.CMB.1.raw
  modified_base (99)..(99): a, c, t, g, unknown or other
  misc_feature (99)..(99): n is a, c, g, or t
  modified_base (242)..(242): a, c, t, g, unknown or other
  misc_feature (242)..(242): n is a, c, g, or t
  modified_base (278)..(278): a, c, t, g, unknown or other
  misc_feature (278)..(278): n is a, c, g, or t
tcagcgtagactagcacgaccggtgctcgatttagtagtgtagatttgggtttgggagtcagtctcagtcaggacacagcatggacatgagggtcccgntcagctcctggggctcctgtctactctggctccgagctgccagatgtgacatccagatgacccagtctccatcctcctgtctgcctcgtgtgggggtcagagtcaccatcacttgccggacaagtcacggacgttaaaacctntttaaattggtaattcagacagaaacctggaaaacnccccaagacctctagactctacgtggtgcatccacttctagcgtaagttcggaccgtccagtcgaggttcagtggactaggtggatcgtagggactagtaatttcaactctacacactacacctactactacgactaacgtagacggtagttagtagacgtaacgtacttaactacgtacgtacaacgtacgtacgttacgtacgttaccctacgtactacgtttacggaccgtaacgggaaccgtaagttacgaacgtaactaaccgaaacggtaacgttacgtacggtacgtacgtaccgtaaccgtacttaccgtagttaccg

SEQ ID NO: 208704 - DNA, 593 bp, Homo sapiens
  misc_feature: GYAE6OF02GV0F2.17.25.C03.1.454.CMB.1.raw
  modified_base (280)..(280): a, c, t, g, unknown or other
  misc_feature (280)..(280): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctggagtggatgggatgggcggaaccctaaccacgtggtggtcacagtgtcttctacccactccgtccggacgacgacttaccactcaccgaccaaccgtcctccaactaaacaaccagacctacactagtagttagtaggacgccgtcgacgactcgtagacgacgaccgtccggtacttacgttactcgtagcgacggtacgtacccgccggaacgtccgggttacgacggtcccgtaccgggacgtacgggccggttaccctttcggttacgttaccggttccggggg

SEQ ID NO: 208705 - DNA, 654 bp, Homo sapiens
  misc_feature: GYAE6OF02GG02J.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagccgtgggcctcgagtgaaggtctccgtgcaaggcttcgtggattctacgtttacctcctatagtatcaacgtgggtgccgccaggccgcgtggacaacgcctgagtggagtgggatcgggaccaacccgtaacacgttgggtctcaacgaggtcttccttaccacccctagtcccgtaccgggacacgtaccttaccgactcgaccaccgaacctcctaccaactaaaccacacgtaccctaacgaagtcgggtaagttggaacgggaccgtcctacgtaactacttacgtacggaaccgtaccggaccggtcccgtttacgttacttaccgtacgtacggacgtaacgtaccgtacccgacggtaaccggtccgggtacgaaccggtacccgaccggtacggacgggtcccggttaccgtttacgggtacccgttcggtaccggggg

SEQ ID NO: 208706 - DNA, 740 bp, Homo sapiens
  misc_feature: GYAE6OF02I61WZ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggggtgaggtgaagagccgtggggcctcagtgaaggtctcctgcaacggcttcgtggattctacgtttacctccgtatagtactcaactgggtcgtcgaccgaggccgcgtggaacaaccgaccgtggaggtggagttaggggagttacggggaccaaaccccgtaaactacgtcgggtgtaccgagtacggttcgtttaccttaccgacccctaattccccggtaccggggaactacggttaacccttaccgaacgttccggaaccctaacccggtaaccttaccctaaccctaaactaaaacccgaactacggtaacccctaagacggttaacgggtacggttacggaacggacgtacccgtacgaactacttaccgtcggaaccgtaaccggaccgggtcccgttaacttactttacgtacggttcgacgtaccggtacgtaccccgaaggtaccggtccgggttacggaacggtacccgttacgggaccgtacgggcccggtttaccggtttacggtaccgtttccgggaccggggtaccgggg

SEQ ID NO: 208707 - DNA, 546 bp, Homo sapiens
  misc_feature: GYAE6OF02FYYUU.17.25.C03.1.454.CMB.1.raw
  modified_base (500)..(500): a, c, t, g, unknown or other
  misc_feature (500)..(500): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtcgtcacgagtgtcttcacccatccctcgggacagacttaccatcgaacccacgaactcctaccaactaaacacagacctacatggagttgaggacgcctagacatctagacgacgaccggccgtactattactgtgacgagacgtcccgacgtctccgggtanacgtccgtacggctacggccggtacctttggaccgttggtccgggg

SEQ ID NO: 208708 - DNA, 621 bp, Homo sapiens
  misc_feature: GYAE6OF02G59I3.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgcaggccgctggacaacgacctgagtggagtgggagtcgggaccgaaaccctaacgacgtggtcgtcactagttcgttccttaccaccctacgtcccgtaccggggactacgaccttaacccagtacgacccacgtaaccctccctaccaactaaaccacaacgccctaacagtggagttggaggacgcctagactatcgtacgaaccgaccgtaccgggtccgttacgttaacttaacgttgtacggacgacgaccgttacccgacggtacgtcccggtgaccgtacccgtacggcgtacgggtccgttacccgtttcggtaccgttcggtaccggggg

SEQ ID NO: 208709 - DNA, 749 bp, Homo sapiens
  misc_feature: GYAE6OF02IGSN2.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagccgtgggcctcagtgaaggtctcctgacaaggtcttcgtggattctaccgtttacctcctaatagtatactaacgtgggtcgccgtcgacgggcccgcgtacggacaaaccggtacctaggaaggtggtagttggggaagttcggggaccgtaaaaccccgttaaagaccgttgggtacgtacgtaaccgtaggttcgtaccttaccaaccctacgtcccggttaccgggaacacggtacttaccgaacgtacgtaacccgaccgtaaacctttccccctaaccgaaaaattaaaacccgacgtaacgtaccccgtaaccaaggtttaccgggaaggttttaacgggaacgggaaccgttccgttaacggacctaaagtttcccgaaggtaaacccggactacccggggtacccgtttacttaacgttaaccgtggtcgtaaccggaagtacccgtacccgtaaggacgttcccggtagaccgtaccccgttaaggcctaacgggtcccgttaccgttttacggcctttagggacccggggg

SEQ ID NO: 208710 - DNA, 589 bp, Homo sapiens
  misc_feature: GYAE6OF02G9J11.17.25.C03.1.454.CMB.1.raw
  modified_base (301)..(301): a, c, t, g, unknown or other
  misc_feature (301)..(301): n is a, c, g, or t
  modified_base (435)..(435): a, c, t, g, unknown or other
  misc_feature (435)..(435): n is a, c, g, or t
  modified_base (463)..(463): a, c, t, g, unknown or other
  misc_feature (463)..(463): n is a, c, g, or t
  modified_base (499)..(499): a, c, t, g, unknown or other
  misc_feature (499)..(499): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagcctggggcctcaggtgaaggtctcctgtcaaggcttacgtggattcctacgtttacctcctatagtactcaacgtgggtcacgccgaggccncgtggacaacgacctgagtggagtgggagtgggaccgtaaccctaagaccgtaggttgacacgtacgtgtccttacaccctatccgtcggacacgacttacaactgaacccacgtaacctcctaacataaaccncactacctagatgggaattcggaggacncctagacctagtctagacgacacgccgtattacgtntgcgtaggactacggttacccaggtactccgggtagaccgtaccgtacggactacgggtcccgttccgtttacgtaccgtacggtcgggg

SEQ ID NO: 208711 - DNA, 590 bp, Homo sapiens
  misc_feature: GYAE6OF02FRGAY.17.25.C03.1.454.CMB.1.raw
  modified_base (281)..(281): a, c, t, g, unknown or other
  misc_feature (281)..(281): n is a, c, g, or t
  modified_base (372)..(372): a, c, t, g, unknown or other
  misc_feature (372)..(372): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgagaagcctggggcctcagtgaaggtctcctgcaaggcttctggattcacgtttacctcctatagtattcaactgggtncgccaggccgctggacaacgacctgagtggatgggatgggacgaaccctaacacgtggtgtcacagtcgtcttcacccatccgtccggganacgacttaccgatcgaccacgaacctcctccaataaacacgacgacctaacagtaggtagttgaaggcgcctgaccactacgtagaccgaacgaccggtccgttacttaacttacgtgtacggcgtaggtaccgtaccccaacggtacgtcccggttaggaaccggtcccgtacgggcaccggtcccggttacctttggtaccctttcggaccggggg

SEQ ID NO: 208712 - DNA, 848 bp, Homo sapiens
  misc_feature: GYAE6OF02HD4CA.17.25.C03.1.454.CMB.1.raw
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (337)..(337): a, c, t, g, unknown or other
  misc_feature (337)..(337): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcctggggcctcagtgaaggtctcctgcaaggcttcgtggattcacgtttacctcctaatagtatcaacgtgggtncgccaggccnctggacaacgcctgagtggatgggatgggacaaacccgttaanacgtggtctcaacgaggttcgtacctttccgaacccctacgttccccggtaccggggtaactaacggtaaccctttaacccgaagtttaccgaaccccgtaaacccggtaaaccctttacccctaaccccgtaaaattaaaaaccccacgtaaccggtaaccccttaaaccgaggtttaacggggtaaacgggttttacgggaaacggggaacctaccccggtttaaggaacccgtaacgttttaccccggtaaacggggaaaccccgttaacccgggtaaccccggggtttcccccggtttaaactttaaaccgtttttaaaccccggtgggttaacccggtacccgggtaaaggttaccccgggtacccccgtaaccgggtaccggttaccccggggttaacggacccgggttaacccccggttaaaccggggccctaaaccgggggttccccggtttaccccgttttttaccgggaaccccgtttttccggggtaaccccgggggggg

SEQ ID NO: 208713 - DNA, 763 bp, Homo sapiens
  misc_feature: GYAE6OF02F86QG.17.25.C03.1.454.CMB.1.raw
  modified_base (300)..(300): a, c, t, g, unknown or other
  misc_feature (300)..(300): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctcctgtctgcctgtggtggggtcagagtccaccatcctacttcggaccggacaacgtccgacggtaccgtttaaaaaccttaatttaaagttggtactacagacgaacgaaaccgtaaggaaaaccnccccgaagtaccctcctagacttcctacgtggtcgcctactcccgtactcgtacggacgtaaggttccggtacccgtacccgtacgtacggtacggtttacgtagggttcggacgtagggttaggacttcggtacggggaacctaagttactttaccgaaacttcccgtaacctaaccctaactaccctaaccctaccttacgtccgtaaccctaaaccgttagggtaaggttactttgggacgttaacctaacgtttacccttaacgttacgttacgtaaacctaaacgtaacggttacgttaaacccgttcccgtttaccccgtcggttaccgtttaacccgtttaccgggaaccgttaacgggggtaaaccttaaggttcggaaccgttaactaaaccgaaacggtaacgttggtaccgtacgtaccgtaccgtaacctacgtttccggttactttcccg

SEQ ID NO: 208714 - DNA, 755 bp, Homo sapiens
  misc_feature: GYAE6OF02HHDMX.17.25.C03.1.454.CMB.1.raw
  modified_base (243)..(243): a, c, t, g, unknown or other
  misc_feature (243)..(243): n is a, c, g, or t
  modified_base (280)..(280): a, c, t, g, unknown or other
  misc_feature (280)..(280): n is a, c, g, or t
  modified_base (289)..(289): a, c, t, g, unknown or other
  misc_feature (289)..(289): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttcnggattcacgtttacctcctatagtatcaacgtgggtncgccaggcnctggacaacgacctggagtggatgggatcggggacgaaaccctaacgacgttgggtgtccgaaacgtacggttacgtccgtttaccgaacccctactccccgtaccgggggaacctaacggtaaccctttaacccgagtaccggtaaccccaaacccggtaaacccttaccccgttaaccctaaactaaaaacccgaccaaaccggtaccccttaaacgtaacgttacggggtaaggtttacggaaacgggtacggtcccgttaagaacccattccgtacggaaccgtaccgaccgggtcccgttacgttacgttaacgttcggtacgtaccggtaaggtacccggttaccccaacgggtaaccttccccggggtagtaacccgggtaccccgttaaccggggccttaaccggggtcccgggttaccccgtttttacgggacccgttttccggggtacccgggggg

SEQ ID NO: 208715 - DNA, 586 bp, Homo sapiens
  misc_feature: GYAE6OF02I23Z5.17.25.C03.1.454.CMB.1.raw
  modified_base (548)..(548): a, c, t, g, unknown or other
  misc_feature (548)..(548): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtacccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtgggagtgggagtgggacgaaccctaacactggtgtcacgtagtgtcttacgacccatccctcgggacagtactaccatcgacacgaacctcctacataaaccacgacgacctacgagtcggacgtttggaaggtacgccgttagaactacgtctacggaccgaaccgtaccggtacccgttactacgtttactggtcgacgtagacgtcccaacggtcgtccggtgacggtcgaccgganacggtccggtaccgttgtaccgttcggcgggtacccgg

SEQ ID NO: 208716 - DNA, 716 bp, Homo sapiens
  misc_feature: GYAE6OF02GBL6H.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtgggcctcagtgaaggtctcctgcaaggcttctggtattctacgtttacctcctatagtatcaacgtgggtgcgccgaggccgctggacaacgaccgtgaggtggatggggagtggggacctaaaccctaacgacttgggtcgtaccacgtagtcgtccgttacacccctacttcccgtaccgggtaactacgtaaccgtttaccacgttacgaacccgtaaccgtaacccttcccgtaacctaaacgtaaaacctacccgaacgtacccttaacgtaacgttagggtaacgtttagggaacggtacggccgttacgacgtaacttcggtacgaaccggtaaccgaccgggtacccgttccgtttaacgtttaccgtaggttcgaccggtacggttaccgtaccccgacggtaaccggttcccggtacggtaccggttacccgtaccgggtaccacgggtacccggttcccgtttacggtaccccggtttcggtacccggggg

SEQ ID NO: 208717 - DNA, 524 bp, Homo sapiens
  misc_feature: GYAE6OF02F0AQK.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatggggcgaaacctaacactggtgtcacagtgtcttcacccatccctccgggacagacttaccatcgaccacgaactcctccataaacacagcctacatggagttgaggagccgtgacatctgacgacacggcgtctattactgtgcgagacgtcccacggatccggtgacgcctacggcacggccggtcctttcgacttcgtcgggg

SEQ ID NO: 208718 - DNA, 567 bp, Homo sapiens
  misc_feature: GYAE6OF02JTPFJ.17.25.C03.1.454.CMB.1.raw
  modified_base (234)..(234): a, c, t, g, unknown or other
  misc_feature (234)..(234): n is a, c, g, or t
  modified_base (247)..(247): a, c, t, g, unknown or other
  misc_feature (247)..(247): n is a, c, g, or t
  modified_base (250)..(250): a, c, t, g, unknown or other
  misc_feature (250)..(250): n is a, c, g, or t
  modified_base (294)..(294): a, c, t, g, unknown or other
  misc_feature (294)..(294): n is a, c, g, or t
  modified_base (344)..(344): a, c, t, g, unknown or other
  misc_feature (344)..(344): n is a, c, g, or t
  modified_base (352)..(352): a, c, t, g, unknown or other
  misc_feature (352)..(352): n is a, c, g, or t
  modified_base (405)..(405): a, c, t, g, unknown or other
  misc_feature (405)..(405): n is a, c, g, or t
  modified_base (413)..(413): a, c, t, g, unknown or other
  misc_feature (413)..(413): n is a, c, g, or t
  modified_base (419)..(419): a, c, t, g, unknown or other
  misc_feature (419)..(419): n is a, c, g, or t
  modified_base (423)..(423): a, c, t, g, unknown or other
  misc_feature (423)..(423): n is a, c, g, or t
  modified_base (481)..(481): a, c, t, g, unknown or other
  misc_feature (481)..(481): n is a, c, g, or t
  modified_base (496)..(496): a, c, t, g, unknown or other
  misc_feature (496)..(496): n is a, c, g, or t
  modified_base (539)..(539): a, c, t, g, unknown or other
  misc_feature (539)..(539): n is a, c, g, or t
  modified_base (562)..(562): a, c, t, g, unknown or other
  misc_feature (562)..(562): n is a, c, g, or t
tcagcgtagactagcacgaccggtgctcgatttagtagtgtagatttgggtttggggtacggtcgaacgaaccacatctcgtcctctagagaaaccctgtgagcacagctcctcaccatggactggactgaggactcctcttcttgtggcgagcagctacgagtcgcccactcccaggtgcagctggtgcagtcgtgggctgaggtgaagagccgtggggcctcagtgaggtcnctgacagtcgtcnggntcgtacgtttcctctattagtatcaacgtggtgccgcaggccgngcggacacggcctgacgtggactgggatgggaccgaacctagcgtggtcnaactggtntcttaccaaccctctccgtacggactacgtactaccatccgaccagttacccncctaccanaaaccncacncttaaccagttacgagttcggaacggtcgtcctagaactgctgaacgcgaaccggttntactacgtcagtcgngtacgacctccgacgtaccgtcggagaagcccctagggtaccnggtcctccgtttagaccgttccncgggg

SEQ ID NO: 208719 - DNA, 662 bp, Homo sapiens
  misc_feature: GYAE6OF02ILOZO.17.25.C03.1.454.CMB.1.raw
tcagcgtagactagcacgaccggtgctcgatttagtagtgtagatttgggtttgggggactcaacaaccacatctgtcctctagagaaaaccctgtgagcacggctcctcaccatggactggacctggaggatcctcttcttggtggcagcagctacaagtgcccactcccaggtgcagctggtgcagtctggggctgaggtgaagaagcctggggcctcagtgaggtctcctgcagcttctggattcacgtttacctctatagtatcaacgtggtgcgccaggccgctggacaacgctgagtggatgggagtgggaccgaaccctaacacgtggtgtacactagtcgtcttccaccctactcccgtaccgggacacgaccttaccatcgaccacgaacctcctaccaactaaaccacacgacctacagtggagttggacggacgccctagacctactacgtacgtaaccggaaccgtacccgggtacccgttacgttaacgtttaaccgttaggttacggaccggtaacggtaaccgttacccccgaacggtacccggttcccggggttaccggaccggggtaccccgttacccgggacccgcgggtacccgggttcccgttttaccgggaccgtttttccgggaccgggggtaccccggg

SEQ ID NO: 208720 - DNA, 734 bp, Homo sapiens
  misc_feature: GYAE6OF02FZGOC.17.25.C03.1.454.CMB.1.raw
  modified_base (280)..(280): a, c, t, g, unknown or other
  misc_feature (280)..(280): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaacgtgggtncgccaggccgcgtggacaacgacctgagtgatgggatgggacaacctaacacgtggtgtcacgagtgtcttcaccatccgacgggacacgtaccttaccgactcgaacccacgtaaactccctaccaagtaaacaccgtaacgacccttaacacgttagggtaacgtttggaacgggtacgacccgttaggaacctacgttaccgttacggaacccggtaccgtaacccggggttaccccgtttacgtttaacgtttaaccgttcggttaccgggaaccgggtaacggttaacccggttacccccgaacgggttaacccggttaccccgggttaacgggtaacccggttacccccggtttaaaccgggggaccccgttaacggggttcccccggggtttaccccgttttttaccgggtaacccggttttttcccggggtaaccccggggggggg

SEQ ID NO: 208721 - DNA, 733 bp, Homo sapiens
  misc_feature: GYAE6OF02I8XDL.17.25.C03.1.454.CMB.1.raw
  modified_base (160)..(160): a, c, t, g, unknown or other
  misc_feature (160)..(160): n is a, c, g, or t
  modified_base (266)..(266): a, c, t, g, unknown or other
  misc_feature (266)..(266): n is a, c, g, or t
tcagcgtagactagcacgaccggtgctcgatttagtagtgtagatttgggtttgggggactcaacgaaccacatctgtcctctagagaaaaccctgtgagcacagctcctccaccatggactcggacctggaggatcctcttcttggtggcagcagctanaagtgcccactcccaggtcgcacgccgtggtcgctacgtccgtggggcctaggaggtagaagaacgccgtggggcctcgaggtgaacggtctcctgacaaggtctntggtatctacgttcctcgtaatagtatacacgtgggtctcgccgaggccgtacgtcggaacctaacgaccgtagaggttcggagtcggggtacgtccgggacctaaacccgtaagtacgttaggtcgtccaacgtacggtcgttacctaccgaacccgacgttcccgtaaccgggactaaccgtaccgttaaccctagtacgaacccggaaccgtaacccgttcctaaccaaacgtaaacctagaaccgtaaccctaaccaggtaggttaaaccgttcggaaaggaccttacccgagaaccgtaccgttacgaaccggtaccgtaaccgtaaaccgggtccgtaaccgttaagttaccgtgggacctaggaccgtacgtaccctacggacggtacccggtgggaaccctccggtaacggacgtacccggtcccggttaccgttacggacccgtttcgggaacccggg

SEQ ID NO: 208722 - DNA, 671 bp, Homo sapiens
  misc_feature: GYAE6OF02H2I2V.17.25.C03.1.454.CMB.1.raw
  modified_base (234)..(234): a, c, t, g, unknown or other
  misc_feature (234)..(234): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctccngcaaggcttcgtggtattctaccgtttacctccttaatagtatcaacgtgggtgtcgccgaggccgccgttaggaccaaccggtaccgtaggagttcggagtggggactacggggccgtaaaccccgtaacacgtggtgtacgacgtaggtgttcttaccaccctacgtcccgtaccgggactaggtaccttaccagttcgaccaaccgaactcctacctaactaaaccacacgccctaacgtgtacggagttcggaacggacgtacctagactacgtcgtacggaccgaccgtaccggtacccgttacgttagttaccgtggtaccgcgtaaccggacgttacccgtacggtaccgttacccggtggaccgttacccgtaccgggtccgaacggtcccgggtacccgttttaggacccgtttcgggtacccggggg

SEQ ID NO: 208723 - DNA, 639 bp, Homo sapiens
  misc_feature: GYAE6OF02GXYQP.17.25.C03.1.454.CMB.1.raw
  modified_base (451)..(451): a, c, t, g, unknown or other
  misc_feature (451)..(451): n is a, c, g, or t
  modified_base (474)..(474): a, c, t, g, unknown or other
  misc_feature (474)..(474): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctggaggtgaagaagccgtgggcctcagtgaaggtctcctgcaaggcttctggtattccacgtttacctcctatagtatcaacgtgggtcgcgccaggccgctggaccaacgacctgaggtggacgtgggagtcgggaccgtaaaccctacgacgtggtagtacacgtagttcgtccttaccacccctacgtcccgtaccggggacacgtaaccttacacgtcgaccacgactccacaacgtaaacacacgacctaanacgtaggtagttaggacggtacncccgtagacctagtaccgtacggaaccgaccgtaccgggtacccttacgttaacgttcgtacggacgtacgggacgtaccgtaccccgagtaaccgtcccggtagaacccggtccccaagggccgtaccggtcccggtccttttagtaccggttccgtaccgggg

SEQ ID NO: 208724 - DNA, 627 bp, Homo sapiens
  misc_feature: GYAE6OF02FVF37.17.25.C03.1.454.CMB.1.raw
  modified_base (333)..(333): a, c, t, g, unknown or other
  misc_feature (333)..(333): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtgcgccaggccgcgtggacaacgacctggagtggatgggatgggacgaaccctaanacgtggtgtcacagtcgtcttccaccctatcccgtccgggacagtaccttacattcgaacccacgaacctccctacaactaaaccacacgacccttaacagtgggtacgttaggaggtacgccgtgaacctagtcctacggaacgaccgtaccgggtccgttcttaatttaacgtggttacgacggtaacgacgttccccgaacggtaccgttcccgggtacgacccggtacccgtaccgggacctacggggtccccggttaccggtttcgtacccggtttggtacccgggggg

SEQ ID NO: 208725 - DNA, 653 bp, Homo sapiens
  misc_feature: GYAE6OF02HKQMO.17.25.C03.1.454.CMB.1.raw
  modified_base (445)..(445): a, c, t, g, unknown or other
  misc_feature (445)..(445): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctggagtaggagtgggatggggaccgaaaccctaacacgtggtatcaactggtgtaccttccaaccctacgtcccgtaccgggaacagtaccttacccatcgaacccagtaaccctcctaccaataaaccacacgaccctaanacgtagggacgttaggacgggaacgtccgtagaacctagttcctacggaaccgaccgaccgggtcccgttaacgttactttaaccgtgtcggacggaacgtacgttaccccgaaggtacgttacccgggtagtaacccggtacccgttaccgggacgtaccgggtccgggtaccccgtttttaggacccggtttccggtaccgggggg

SEQ ID NO: 208726 - DNA, 588 bp, Homo sapiens
  misc_feature: GYAE6OF02F8NUD.17.25.C03.1.454.CMB.1.raw
  modified_base (279)..(279): a, c, t, g, unknown or other
  misc_feature (279)..(279): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtncgccaggccgctggacaacgacctgagtggatggggatggggacgaaccctaacactggtgtcacagttcgtcttccacccatccctccgggacacgtacttaccatacgaccacgaactcctaccaataaacacacgacctacataggagttgaggcgcctgactatcgtacgaaccgtaccgaccgggtccgttacttaactttacgtgtacgacggaagtaccgttaccccgaacggtacgtcccggtaggacgtcccgtacgggcgaacggtccggtaccgttttcggaccgtttcggtccgggg

SEQ ID NO: 208727 - DNA, 695 bp, Homo sapiens
  misc_feature: GYAE6OF02IUF4Q.17.25.C03.1.454.CMB.1.raw
  modified_base (298)..(298): a, c, t, g, unknown or other
  misc_feature (298)..(298): n is a, c, g, or t
  modified_base (560)..(560): a, c, t, g, unknown or other
  misc_feature (560)..(560): n is a, c, g, or t
tcagcgtagactagcacgaccggtgctcgatttagtagtgtagatttgggtttggggtacgtcaacaaccacatctgtcctctagagaaaaccctagtgagcacagctcctcaccatggactggacctggagggatctcttcttggtggcagcagctacaagtgcccactcccaggtgcagctgggtgcgagtcgtggggcttggagggtaggaaggaagcctgggggcctcaggtaggaggtctcctgcaagggcttctaggattcacgtttaacctcctatagtatcaactggggngtcgacgacgggccgcgtagggacctaaccggaactggtacggtgggtagtcgggggtagttggggaccggtaaaccctaaacgtaccggtaggttccggactaccggaaggtttcggtccgttaccaaccccaagtccccggttaccggggactaacggtaacttaccctaagcggtaacccaacgtaaacccttccgtaacctaacgtaaaacccacgtacgtaaccctaagtacgtacgggtaggttacgaagggtacnccgttacgactattcgacgtacgaccgacggccgttactacgttacgtcgaggacaggtacgcccaacggcggttccggaggtaacgtccccgtaggcgacggtcccggtacgtttagtaccgttggtcccgggg

SEQ ID NO: 208728 - DNA, 605 bp, Homo sapiens
  misc_feature: GYAE6OF02HASTU.17.25.C03.1.454.CMB.1.raw
  modified_base (343)..(343): a, c, t, g, unknown or other
  misc_feature (343)..(343): n is a, c, g, or t
  modified_base (438)..(438): a, c, t, g, unknown or other
  misc_feature (438)..(438): n is a, c, g, or t
  modified_base (461)..(461): a, c, t, g, unknown or other
  misc_feature (461)..(461): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcctggggcctcagtgaaggtctcctgcaggcttctggattcacgtttcctcctatagtatcaacgtgggtgcgccaggccgcgtggacaacgacctggaggtggagtggggagtcggggaccgaaacccctaanacgtgggtcgtcacgagttcgtcttccacccactcccgtaccgggacacgtaccttaccgatacgaccacgtacctccctacaactaaacacacncctacagtggtagttagaggacnccgtagactatcgtacggaccgacgaccggtccgttacttagttacgtgtagacgacgtacccgtaccgaacgtcgtaccgggtacgacggtacccgtacggcgacggtcccggttaccgtttcggtaccgttcggtaccgggg

SEQ ID NO: 208729 - DNA, 594 bp, Homo sapiens
  misc_feature: GYAE6OF02I2S83.17.25.C03.1.454.CMB.1.raw
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcagtgaaggtctcctgcaaggcttcgtggattctacgtttacctcctatagtatcaacgtgggtgcgccgaggccgcgtggacaacgacctggagtggagtggggatcgggaccgaacctaacgacgtggtcgtcgaacgtagtcgtccttaccaccctatcccgtaccgggacacgacttaccatcgaccacgtactcctacaataacacacgacctacatggtaagttcgaggactccgtagactagtctaggacgacgaccggtccgttacttaacttacgtggtacgacgagtaccgtacccgacggtacgtccggtagaccggtaccgtacgggcacgggtccgtacgtttcgacgttcggtacgggg

SEQ ID NO: 208730 - DNA, 533 bp, Homo sapiens
  misc_feature: GYAE6OF02GGGPO.17.25.C03.1.454.CMB.1.raw
  modified_base (280)..(280): a, c, t, g, unknown or other
  misc_feature (280)..(280): n is a, c, g, or t
  modified_base (396)..(396): a, c, t, g, unknown or other
  misc_feature (396)..(396): n is a, c, g, or t
  modified_base (401)..(401): a, c, t, g, unknown or other
  misc_feature (401)..(401): n is a, c, g, or t
  modified_base (410)..(410): a, c, t, g, unknown or other
  misc_feature (410)..(410): n is a, c, g, or t
  modified_base (425)..(425): a, c, t, g, unknown or other
  misc_feature (425)..(425): n is a, c, g, or t
  modified_base (458)..(458): a, c, t, g, unknown or other
  misc_feature (458)..(458): n is a, c, g, or t
  modified_base (499)..(499): a, c, t, g, unknown or other
  misc_feature (499)..(499): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtgagtgggatgggcgaacctaacacgtggtgtcacagtgtcttcacccactccgtcggacacgacttaccatcgaccacgactccacanaaacncacgcctanatggagttgaggacnctgacatctagacgacacggcctctaatctggngacgagacgtcccacggtctcgggtacacgtccctacgggntacggtccgtacctttggaccttcggtaccgggg

SEQ ID NO: 208731 - DNA, 545 bp, Homo sapiens
  misc_feature: GYAE6OF02GXTXT.17.25.C03.1.454.CMB.1.raw
  modified_base (456)..(456): a, c, t, g, unknown or other
  misc_feature (456)..(456): n is a, c, g, or t
  modified_base (536)..(536): a, c, t, g, unknown or other
  misc_feature (536)..(536): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctaggaaaaccgcctgagtggatggggatgggcgaaccctaacacgtggtgtcacagtgtcttcacccatccctcgggacagtacttaccatcgaccacgaactcctaccaataaacacagcctacatcggagttgaggagcctgacatctagacgacacggcctntacttacgtgtcgacgagacgtcccaggtacgtccgggtagacgtccgtacggcacggccggtcctttgacgtttccggngggtcccgg

SEQ ID NO: 208732 - DNA, 618 bp, Homo sapiens
  misc_feature: GYAE6OF02HPFBZ.17.25.C03.1.454.CMB.1.raw
  modified_base (461)..(461): a, c, t, g, unknown or other
  misc_feature (461)..(461): n is a, c, g, or t
  modified_base (526)..(526): a, c, t, g, unknown or other
  misc_feature (526)..(526): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtgggcctcagtgaaggtctcctgcaggcttctggtacttctacgttttacctccttatagtatcaacgttgggtgcgccaggccgctggacaacggacctggagtggagtgggagtcggggaccgaaacccgtaacacgtgggtctacacgtagttcgttccttccaaccctactcccgtaccgggacacgtaccttaccataccgacccaacgtaaccctcctaccaactaaaccacacgtacctanacgtaggagttcgaaggacgcctgacctatcgacgacgaccgaccggtccgttacttaacttcgngtacgcgacgtaccgtcccgtaacggcgtaccgggtgaacccgtccgtaccggacacgggtccgttacgtttacggtaccgttggtccgggg

SEQ ID NO: 208733 - DNA, 740 bp, Homo sapiens
  misc_feature: GYAE6OF02JIGUL.17.25.C03.1.454.CMB.1.raw
tcagcgtagactagcacgaccggtgctcgatttagtagtgtagatttgggtttggggtacgtcaacaaccacatctgtcctctagagaaaccctagtgagcacagctcctccaccatggactggacctggaggatctcttcttggtggcagcagctacagtgcccactcccaggtgcagctggtgcagtcgtgggctgaggtagaagagctggggcctcgagtgaaggtctcctgcgaaggcttcgtgacttctacgtttacctctatagtactcactgggtgccgccgaggccgcgtaggaccaaacggtaccgtggtacggtgggagtggggtaagtcggggaccgaaacccgtaacgacgttgggtcgtcgaacctaggtttcgtccgtttaccaaccccagtttccccggtccggggaactacggtaacctttacccgattacggacccaaccgtaaacccgtcccttaaccaaacttaaaaccacccgtaacgtccccgttaaacgacgttacgggtaacggttttcgggaaacgggacggtcccgttaagaacccgttcttaccgggtaggaaacccgtacggtaccccggggtacccgtttaccttaaacggttttacgtcggttaaaggccgggtaaaccgccggtttacccaccgggtaagtccccgggttaggaccctccggtacgcggtaacggtcccgggttcttttaccggtacttccggggaacgg

SEQ ID NO: 208734 - DNA, 663 bp, Homo sapiens
  misc_feature: GYAE6OF02FLA2L.17.25.C03.1.454.CMB.1.raw
  modified_base (244)..(244): a, c, t, g, unknown or other
  misc_feature (244)..(244): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttntggattcacgtttacctcctatagtactcaactgggtgcgccaggccgcgtggacaacgacctgagtggatgggatggggaccgaacccctaacgtacgtgggtcgtacgacgtagtcgtctttaccacccctagtcccgtacccggggaactacgtaaccctttacccattcggaacccaaccggtaaaccttcccctaacccgaaactaaaaccaacgaccgacccttaacagtagggtacgttaggacggactacccgttgaactactacgtaggaaccgacggtaccggtccgttacttacgttaccgtggtacgaccggagtaccgtcccgaacggtaaccgtcccggtacggtacgtcccgttacgggccgacgggtccggttaccctttaggtaccgtttcggtaccggggg

SEQ ID NO: 208735 - DNA, 733 bp, Homo sapiens
  misc_feature: GYAE6OF02HIUPA.17.25.C03.1.454.CMB.1.raw
  modified_base (582)..(582): a, c, t, g, unknown or other
  misc_feature (582)..(582): n is a, c, g, or t
  modified_base (663)..(663): a, c, t, g, unknown or other
  misc_feature (663)..(663): n is a, c, g, or t
  modified_base (703)..(703): a, c, t, g, unknown or other
  misc_feature (703)..(703): n is a, c, g, or t
tcagcgtagactagcacgaccggtgctcgatttagtagtgtagatttgggtttggggtacgtcgaacaaccacatctgtcctctagagaaaaccctagtagagcacagctcctcaccatggactggacctggaggatcctcttcttggtggcagcagctacaagtgcccactcccaggtgcagtccgtggtgacgagtctaggggctaggaggtgaagaagcgtggggcctcgaggtcgaaggtctaccgtgacgaacggtctttacgtcgggtaatttccgtacgggtttttacccttacccgtaagttaacggttacgttacctaaacgttgggggtactcgggaccctaacgggccggcgttacgggaacctaaaccggaccttagaacgggttcggaaaggttgggggaacgtgggggaccgtaaaaccccgttaacaccggttggttacggtacaacgtaaggttcggtcttacctacccgagtacccgttcccgggggaataacggaacctttaccgatttcggacccacaaaccggtttcccaaactaaactaaacacgtactaccgttaacgangggtaaattcgggaaacgcggactacggaccagttcacggaacgtaccgaccggtcgttactaattacgttgagtaccganacgttcccacggaacgttcgggacaggacccgtaggcccnggaccggttctttacgcgttccgacggggg

SEQ ID NO: 208736 - DNA, 613 bp, Homo sapiens
  misc_feature: GYAE6OF02IO7DJ.17.25.C03.1.454.CMB.1.raw
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggaccaacgacctgagtggagtgggatggggaccgaaacccctaacgacgttgggtcgtccacgtagtcgtccttccaccctatcccgtccgggacacgacttaccatcgaccacgaactcctaccaataaaccacacgaccctaacagtaggtagttagaacggacgtccctagacctatcgtaggaaccgacgaccgggtaccgtacttacttaacgtgtacgcgagaccgtcccgaacggtacgttcccgggtagacggtacccgtagggaccgacggtcccgggtcccttttacggacccgtttcggtaccggggg

SEQ ID NO: 208737 - DNA, 570 bp, Homo sapiens
  misc_feature: GYAE6OF02GLYWM.17.25.C03.1.454.CMB.1.raw
  modified_base (445)..(445): a, c, t, g, unknown or other
  misc_feature (445)..(445): n is a, c, g, or t
  modified_base (457)..(457): a, c, t, g, unknown or other
  misc_feature (457)..(457): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaagcttctggattcacgtttacctcctatagtatcaactgggtgcgtccaggcccgctggacaacgacctgagtggatggggagtggggacgaacccctaacgactgggtctcgactagtgtcttcacccacgtccgtccgggacacgacttaccatcgaccacgaacctcctaccaactaaacacacgacctacatggtagttgaggacncgtgactatcgngacgcgaccgcgtctaattacgtgcgacgacgtacgcccgacggtctaccgggtgaccgtaccgtaccggcgtaacggtccgggttacctttcgtaccgttccggtaccgggg

SEQ ID NO: 208738 - DNA, 657 bp, Homo sapiens
  misc_feature: GYAE6OF02IQMUJ.17.25.C03.1.454.CMB.1.raw
  modified_base (243)..(243): a, c, t, g, unknown or other
  misc_feature (243)..(243): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagccgtggggcctcagtgaaggtctcctgcaaggtctcnggattcacgtttacctcctatagtactcaacgtgggtgccgccaggccgcgtcggacaacgacctggaggtggagtgggatcgggaccgtaacctaacacgttggtcgtacgaacgagttcgtccttacaccctatcccgtacggacacgtaccttaccagtcgaccgaccgtaacctaccctacaaactaaaccgacaaccgaccctaacacgtagggtacgtttaggaggtacgacctaggacctattccgtacggaaccgacccgaccgggtccttacgttacgttaacgtcggtaacgacgaacggtaccgtacccggacggtacgttacccgggtacggaaccgtacccggtaacggaccgacggggtacccggttccgttttacggtacccggtttaccggccggggg

SEQ ID NO: 208739 - DNA, 584 bp, Homo sapiens
  misc_feature: GYAE6OF02HTD1H.17.25.C03.1.454.CMB.1.raw
  modified_base (185)..(185): a, c, t, g, unknown or other
  misc_feature (185)..(185): n is a, c, g, or t
  modified_base (191)..(191): a, c, t, g, unknown or other
  misc_feature (191)..(191): n is a, c, g, or t
  modified_base (228)..(228): a, c, t, g, unknown or other
  misc_feature (228)..(228): n is a, c, g, or t
  modified_base (237)..(237): a, c, t, g, unknown or other
  misc_feature (237)..(237): n is a, c, g, or t
  modified_base (257)..(257): a, c, t, g, unknown or other
  misc_feature (257)..(257): n is a, c, g, or t
  modified_base (281)..(281): a, c, t, g, unknown or other
  misc_feature (281)..(281): n is a, c, g, or t
  modified_base (336)..(336): a, c, t, g, unknown or other
  misc_feature (336)..(336): n is a, c, g, or t
  modified_base (351)..(351): a, c, t, g, unknown or other
  misc_feature (351)..(351): n is a, c, g, or t
  modified_base (571)..(571): a, c, t, g, unknown or other
  misc_feature (571)..(571): n is a, c, g, or t
tcagcgtagactagcacgaccggtgctcgatttagtagtgtagatttgggtttggggtacgtcaacaaccacatctgtcctctagagaaaccctagtgagcacagctcctcaccatggactggactggaggatcctcttcttggttggcagcagctacaagtgcccactcccaggtgcagctggncagtcngggctgaggtgaagagcctgggctcgagtgaaggtcnctgcaaggnttctggattcacgtttaccnccgtatacgtaatcaaactgggtncgccgagccgctggacacgacctgagtcgagtgggtaactggggctaaccctaancgtgggtcaccgtanaggtctcgtacacccgattcccgccgggaatcgacttaccagactacactactctaccataaacagacgctaactagtacgagttgaggagcctagtacacgtacgtacgaaccgacgaaccggtcgtaacccgttagttaaccgtaggtacgtacgacggtaacgtcccgtaaccggaagttccgtagtccgaacccgttagcgtacgcgaccgttttnaccgttggtccgg

SEQ ID NO: 208740 - DNA, 636 bp, Homo sapiens
  misc_feature: GYAE6OF02HCHP0.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcgagtgaaggtctcctgcaaggcttctggattcacgtttacctcctatagtatcaactgggtgcgccaggccgctggaccaacgacctgaggtggagtggggatggggaccgaaccctaacgacgtggtcgtacacagtgtccttacgacccctatcccgtaccgggactacgtaccttaccatcgaccacgacctcctaccaataaaccacacgacctacagtcgggaagttggaaggacgtccgtagactactcgtagaccgacgaccgggtcccgttacttaacgtttaacgtggtaccgacggtacggtacgtccccgaacggtaaccgttcccggggtagaaccggtcccgtaaccgggtcgaccggtcccgggttacccttttagggtacccgtttccgggtaccgggggg

SEQ ID NO: 208741 - DNA, 659 bp, Homo sapiens
  misc_feature: GYAE6OF02JRBR0.17.25.C03.1.454.CMB.1.raw
  modified_base (290)..(290): a, c, t, g, unknown or other
  misc_feature (290)..(290): n is a, c, g, or t
  modified_base (310)..(310): a, c, t, g, unknown or other
  misc_feature (310)..(310): n is a, c, g, or t
  modified_base (349)..(349): a, c, t, g, unknown or other
  misc_feature (349)..(349): n is a, c, g, or t
tcagcgtagactagcacgaccggtgctcgatttagtagtgtagatttgggtttgggtaggtcgagtctcagtcaggacacagcatggacatgagggtccccgctcagctcctgggctcctgctactctggctccgagctgccagatgtgacatccagatgacccagtcctccatcctccctgtctgcctcgtggtcgggggtacaggtacgtcaccatccacttcgaccggacaaggtcacggacttaaaacctatttaaacttggtatcagcaagaaactaggaaaacnccccaagacctcgagactcnctgcgacactccactctggactaggtcggccgtccctanccggtaggtttcagggtcggactaaggtcggtatcggtagggaacaggttactttacgaactccgtacaaccgtactacacctacgtacctacgtacctaacgtacgtaaggtactttacgtagtaccttaacttacgtaaccttacttacgtactaaaccgaagttaaccggttaaccttaccgttccccgttacgtacctttaccggtttaccgaaccgggtaccgggtaccttaacggttagacggtaactaacgaaaccgtaacgtcgtacggtaccacgaccgtacctacgttacgttccttacg

SEQ ID NO: 208742 - DNA, 824 bp, Homo sapiens
  misc_feature: GYAE6OF02IMAEO.17.25.C03.1.454.CMB.1.raw
  modified_base (282)..(282): a, c, t, g, unknown or other
  misc_feature (282)..(282): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtgggcctcagtgaaggtctcctgcaaggcttctggattcacgtttacctcctatagtatcaacgtgggtcncgccaggccgctaggaccaacgacctgacgtggagtgggacgtggggaccgaaccctaacgtacgtggtactcacgtagttcgtacttccaccctagtcccgtaccggggacaacggtaccttaacccgatacggaacccctaacgtaaccctaccctaaccgtaaactaaaacccaccgtaaacggtaccccttaaacgaacgtttacgggggaacgttttacgggaaacgggtaccggtacccgttaggtaaaccgtaccttacccggtaacggtaaaccccggtaaaccccgtaacccgggggttacccctttaaccggttttaaaaccttttacccgggttaaggttacccggggtaccgtaaacgggttacccgttacccccggtaaccggttaacccgggtttacccccgggggttaaggtaaaccccgggtacccccgtttaaacccgggggacccgtaacccggggttcccggggtttaacccccggtttttacgggttaaccccggttttcccggggtaaccccggggggggg

SEQ ID NO: 208743 - DNA, 762 bp, Homo sapiens
  misc_feature: GYAE6OF02F9TEI.17.25.C03.1.454.CMB.1.raw
  modified_base (150)..(150): a, c, t, g, unknown or other
  misc_feature (150)..(150): n is a, c, g, or t
  modified_base (212)..(212): a, c, t, g, unknown or other
  misc_feature (212)..(212): n is a, c, g, or t
  modified_base (229)..(229): a, c, t, g, unknown or other
  misc_feature (229)..(229): n is a, c, g, or t
tcagcgtagactagcacgaccggtgctcgatttagtagtgtagatttgggtttggggtacgtcgaacaaccacatctgtcctctagagaaacctagtgagcacagctcctcaccatggactggacctggaggatcctcttcttggtggcngcagctacaagtgcccactcccaggtgcacgctggtgcagtctggggctgaggtgagaagcncgggctcagtgaagtcnctgcaggctctggattcacgtttacctcgtatgtactacgaacgtggtcgcgccacggccgtctagggaccaaaccggtcctacggaggtacggacggttaggggacgtacggggggaccgtaaacccccgtttaaagaaccctttaggggtcgttacccgaacgtaacggtttcggttaccctttaaccgaccccccgtaaagtttccccgggtaccccgggggtaacctaacggtaacccttttaacccgaagtttacggaaccccgaaccggtaaaccttaaccccgtaacctaacgttaaacccaaacccggactaaccgtaaccgtaacgtacggtaagttaggaacggtacgaccgtaggtactacgtaacttcgacggaccacggtaccgtacgttacgttactacggtacggtcgacgtaccgtacctaaccgggtaccgttaccgggtacggtaaccggttaccggtaaccgtaccggacgggttaccggtaccgtttccgtaaccggtttcggttacccgggg

SEQ ID NO: 208744 - DNA, 541 bp, Homo sapiens
  misc_feature: GYAE6OF02IKA7M.17.25.C03.1.454.CMB.1.raw
  modified_base (260)..(260): a, c, t, g, unknown or other
  misc_feature (260)..(260): n is a, c, g, or t
  modified_base (280)..(280): a, c, t, g, unknown or other
  misc_feature (280)..(280): n is a, c, g, or t
  modified_base (291)..(291): a, c, t, g, unknown or other
  misc_feature (291)..(291): n is a, c, g, or t
  modified_base (329)..(329): a, c, t, g, unknown or other
  misc_feature (329)..(329): n is a, c, g, or t
  modified_base (335)..(335): a, c, t, g, unknown or other
  misc_feature (335)..(335): n is a, c, g, or t
  modified_base (361)..(361): a, c, t, g, unknown or other
  misc_feature (361)..(361): n is a, c, g, or t
  modified_base (406)..(406): a, c, t, g, unknown or other
  misc_feature (406)..(406): n is a, c, g, or t
  modified_base (431)..(431): a, c, t, g, unknown or other
  misc_feature (431)..(431): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttaccncctatagtatcaactgggtncgccaggccgntggacaacgcctgagtggatgggatgggcgaaccctanactggntcacagtgtctcaccatcctcggganagacttacatcgaccacgactcctaccaataaaccacagccctanagtggagttgaggagcctgacatcngacgacacggcctactattacgtgtcgcgaggacgtcccgaacgtcgtacccgggtgaccgtcccgtaacggcacggtccggtccctttaggtacccttggtaccggggg

SEQ ID NO: 208745 - DNA, 552 bp, Homo sapiens
  misc_feature: GYAE6OF02FJZMX.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaacgccccagacctcctgatctctgtgcatccactctgcgaagtggcgtcccatcgagttcagtggcagtgatcgtggacagatttcaatctcaccatcaccactctcgcaacctgaggtatgtgctaatctactactctacaactagacgttacacgtttcccctcgtactacgttttacggcccgtaacgggggaaccctaaggttacgacggtaactaccaaaaccggtaaccgttggtacggtcctcgtaccctaccctacttaccttggttaccc

SEQ ID NO: 208746 - DNA, 749 bp, Homo sapiens
  misc_feature: GYAE6OF02JFUH6.17.25.C03.1.454.CMB.1.raw
tcagcgtagactagcacgaccggtgctcgatttagtagtgtagatttgggtttgggggtaggtcgagtctcagtcaggacacagcatggacatgagggtccccgcgtcagctcctggggctcctgctactctggctccgagctgccagatgtgacatccagatgacccagtctccatcctccctgtcctgtcctctgtgggggtcaggagtcaccagtcctacgttcgccggacaagtccaccggtacgttaaaaccttatttaaacgttggttattaccgagcgtagaaaccttaggaaaaacgcccccgaagtaccctaccctagaacttcctaccgtggttacgccaatcccaacttcctcggaccgtaaggtcgggccggttccccaagttccggaacggtttcaacgggttcgggacgaggttacgggtaactcgttagggggaaccctaaggtacttttaccgaattccttacccgaacaactccaaccctactacccggttcaccaccgttacgaagggttacttagtcgtcgaacttccttacctaacttcggtacctaacgagtacggtttaactccgtttacccctaccgtacttaaccgtttttgggacccgttaacggggggtaaccctaaccgggtttaggtaacggtaacgttacccgtaaaaaccggtaaccgtttacgggttcgggaaccttccggtaaccctacccggaactttacccgtaggttttacccc

SEQ ID NO: 208747 - DNA, 820 bp, Homo sapiens
  misc_feature: GYAE6OF02HXXLS.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggcctcgagtgaaggtctccgtgacaaggtcttcgtggattcgtaccgttttacctaccttatagtactcgaacgttggggtacgccgaccgaggcccgcgttacggaacctaacggaccgtggacggtaggacggtgggagtcggggaaccgtaacccgtaaacgtacgtgggttcgtaccgacgtacggttcggttaccttaccgaaccccgtacgttacccggtaccggggaactaaccggttaacctttaacccgacgttaccggaaccccgtaaccggtaaaccccttcccttaaacccgaaaattaaaacccgaccgtaaccggtaccccttaacgaacggttacgggtaacggtttcgggaaacgggttaccgtacccgtaggaaacctacgttaccgtaacgggaaccgtaacccgtaccgggtcccgtttacttaagtttaaccgtcggtacggtaccgggtaacgttacccggtaccccgtaacgggtaccgtttccccggggtaagtaacccggttacccccggtaaggtccggaaccgggttccccgggtttaaccttttaccgggtaccccgtttacggggtaacccgggggg

SEQ ID NO: 208748 - DNA, 853 bp, Homo sapiens
  misc_feature: GYAE6OF02GJW4C.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggagatcctcttcttggtggcagcagctacgaagtcgcccacctcccgaggtcgcgacgcgtgggtgacgtacggttcggtcggggacgtagggtaaggtaggaaacggacggtccggtcggggtcctacggtaggtacggtaacggttccttcgaggtacgtaacggtcttacggtacgttacctttaccgttaccgtttaccctagttaagtacgtacgtacgtacgggtggtcgccggtacggacggtccgacgtacggaacgacgtacgtaggtacggtggacggtcggtacgtacgggaacctaaccgtacgttacggtcgtacgtaacctacggtacggttcctccgtaacccgtaccgtacccggttacccggaacgggtaactaaccgttaaccgtaacgtaccgtaacgtaacccgaacctaacccgtacccaaaccgtaaaccaaccgaccgtaacgtaacctaacggtagtacgggttacggacgacgtacgaaccgttgaaacctcgtacggaaccgtaccgtacccgggttaccgtaaccgttacgtttaaggtaccgacgggtaaccgtaaccgggtaccgtaccccggttaccggtaaccggttccggggttaaaccgggcccggtaaacccggtcccgggtaacgtaccggggttacccgtttaacccgggttcccgttaccggggtttaccgggacccgggtaaccggggg

SEQ ID NO: 208749 - DNA, 558 bp, Homo sapiens
  misc_feature: GYAE6OF02IMM8F.17.25.C03.1.454.CMB.1.raw
  modified_base (332)..(332): a, c, t, g, unknown or other
  misc_feature (332)..(332): n is a, c, g, or t
  modified_base (421)..(421): a, c, t, g, unknown or other
  misc_feature (421)..(421): n is a, c, g, or t
  modified_base (507)..(507): a, c, t, g, unknown or other
  misc_feature (507)..(507): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgactgagtggatgggatgggacgaacccgtanacgtggtgtcacagtcgtcttccacccatccgtccggacacgtactaccatcgaccacgtaacctccgtaccaataaacacacacctanagtgagttagacgcgcagacatctgacgacaccggtccgtacttattacggtgcgtacgacgcgtacccgaaggtcgtccgggtanacggacccgtaggccgtacggtccggttaccctttgtaccgtggtccgggg

SEQ ID NO: 208750 - DNA, 571 bp, Homo sapiens
  misc_feature: GYAE6OF02ITU6Y.17.25.C03.1.454.CMB.1.raw
  modified_base (175)..(175): a, c, t, g, unknown or other
  misc_feature (175)..(175): n is a, c, g, or t
  modified_base (202)..(202): a, c, t, g, unknown or other
  misc_feature (202)..(202): n is a, c, g, or t
  modified_base (242)..(242): a, c, t, g, unknown or other
  misc_feature (242)..(242): n is a, c, g, or t
  modified_base (245)..(245): a, c, t, g, unknown or other
  misc_feature (245)..(245): n is a, c, g, or t
  modified_base (255)..(255): a, c, t, g, unknown or other
  misc_feature (255)..(255): n is a, c, g, or t
  modified_base (260)..(260): a, c, t, g, unknown or other
  misc_feature (260)..(260): n is a, c, g, or t
  modified_base (265)..(265): a, c, t, g, unknown or other
  misc_feature (265)..(265): n is a, c, g, or t
  modified_base (275)..(275): a, c, t, g, unknown or other
  misc_feature (275)..(275): n is a, c, g, or t
  modified_base (285)..(285): a, c, t, g, unknown or other
  misc_feature (285)..(285): n is a, c, g, or t
  modified_base (393)..(393): a, c, t, g, unknown or other
  misc_feature (393)..(393): n is a, c, g, or t
  modified_base (420)..(420): a, c, t, g, unknown or other
  misc_feature (420)..(420): n is a, c, g, or t
  modified_base (429)..(429): a, c, t, g, unknown or other
  misc_feature (429)..(429): n is a, c, g, or t
  modified_base (444)..(444): a, c, t, g, unknown or other
  misc_feature (444)..(444): n is a, c, g, or t
  modified_base (451)..(451): a, c, t, g, unknown or other
  misc_feature (451)..(451): n is a, c, g, or t
  modified_base (459)..(459): a, c, t, g, unknown or other
  misc_feature (459)..(459): n is a, c, g, or t
  modified_base (511)..(511): a, c, t, g, unknown or other
  misc_feature (511)..(511): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtncagctggtgcagtctggggctgaggtnaagagccgtgggcctcagtgaaggtctcctgcaagcttcnggnttcacgttcncctanagtancactgggtcncgccaggccngtcggacacgacctggagtggactgggatggggacctaacctaacgtcgtggtcgtacacgtagttcgtaccttccacctacgttcccgacgggacacgtacttaccntacgacctacgactcctaacataaacntacgcctanacgtggattcgagcncgtgacngtcagacncgacgtcctctagttacctgtcggacgtagccgtaccgagtacgttaccggngtaaccggtccctaggaccgtcgggtacccgttccgttacgtaccggttcgaaccggggg

SEQ ID NO: 208751 - DNA, 604 bp, Homo sapiens
  misc_feature: GYAE6OF02HIFZY.17.25.C03.1.454.CMB.1.raw
  modified_base (281)..(281): a, c, t, g, unknown or other
  misc_feature (281)..(281): n is a, c, g, or t
  modified_base (334)..(334): a, c, t, g, unknown or other
  misc_feature (334)..(334): n is a, c, g, or t
  modified_base (428)..(428): a, c, t, g, unknown or other
  misc_feature (428)..(428): n is a, c, g, or t
  modified_base (446)..(446): a, c, t, g, unknown or other
  misc_feature (446)..(446): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcgtggattcacgtttacctcctatagtatcaactgggtncgccaggccgctggacaacgcctgagtggatgggatgggacgaacccctaacncgtggtgtacacgagtgtcttcacccatcccgtaccgggacacgacttaccatcgaacccacgaacctcctaccaataaaccacagaccctaanacgtggacgttgaaggcncctagacattcgtagacacgaccggtccgttacttacttaccgtgtcgacgtaagacgtacccctacggtaacgttcccggggtaaacccggttcccgtaacgggccgtacggtcccgggttacccttttaggtacccgtttccgggtacccgggggg

SEQ ID NO: 208752 - DNA, 666 bp, Homo sapiens
  misc_feature: GYAE6OF02FSMNU.17.25.C03.1.454.CMB.1.raw
  modified_base (501)..(501): a, c, t, g, unknown or other
  misc_feature (501)..(501): n is a, c, g, or t
tcagcgtagactagcacgaccggtgctcgatttagtagtgtagatttggtttggggtacggtcaacaaccaccatctgtccgtcttacgaggaaaacccttcgtgtagcaccagctccctcaccgaatggactggacctggacggatccgtctttcgttggtggcctaggtcctagctacaagtagtcccaacgtcccgaggtcgcagcgtggtgcagtcgtgggctgaggtgaagagtccgtcgggcctcaggtgaggtctccgtgcaggtccttgtggacttcacggtttacctcctatagtactcaacgtgggtgcgtccacggccgcgtcggacaaccgcccgtaggaggtgggacgtggggagtcgggccgtaaacccgttaacttacgtgggtgtaccgaacgtagttcgtaccgttacacccctactccgtaccggggaacacgtaccttaccactcgaccctacgaactcctactaactaacacacgcctacngtcgtagttgaacgtacgacctgactagtcgtacgacgaccgacggcccgttacttagttactggtcgacgtagtacgttacccgacggtcgtaccggtagaccgtcccggtacggacgtacggtcccggtacccgtttacggtacccgttcggtaacccggggg

SEQ ID NO: 208753 - DNA, 598 bp, Homo sapiens
  misc_feature: GYAE6OF02I0QLS.17.25.C03.1.454.CMB.1.raw
  modified_base (444)..(444): a, c, t, g, unknown or other
  misc_feature (444)..(444): n is a, c, g, or t
  modified_base (462)..(462): a, c, t, g, unknown or other
  misc_feature (462)..(462): n is a, c, g, or t
  modified_base (543)..(543): a, c, t, g, unknown or other
  misc_feature (543)..(543): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggaccaacggacctggaggtggagtggggagtcggggaccgaacccctaagacgttgggtcgtcgacaggtcgtccttcaccccatcccgtccgggacacgaccttaccatcgacccacgaacctcctaccaataaaccacacgaccctanacgtggagttgacggacncctagacctatcgtgaaccgacgaccgggccgttacttaacttacgtcgtcgaccgagtacggtcccacggtcgttccggngaaccgcctaacgggccacggtcccggtacctttcggaccgtttcggaccggggg

SEQ ID NO: 208754 - DNA, 600 bp, Homo sapiens
  misc_feature: GYAE6OF02H1CIU.17.25.C03.1.454.CMB.1.raw
  modified_base (282)..(282): a, c, t, g, unknown or other
  misc_feature (282)..(282): n is a, c, g, or t
  modified_base (465)..(465): a, c, t, g, unknown or other
  misc_feature (465)..(465): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcgagtgaaggtctcctgcaaggcttctggattcacgtttacctcctatagtatcaacgtgggtncgccaggccgctggacaacgacctggacgtggatgggatcggggaccgaaaccctaacacgtggtgtaccacgtagttcgtccttaccaccctagtcccgtaccgggacacgtaccttaaccatcgaaccacgaacctccctaccaaataaaccacacgacctaacagtaggattggaggacncctgacagtctagacgacgacggtcctactacttacgtgtcgacgagtacgtcccgaacggtcgttcccgggtagaccgtacccgtacggcgtacgggtcccggttaccgttttaggaccctttcggaccggggg

SEQ ID NO: 208755 - DNA, 650 bp, Homo sapiens
  misc_feature: GYAE6OF02IXGSS.17.25.C03.1.454.CMB.1.raw
  modified_base (316)..(316): a, c, t, g, unknown or other
  misc_feature (316)..(316): n is a, c, g, or t
  modified_base (332)..(332): a, c, t, g, unknown or other
  misc_feature (332)..(332): n is a, c, g, or t
  modified_base (346)..(346): a, c, t, g, unknown or other
  misc_feature (346)..(346): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaaggcttctggattcacgtttacctcctatagtatcaactgggtagcgccaggccgctggacaacgcctgagtggatgggangggaccgaaccctaanacgtggctacgacngttgtctcaccccagttcccgtccgggacacgtaccttaaccacttacgaaccctaccgtaaaccttccctaaccaacttaaaacccacgaaacgtccctaaacgacggtgggaacgtttcgggaaggacgtcccgtaggacctaacgtccgttagaaccggaccgtaccggccggttacttacgtttaaccgtgtacgggacgtaggtacgtcccctaagggtaccgttaccggtggaacgtaccccggtacggaccggtacgggtcccggttacccgtttggtacccgttcggtaccggggg

SEQ ID NO: 208756 - DNA, 602 bp, Homo sapiens
  misc_feature: GYAE6OF02GIEIP.17.25.C03.1.454.CMB.1.raw
  modified_base (291)..(291): a, c, t, g, unknown or other
  misc_feature (291)..(291): n is a, c, g, or t
  modified_base (337)..(337): a, c, t, g, unknown or other
  misc_feature (337)..(337): n is a, c, g, or t
tcagcgtagactagcacgaccggtgctcgatttagtagtgtagatttgggtttggggactcaacaaccacatctgtcctctagagaaaaccctgtgagcacatctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgntggaccaacgacctgaggtggagtggggatcggggacaaccctaanacgtggtcgtcacgaggtcttcgttccaccctatcccgtaccgggacaggtaccttaccatcgaaccacgaacctccctaccaataaaccacacgacctacatggtagttgaggtacgctacgacattctagaccgacgaccggccgttacgttaacttcgtgtcggacgacgtacgtacccaacggacgttacccgggtagaaccggtaccgtaccgggactacgggccgttacccgtttcggtaccgtttccggtaccggggg

SEQ ID NO: 208757 - DNA, 666 bp, Homo sapiens
  misc_feature: GYAE6OF02HZZQA.17.25.C03.1.454.CMB.1.raw
  modified_base (276)..(276): a, c, t, g, unknown or other
  misc_feature (276)..(276): n is a, c, g, or t
  modified_base (299)..(299): a, c, t, g, unknown or other
  misc_feature (299)..(299): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgccttctggtgggggtcagagtcaccatcacttgccgacaagtcacggacgttaaaacctatttaaattggtatcagcagaaacctggaaaacncccagacctctagatctctggtncactcccactcgtagacgaagtcggccgtcccctagtcggtaggttcaggtggacaggtcgggattcggaggggtaactaggttaacttttccgaaacttccgtaccaaccattaccctaaaccctaccgttctaccggacctaaaccgttggtaacggtacgttttaggacgtacctaaacgtttccttaaaccttacgtacgtaaccaaaggtaacgtacgttttaaaccgacccgttttaccccgtcgttaccgtttaccggtttacggacccggttaaggggaaacctagggttacgtaacggtaactaacctaaacggtacgttcggagtccgtacgaccgtaaccctgttcgttcgttacc

SEQ ID NO: 208758 - DNA, 568 bp, Homo sapiens
  misc_feature: GYAE6OF02IHFKK.17.25.C03.1.454.CMB.1.raw
  modified_base (280)..(280): a, c, t, g, unknown or other
  misc_feature (280)..(280): n is a, c, g, or t
  modified_base (290)..(290): a, c, t, g, unknown or other
  misc_feature (290)..(290): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccnctggacaacgacctgagtggatggggatggggcgaacctaacactggtgtcacagtgtcttacacccatcctcgggacacgctaccatcgaccacgaactcctcaactaaacacagacctaacagtaggagttagaggacgcctagacatctagaccgacgaccggtcctacttacttaccgtgttcgacgacgtcgtacccgaaggtccgtaccggtacgacggtacccgtaacggcgaacggtccggtcctttacggtaccgttcggtaccggggg

SEQ ID NO: 208759 - DNA, 552 bp, Homo sapiens
  misc_feature: GYAE6OF02G5KF7.17.25.C03.1.454.CMB.1.raw
  modified_base (334)..(334): a, c, t, g, unknown or other
  misc_feature (334)..(334): n is a, c, g, or t
  modified_base (347)..(347): a, c, t, g, unknown or other
  misc_feature (347)..(347): n is a, c, g, or t
  modified_base (406)..(406): a, c, t, g, unknown or other
  misc_feature (406)..(406): n is a, c, g, or t
  modified_base (473)..(473): a, c, t, g, unknown or other
  misc_feature (473)..(473): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgcgtggaccaacgacctggagtggatgggatgggcgaaccctaanactgggtgtcacngtgtcttcgacccatccctccgggacagacttaccatcgaccacgactctccataaacncagcctacatggagttgaggagcctgacatctagacgacgacggccgtcttagttactggtacgcgngacgtcccaaggaccttccgggtgacggtaccctacgggcctaggcccggtcccgttttagcccgtttacggtcggggg

SEQ ID NO: 208760 - DNA, 729 bp, Homo sapiens
  misc_feature: GYAE6OF02JD1RG.17.25.C03.1.454.CMB.1.raw
  modified_base (381)..(381): a, c, t, g, unknown or other
  misc_feature (381)..(381): n is a, c, g, or t
tcagcgtagactagcacgaccggtgctcgatttagtagtgtagatttgggttttgggggactcaaacaaccacatctgtccctctacgtagaaaaccctgtgagcgacacgctccttcaccctatggactggacctggaggactctcttctggtggccaggcagctaacaagtgcccacgtcccaggtcgcgtaggctggtgcagtcgtgggtctgaggtgaacgaacgtcccgtcggggccctcacggtggaacggtccgtccgtcgaccgaacggtcttccgtggtacttacgtaccgttttacctcctagtacgttactacgtaacgtgggtacgcgaccgtacggcccgcgtacgggacaacgtaccgtaggtacgnggagtggggacgtcgggaccgaaaccctaacgacgtggtcgtactacgtagtcgtacttaccgtaacccgtacgtccgttccgggaccaacgtaccttacgacgttacgaccgaccgtaacccgtcctaacggaaacctaaacgcctaacgccttacgacgtcgtacgttaggaacggacgtccgtagactacggttcgaggaaccgaggaaccggttcctttagtaaactttcggttacggtcgtaccgacggtacccggacctaacgggctttacgggacgtacgcccggttaacggcgtacgggttaccccgtacgggtttaagacccgtttggggtaacccggg

SEQ ID NO: 208761 - DNA, 641 bp, Homo sapiens
  misc_feature: GYAE6OF02G93O7.17.25.C03.1.454.CMB.1.raw
  modified_base (282)..(282): a, c, t, g, unknown or other
  misc_feature (282)..(282): n is a, c, g, or t
  modified_base (336)..(336): a, c, t, g, unknown or other
  misc_feature (336)..(336): n is a, c, g, or t
  modified_base (349)..(349): a, c, t, g, unknown or other
  misc_feature (349)..(349): n is a, c, g, or t
  modified_base (435)..(435): a, c, t, g, unknown or other
  misc_feature (435)..(435): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcgagtgaaggtctcctgcaaggcttctggattcacgtttacctcctatagtatcaacgtgggtncgccgaggccgctggacaacgcctgacgtggatgggactggggccaaaccctanacgtggtgtacanagtgtccttccacccagttcccgtaccggactagacttacccagtcgaaccacgaacctcccgtccaataaaccacacgccctaanacgttgggaacgttggaacgggacgcctagactaacgttccgtaggaacccgacgtaaccgggtcccgttacgttaactttcgtacggtgtaccggtaacggtaccgttaccccgaacggtaccggttccgggtacgtaaccggtaccccgtacgggcccacgggtccgggttcccgtttaggtacccgtttcgggtaccgggggg

SEQ ID NO: 208762 - DNA, 718 bp, Homo sapiens
  misc_feature: GYAE6OF02JUKCB.17.25.C03.1.454.CMB.1.raw
  modified_base (188)..(188): a, c, t, g, unknown or other
  misc_feature (188)..(188): n is a, c, g, or t
tcagcgtagactagcacgaccggtgctcgatttagtagtgtagatttgggtttggggacgtcaacaaccacatctgtcctctagagaaaaccctgtgagcacagctcctcaccatggactggacctggaggatcctcttcttggtggcagcagctacaagtgcccactcccgaggtgcagctggtgcngtcgtggggctggaggtgaagaagccgtggggcctcgagtgaaggtctccgtgcgaaggtccttgtcggattccaccgttttacctccgtaactatactacctaacggtggtacgtccgccgtaggcccgcgttaggaaccgaacgtaccctggaacggttggacggttcggggaaggtaccgggggaaccgtaaaccccgtaaccgtacggtcgggtttacggaccgtacgtaggtttcgtaccttccacccgtactcccgtaccgggaacacgtacctaccacgtacgacctaaccgaacctacccgttacaacctaaaccgaccgtaacgtaccgtacgacgtaggtacggtacgtagggactacctggtacaccgtagtaccggacgacccgtaccgtaccggtacttacgttacgttcgacgtacgtaccgacgttacccgacggtaaccgtaccggtacggaccgttacgtaaccggccgtacggtcccggtttaccgttacggttacgttcccgggtacgggg

SEQ ID NO: 208763 - DNA, 703 bp, Homo sapiens
  misc_feature: GYAE6OF02GTXM0.17.25.C03.1.454.CMB.1.raw
  modified_base (332)..(332): a, c, t, g, unknown or other
  misc_feature (332)..(332): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagcctggggcctcagtgaaggtctcctgcaaggcttcgtggtattctacgttttacctccttatagtatcgaactgggtgcgccgaggccgcgtacggacaacgaccgtggaggtggagtgggngtcgggcgaaccctaacgacgtggtgtacaacgtagtcgttccttcaccccgtactcccggtaccgggaactaacgtacctttaccacgtacgaacccacgtaaacccttcccgtaaccaaactaaaaccgaccaccgtacccttaacgaacgtacgggtaagttcgaagggtacctccgttacggacctagttccgacgtaaccgacccgaccggttccgttaacctttacgttaaccgttcggtaacggtcgtaacggtacccgttaccccgacggttaccggtaccgggttcgtaccgtaaccccggttaccgggcgtacgggtcccggttttacccgttttcggtacccgtttccggggtccggggg

SEQ ID NO: 208764 - DNA, 627 bp, Homo sapiens
  misc_feature: GYAE6OF02JCMSA.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcagtgaaggtctcctgcaaggcttcgtggattcacgtttacctcctatagtatcaacgtgggtgcgccaggccgcgtggacaacgacctggaggtggagtggggagtcgggaccgaaaccctaacgacgttggtcgtcacgagttcgtaccttaccacccgatcccgtaccgggaacacgtaccttaccatacgaaccacgtaacctcctaccaaataaaccacacgacctaacagtaggtagttagacggacgtccctagaacctatcctaggaccgaaccgacggtcccgttacttaacttacgtacggtcgacgtacgtaccgtacccgagtaaccggttcggtacggaccgtcccgtaaggccgacggtccggttaccgtttggtaccgttcgggtaccgggg

SEQ ID NO: 208765 - DNA, 688 bp, Homo sapiens
  misc_feature: GYAE6OF02IZ59Q.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatccctccctgtctgcctctggtggggtcagcgtcaccatcacttcgaccggacaacgtcacggtacgttaaaacctattttaaattggtatcgagacaagaaaccgtaggaaaacgccccagaccctcctgactcgtctggtgcactccactctagacgtaaggtcggctcccagttccggaggttcagtcggctaaggtggtactcggtagggactaggttaactttacgaaacgttcctaccaccctaacttacccgaaccctaaccttccgtacgtaaccctaaccgttaggtaacggttacgttgtaccgtaacttaacttaccttaacttacgtacgtaacctaacgtaggttaaccgttaccgtacccgtttccccgtacgttacccgtttacggtttcggaacccgtaacggggttaaccctaaggttaccggaagtaaccgtaaccggaaaaccgttacgtacggttacggtactaccgtaccgtaacccgttacttaccgttcttaccg

SEQ ID NO: 208766 - DNA, 684 bp, Homo sapiens
  misc_feature: GYAE6OF02HW4CQ.17.25.C03.1.454.CMB.1.raw
  modified_base (246)..(246): a, c, t, g, unknown or other
  misc_feature (246)..(246): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaaggtctcctgcaggcttcgnggtattcgacgtttacctcctatagtatcaacgtgggtgcgccgaggccgctggacaacgccgtaggagtggagtggggagtcggggaccgtaaaccctaacgacgttgggtcgtacgacgtagttacgttccttaccaaccccgtactcccggttacccgggaactacgtaacccttaccgtaagtccgaaccaaccgtaaccctccctaacccaaactaaaccaccgaacgtaccctaacgtaacgttcggaaggtttggaacgggtaccgtacccgtaggtaacctactccgtacgaacccgaccgtacccgggtcccgttaccgtttaacgtttaccgtggtacggaccgtaagccgttaaccccgacggtacgtccggtagaccgtaccgtacggcgtacggtcccgtcgttttacgacgttcggtaccgggg

SEQ ID NO: 208767 - DNA, 735 bp, Homo sapiens
  misc_feature: GYAE6OF02F6T78.17.25.C03.1.454.CMB.1.raw
  modified_base (373)..(373): a, c, t, g, unknown or other
  misc_feature (373)..(373): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatctcttcttggtggcagcagctacaagtgcccactcccaggtgcagctggtgcagtctggggctgaggtgaagaagcctggggcctcagtgaaggtctcctgcaaggcttctggattcctacgtttacctcctatagtatcaacgtgggtgcgccaggccgctggaccacgacctggagtggagtgggagtcgggaccgaaccctaacacgtggtgtaccagtagttcgtccttacaccctnttacccgtaccggggactacggtaacccttaaccacgtacgaaccctaaccgtaaaccgttcccctaacctaaactaaaccacaaccgtacccttaacacgttagggtaagttacgggaacggtacgtcccttaggaaccttacgtaccgttacggaaccggttacgtaccggggtaccccgtttaaccgtttacgttttaaccgtacggttacgggaccggttaacggacccgttaaccccccgtaagggtaacccggtttacccggggtaccggtaaccggtacccccgttaaccggggtcctaacccggggtcccgttaacccggttttcggtaacccggtttccggtaacccgggggg

SEQ ID NO: 208768 - DNA, 581 bp, Homo sapiens
  misc_feature: GYAE6OF02HCLDQ.17.25.C03.1.454.CMB.1.raw
  modified_base (444)..(444): a, c, t, g, unknown or other
  misc_feature (444)..(444): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtgcgccaggccgctggacaacgacctgagtcggatgggatggggcgaaccctaacactggtgtcgacagtgtcttcacccatccgtccgggacacgaccttaccatcgaccacgaactccctaccaataaaccacagacctacagtggagttgaggtacgcctgacntctagaccgacgaccggtccgttacttactttacgtggtcgacgagtaccgtcccgaagtcgttaccggtacggacggaccccgtacgggccgaacggtcccggttacccttttcgggacctttccggtaccggggg

SEQ ID NO: 208769 - DNA, 561 bp, Homo sapiens
  misc_feature: GYAE6OF02GA5AZ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatgggcaaccctaacgactggtgtcactgtgtcttcacccatcccgtcggacagaccttaccatacgaccacgaacctcctaccaataaaccacacacctacagtcggtagttggaggtacgccgtagactatcgtagaacgacgtaccggccgttacttagttactgtgacgagtacgtcccgacgtcgtccggtagaccgtccgtacggcgacggccggttcgtttcggaccgttcggtcggg

SEQ ID NO: 208770 - DNA, 541 bp, Homo sapiens
  misc_feature: GYAE6OF02GXRW9.17.25.C03.1.454.CMB.1.raw
  modified_base (530)..(530): a, c, t, g, unknown or other
  misc_feature (530)..(530): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaacgccccagacctcctgatctctggtgcatccactctgcgaagtcggcgtcccatcgaggttcagtggcagtggatcgtgggacagtatttcaatctcaccatccaccactctcgacaacctgaggtattgtgactaattctactactgtacaacagtacgttacctacgttcccctcgtccttacgttttcggaccgtaacggggtaaccctaaggttcgaagtactaccgaaacgtaacgtgtggctcgaccacctntacgtgttacc

SEQ ID NO: 208771 - DNA, 593 bp, Homo sapiens
  misc_feature: GYAE6OF02F6HEQ.17.25.C03.1.454.CMB.1.raw
  modified_base (335)..(335): a, c, t, g, unknown or other
  misc_feature (335)..(335): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctctttttggtggcagcagctacaagtgcccactcccaggtgcagctggtgcagtctggggctgaggtgaagaagcctggggcctcagtgaaggtctcctgcaaggcttcgtggattcacgtttacctcctatagtatcaactgggtgcgccgaggccgctggacaacgacctgacgtggatgggatgggacgaaccctaanacgtggtcgtcacagtcgtcttcacccagtcctccgggacagtacttaccatcgaaccacgaacctccgtaccaataaaccactacgacctacactaggtagttggaacggtacgtcctagaactatcgtacgaccgacgtaccggaccgtcttacttacgtgtcgaccgtagtaccgtacccgacgtacgtccggtacgtaccgtcccgtacggccgaacggccggttaccgtttgaccgtttcggcgggtacccgg

SEQ ID NO: 208772 - DNA, 824 bp, Homo sapiens
  misc_feature: GYAE6OF02J2LHJ.17.25.C03.1.454.CMB.1.raw
  modified_base (183)..(183): a, c, t, g, unknown or other
  misc_feature (183)..(183): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttggtgcagcagctacaagtgcccactccaggtgcagctggtncagtcgtgggctggaggtagaacgacgccgttggggcctcgaggttcgaacggtcctccgtagaccgtaaggtcctttcgtacggtactttaccgtaaccgttttaccctccgttaagttacgtactaccgtaacggttggggttaccgaccggtaccgtacgggtcccgtacgttacgggaaaccctaaccggtaccgttggaacggttcgggtaacggttacggggaacggttacggggaaacccctaaaccccgttaacgtacggttcgggttacctacgtaacggtacggtttccttaccgttaacccgtaacccgttaccggttaccccggtaaccggggtaacctaaccgttaacccgtaaccgtaccgttaaccggaacccgtaacgttacccctacctaaccgaaactaaaccgtaacgaccgttaccgtaagtacggtacggtacggttacggaacggtaccgtaccaagtaaccgtacgtaccggtaacgaccggtaccgtacgggtaccttacgttacgttacgacggtcgacgtaccgtacgtacccggtagtaccggttcggaacgtacccgttcccgggaagtccggacggttacccgttacgttacggtaccggtttcgggaccgg

SEQ ID NO: 208773 - DNA, 610 bp, Homo sapiens
  misc_feature: GYAE6OF02GSB8L.17.25.C03.1.454.CMB.1.raw
  modified_base (190)..(190): a, c, t, g, unknown or other
  misc_feature (190)..(190): n is a, c, g, or t
  modified_base (216)..(216): a, c, t, g, unknown or other
  misc_feature (216)..(216): n is a, c, g, or t
  modified_base (226)..(226): a, c, t, g, unknown or other
  misc_feature (226)..(226): n is a, c, g, or t
  modified_base (250)..(250): a, c, t, g, unknown or other
  misc_feature (250)..(250): n is a, c, g, or t
  modified_base (267)..(267): a, c, t, g, unknown or other
  misc_feature (267)..(267): n is a, c, g, or t
  modified_base (279)..(279): a, c, t, g, unknown or other
  misc_feature (279)..(279): n is a, c, g, or t
  modified_base (296)..(296): a, c, t, g, unknown or other
  misc_feature (296)..(296): n is a, c, g, or t
  modified_base (298)..(298): a, c, t, g, unknown or other
  misc_feature (298)..(298): n is a, c, g, or t
  modified_base (339)..(339): a, c, t, g, unknown or other
  misc_feature (339)..(339): n is a, c, g, or t
  modified_base (436)..(436): a, c, t, g, unknown or other
  misc_feature (436)..(436): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcnggggctgaggtgaagagctgggcctnagtgaggtcnctgcaaggctgtgattcacgttcnctatagtatcactggtncgccaggtccgntgacggggacaccgtgngnggagcgggagtggggaccgaacccgtaacgtacgtcgggtntaccgacgtagttcgtcgttccaccgtactccgtaccggacagtaccttccgatcgaaccgacaaccttccaccgaataaaccacgagacccttaanacgtaggtaggtacgtacgggacgaccgtcaacgacgttacgacggtaccgaaccgacgggtacccggttacttaaacgttccttggtacggacgaccggttacgcccctaacggaccgttcggacgtacgtccgaacggcacggccgtttacgtcgtaccgttggacccgggg

SEQ ID NO: 208774 - DNA, 588 bp, Homo sapiens
  misc_feature: GYAE6OF02GDFKI.17.25.C03.1.454.CMB.1.raw
  modified_base (175)..(175): a, c, t, g, unknown or other
  misc_feature (175)..(175): n is a, c, g, or t
  modified_base (312)..(312): a, c, t, g, unknown or other
  misc_feature (312)..(312): n is a, c, g, or t
  modified_base (324)..(324): a, c, t, g, unknown or other
  misc_feature (324)..(324): n is a, c, g, or t
  modified_base (330)..(330): a, c, t, g, unknown or other
  misc_feature (330)..(330): n is a, c, g, or t
  modified_base (336)..(336): a, c, t, g, unknown or other
  misc_feature (336)..(336): n is a, c, g, or t
  modified_base (399)..(399): a, c, t, g, unknown or other
  misc_feature (399)..(399): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtncagctggtgcagtctggggctgaggtgaagagcctggggcctcagtgaaggtctcctgcaaggcttctggattcacgtttacctcctatagtatcaactggtgcgcaggccgctggacaacgcctgagtggatgggntgggcaacctanactggngtcacngtgtctcaccatcctccggacagaccttacatcgaccacgaactcctaccaataaaccacacnccctaactagtcggtagttagagggtacgcctagactagtactacggaccgtaaccgaccgggtcccgttacttaacgtttaacgtggtacgcgtacggtacgtaccccaggtacgttcccggtagaaccgcccgttaacggccgacggtcccgggtcccttttacgggaccgtttccggacccggggg

SEQ ID NO: 208775 - DNA, 620 bp, Homo sapiens
  misc_feature: GYAE6OF02JL3FS.17.25.C03.1.454.CMB.1.raw
  modified_base (220)..(220): a, c, t, g, unknown or other
  misc_feature (220)..(220): n is a, c, g, or t
  modified_base (246)..(246): a, c, t, g, unknown or other
  misc_feature (246)..(246): n is a, c, g, or t
  modified_base (285)..(285): a, c, t, g, unknown or other
  misc_feature (285)..(285): n is a, c, g, or t
  modified_base (318)..(318): a, c, t, g, unknown or other
  misc_feature (318)..(318): n is a, c, g, or t
  modified_base (458)..(458): a, c, t, g, unknown or other
  misc_feature (458)..(458): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctgggaggatcctcttcttggtggcagcagctacaagtgcccactcccaggtgcagctggtgcagtctggggctggaggtgaagagcctggggcctnagtgaaggtctcctgcaaggtcttcnggtattcctacgtttacctctatagtatcaacgtgggtncgcaggccgctggacaacgacctgagtggacgngggagtcggggacctaaaccctaacgaccgtggtcgtacaccgtgttcgttccttaccgaccctagttcccgacgggtaaccagtacccttacgactcggacctaacgtacctccctacaactaaacacctacgacctanacgtacggtagttcggaagcgacctacgactacgtctacgaccgacgaccgtccgtacttacgtacgtggtacgacgacgtacgaccctacggtacgttaccggtacgacgtacccgtaacggcgtacggtccgtaccgtttcggaccctttggacccgggg

SEQ ID NO: 208776 - DNA, 603 bp, Homo sapiens
  misc_feature: GYAE6OF02GR8VL.17.25.C03.1.454.CMB.1.raw
  modified_base (421)..(421): a, c, t, g, unknown or other
  misc_feature (421)..(421): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgcctgagtggatgggatggggacgaaccctaacactggtgtcacagtcgtcttcaccctatccgtccgggacacgtacttaccatcgaccacgaacctcctaccaataaacacacgccctanatgggagttgaagggacgccctagacctatcgtgaccgacgaccgggtccgttacttaacgttactggtgacggtaagaccgttccccgaacggtcgttcccggggtggtaaccgtacccgttaacgggcctaacggggtccccggttcctttttacggacccgtttcgggtacccgggggg

SEQ ID NO: 208777 - DNA, 749 bp, Homo sapiens
  misc_feature: GYAE6OF02INJPU.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatctacttggccggacaagtcacggacgttaaaaccttattaaattggtatcagcaagaaacctaggaaaaacgccccagaccttcctgacttccgtcgtgggtcgacacgtacccacctcgtcggacgtaacggtcgggtaccgtcccagttcggtacggtttcaggtcgggtactaggtggtaacttcgtcggggaactaaggtacttttacgaaacttcctaccaacctacgtacccctaaacccgtaacccttcgtaccgaacccttaaacccgtagggtaacggttacgtttacggtacgtaccttaaacgttacctttaaaccttaccgtacggttaacctaaaggtaccggttaacgtttaacccgttaccgtttccccctacggttaccctttacgggtttttacccggaaccgggttaaccgggggtaacccttaaagggttaccgtaacggtaacttaaacccgaaaacggttacggttacggtacggtccgtacgtaacccgtaccgtacttacgttaccgtttacccg

SEQ ID NO: 208778 - DNA, 572 bp, Homo sapiens
  misc_feature: GYAE6OF02JWMI7.17.25.C03.1.454.CMB.1.raw
  modified_base (291)..(291): a, c, t, g, unknown or other
  misc_feature (291)..(291): n is a, c, g, or t
  modified_base (337)..(337): a, c, t, g, unknown or other
  misc_feature (337)..(337): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgntggacaacgcctgagtggatgggatgggacaaccgtaacactggtntcacagtgtcttcacccatccgtccgggacagtaccttaccatcacccacgaacctcccttaccaataaaccgcacgtacctacgatcggagttgaaggacgcccttagacctagtccgtagaccgaccaccgggtccttacgttaattactggcgtaccgaaggactaccccaaggtacgttccggagaccgccgtacggcacgggcgttaccgtttcggactttccggcgggg

SEQ ID NO: 208779 - DNA, 730 bp, Homo sapiens
  misc_feature: GYAE6OF02H6I4B.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatctcttcttggtggcagcagctacaagtgcccactcccaggtgcagctggtgcagtcgtggggctggaggtgaagaagccgtggggcctcagtgaaggtctcctgcaaggcttcgtggtattcaccgtttacctccttatagtatcaacgttgggtgcgccaggccgcgtaggacaacgacctgacggtggagtgggagtcgggaccgaaccctaacacgtggtctacgacgtagttcgtccttccaacccctacgtcccgtaccgggactaacgtaccctttaaccacgtaccgacccaaccgtaacccttcccgtaacccaaacgtaaaaaccaccgtaacgaccccttaaagacgttagggtaacggtttacggaaagggtacctacccgttacgaacctaacgttacgtacggaaacccgtaccggtaacccgggtcccgtttacttaaacgtttaccgtcggtacgggaccgtaacggtacccgtacccccgaaggtaccgggttaccccggtagggtacccgtaccccggtacgggtaccgacgggtccccggttttcccttttacggtacccgtttccggggtacccggggg

SEQ ID NO: 208780 - DNA, 561 bp, Homo sapiens
  misc_feature: GYAE6OF02FYH1F.17.25.C03.1.454.CMB.1.raw
  modified_base (446)..(446): a, c, t, g, unknown or other
  misc_feature (446)..(446): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctccgtgcaaggcttctggattcacgtttacctcctatagtatcaacgtgggtgcgccaggccgcgtggacacgacctgagtggatgggatgggaccgaacctaacgacgtggtcgtcacgagtcgtcttaccaccctactccgtaccgggacacgtaccttacatcgaccacgaacctccacaataaaccacacgacctacagtggtagttgaggcncctgacagtcagacgacacgtccgtacttagtctgtgacgacgtacgacccaggtacgtccggtatccggaccgtacggcacggtccgtcctttacggtaccttcggtaccgggg

SEQ ID NO: 208781 - DNA, 644 bp, Homo sapiens
  misc_feature: GYAE6OF02GUNP4.17.25.C03.1.454.CMB.1.raw
  modified_base (283)..(283): a, c, t, g, unknown or other
  misc_feature (283)..(283): n is a, c, g, or t
  modified_base (464)..(464): a, c, t, g, unknown or other
  misc_feature (464)..(464): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcagtgaaggtctcctgcaaggcttctggattcacgtttacctcctatagtatcaacgtgggtncgcgaggccgctggaccaacgacctgaggtggagtgggagtcggggaccgaaacccgtaacgacgttgggtcgtccacgaggttcgttccttccacccctacgtcccgtccgggaacacggtaccttaccagtacgacccacgtaacctccctaccaaactaaaccacgtacgaccctaanagtggtagttagagggtactccgtagacctatcgtaggaaccgacgacccgggtccgttacttaacgtttacgtcggtacggccgtaaggtacccgtcccaacggtaccggtccgggtagaaccggtacccgtaccggcgacgggtcccggttacgtttcggacccgtttcggtccgggg

SEQ ID NO: 208782 - DNA, 596 bp, Homo sapiens
  misc_feature: GYAE6OF02HV9KR.17.25.C03.1.454.CMB.1.raw
  modified_base (343)..(343): a, c, t, g, unknown or other
  misc_feature (343)..(343): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccgaggccgctggaccaacgacctggacgtggatggggatcggggaccgaaacccctaacncgtgggtgtacacgtagttgtcttccaccctatcccgtccgggacagtaccttaaccatcgaccacgaacctccctaccaataaaccacacgaccctaacagtagggtaagttggaggacgcctagacattcgaggaaccgacgaccggccgtacttattacgtgtcgacgagacgtcccaacggcttccgggtgaccgtaccgtacgggcacgggtcccggtaccttttcggtaccgttcggtacccggggg

SEQ ID NO: 208783 - DNA, 612 bp, Homo sapiens
  misc_feature: GYAE6OF02GZFGR.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggagtgggatggggacgaaccctaacgactggtgtcacagtcgtcttcacccatcccgtcgggacagacttaccatcgaccacgaacctcctaccaataaacacacgaccctaacagttcggtaagttcggaagggacgtccctaggaacctacgttcctaggaaccgtaagttacccgggccttacttaactttaccgtggtcgcgtagaccgtcccaacggtacgtcccgggtagaaccggtcccgttaacgggcctacgggtccggttacccttttaggacccgtttccgggtaccggggg

SEQ ID NO: 208784 - DNA, 642 bp, Homo sapiens
  misc_feature: GYAE6OF02II2IQ.17.25.C03.1.454.CMB.1.raw
  modified_base (280)..(280): a, c, t, g, unknown or other
  misc_feature (280)..(280): n is a, c, g, or t
  modified_base (332)..(332): a, c, t, g, unknown or other
  misc_feature (332)..(332): n is a, c, g, or t
  modified_base (339)..(339): a, c, t, g, unknown or other
  misc_feature (339)..(339): n is a, c, g, or t
  modified_base (419)..(419): a, c, t, g, unknown or other
  misc_feature (419)..(419): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaacgtgggtncgccaggccgctggacaacgcctgagtggatgggatcgggacaaccctaacncgtggtntccagtagtcgtcttccaccctactcccgtccgggacacgtacttaccatcgaccacgaacctcccgtaccaataaaccncgaacgaccctacagtaggacgttaggaacggacgtcctacgaactacgtcgtacggaaccgtaaccgaccgggtcccgttacttaacgtttaccgtacggtcggaccgtaacggtacccgtaccccgaacggtacgttacccgggtcggaaccggtcccgttaaccgggcctaaccgggtcccggttacccgttttacggaccgtttccgggtaccgggggg

SEQ ID NO: 208785 - DNA, 578 bp, Homo sapiens
  misc_feature: GYAE6OF02GRR38.17.25.C03.1.454.CMB.1.raw
  modified_base (265)..(265): a, c, t, g, unknown or other
  misc_feature (265)..(265): n is a, c, g, or t
  modified_base (296)..(296): a, c, t, g, unknown or other
  misc_feature (296)..(296): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgactgtctcctgcaaggccagtggatatatcttcaacaaaatntggtatgaattgggtgcgacacggccccganaagggcttggaggtggggtggggtggtcgaggcggtcgtttggacggtaaggcacgtagtatcgacaaccgaagataggaacgggcaggacgtcgaacgtacttaccgacggaccaacccccgaacgaaccacacgtacacagtcgacaacgtacgacgacgcctagacgagctacggaaccgaccgacggcccgtacttacttacgtgtcggacgtagtacgtttcgttttctagttctagttaccgtattaatttcgaagttaggtccttagtagtacgg

SEQ ID NO: 208786 - DNA, 528 bp, Homo sapiens
  misc_feature: GYAE6OF02GDJ03.17.25.C03.1.454.CMB.1.raw
  modified_base (280)..(280): a, c, t, g, unknown or other
  misc_feature (280)..(280): n is a, c, g, or t
  modified_base (413)..(413): a, c, t, g, unknown or other
  misc_feature (413)..(413): n is a, c, g, or t
  modified_base (447)..(447): a, c, t, g, unknown or other
  misc_feature (447)..(447): n is a, c, g, or t
  modified_base (461)..(461): a, c, t, g, unknown or other
  misc_feature (461)..(461): n is a, c, g, or t
  modified_base (486)..(486): a, c, t, g, unknown or other
  misc_feature (486)..(486): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgcctgagtggatgggatggggcgaaccctaagacgtggtgtcacagtgtcttcacccatcctccgggacagacttaccatcgaccacgaactcctaccataaacacagcctaanatggagttgaggacgcctagacatctagacgacncggcctctattacngtgcgagcgtcccagtcgtccggtnacgtcctacggcacggccggtcctttggaccttcggtcgggg

SEQ ID NO: 208787 - DNA, 565 bp, Homo sapiens
  misc_feature: GYAE6OF02JJ7GN.17.25.C03.1.454.CMB.1.raw
  modified_base (463)..(463): a, c, t, g, unknown or other
  misc_feature (463)..(463): n is a, c, g, or t
  modified_base (471)..(471): a, c, t, g, unknown or other
  misc_feature (471)..(471): n is a, c, g, or t
  modified_base (485)..(485): a, c, t, g, unknown or other
  misc_feature (485)..(485): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcgtggattcacgtttacctcctatagtatcaacgtgggtgcgccaggccgctggacaacgacctgagtggagtgggagtcgggacgaaaccctaacgacgtggtcgtcacgagttcgtcttccgacccacgtcctccggggaacacggtacttaccatacgaccacgaacctcctacaactaacacagacctacatggagttggaggacgcctagacatcngaccgacncgccgtctagttcngtgacgagtacgtcccacgtacgtccggtgacgtccgtacggccgaggcccggtaccgtttcgaccgttcggtaccgggg

SEQ ID NO: 208788 - DNA, 684 bp, Homo sapiens
  misc_feature: GYAE6OF02I8C7S.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaagtctcctgcaaggcttcgtggattcacgtttacctcctatagtatcaacgtgggtgcgccgaggcccgcgtcgggaccaacggacctggaggtcggagtggggatcggggaccgtaaacccgtaacgacgtggtcgtacgacgtaggtgttccttaccgacccctagtcccgtaccgggactacgtaaccttaccagtacgaccacgtaaacccttccctacctaactaaaccacgtacgaccctaagacgttgggtaacgttggacggtacgtcccgtagacctacgtcgtacggaaccggtaccgtacccgggtccttaaccgttaacgtttacgtggtacgtacgtacggtacccgtcccgaacgggtcttacccggggagtacccgtacccgttaaccgggaccgtaccgggtcccggttacccgttttacggtacccgtttcgggtacccggggg

SEQ ID NO: 208789 - DNA, 703 bp, Homo sapiens
  misc_feature: GYAE6OF02GNSTA.17.25.C03.1.454.CMB.1.raw
  modified_base (259)..(259): a, c, t, g, unknown or other
  misc_feature (259)..(259): n is a, c, g, or t
  modified_base (288)..(288): a, c, t, g, unknown or other
  misc_feature (288)..(288): n is a, c, g, or t
  modified_base (329)..(329): a, c, t, g, unknown or other
  misc_feature (329)..(329): n is a, c, g, or t
  modified_base (342)..(342): a, c, t, g, unknown or other
  misc_feature (342)..(342): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcgagtgaaggtctcctgcaaggctctggattcacgtttaccncctatagtatcaactggtgcgccaggccncgtggacaacgcctgagtggatgggatgggacaaccctaanacgtggtcgtcanagtcgtcttcacccactccgtcgggaacagtaaccttaccgatacgaaccaacgtaaccctcccgtaacctaaactaaaacctaccgaacgtccctaactaggttacggtaacggttaggaacggaccgtaccgtacgaactaacgttcgtacggaaacccgtaccggtaaccccgggttccgttaaccgtttaactttaccggttacggtacggtaccgggtaacgtacccggttaccccgtaaacgggtaccgggttaacccgggttacggaaccggtaccccggtttaaccgggacccgttacgggtaccccgggtttaccccttttcgggtacccgtttcgggtaaccccggggggg

SEQ ID NO: 208790 - DNA, 899 bp, Homo sapiens
  misc_feature: GYAE6OF02H1PEC.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatctcttcttggtggcagcagctacaagtgcccactcccaggtgcagctggtgcagtctggggctgaggtgaagaagcctggggcctcgagtgaaggtctctgcaaggcttctggattcacgtttacctccttatagtatcaacgttggggtcgcgtccgaagggtcccgcgttacgggaacctaaaccggtaacccgttggaacggttacgggaggttacgggggaagttacgggggacccgtaaaacccccgttaaacgaccgttacgggttacgtaccaaccgttaggtttacggttacctttacccgtaacccccgtacgttacccccggtacccgggggaaaccctaacggtaaccccttttaaacccgaacgtttacccgggtaaaccccgaaccggtaaaccccgtttaccccctaacccgtaaaaccgtaaaaacccacccgtaaacggtaccccttaaaccgaaggtttacggggtaaacggtttacgggaaagggtaccggtacccttacgggaaacctaacggtttacccgtacgggtaaacccgggtacccgtaaacccgggggtccccttacgtttaaaaccgtttaccggtacgggttacggaacccgggtaaggtacccccggttaccccgtaaacgggtaccgtttacccccggggttagaaccggttaacccccggttaccggggaccgtaaccggggtaccccggttttaccttttaacgggtaccccgtttcgggttaaccccggggggg

SEQ ID NO: 208791 - DNA, 618 bp, Homo sapiens
  misc_feature: GYAE6OF02FRLJF.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcctggggcctcgagtgaaggtctcctgcaaggcttctggattcacgtttacctcctatagtatcaactgggtgcgccgaggccgctggacaaccgacctgagtggagtgggatggggccgaaccctaacgactggtgtcacgagtgtcttcacccatccgtaccggacacgtacttacatcgaccacgaactcctaccaactaaacacacgaccctaacatacgggtagttggacggtacgtcccgtagacctacgttccgtacggaaccgaccgtacccgggcccgttcgttaactttaccgtggtacggacgtacgacgtccccgaacggtacgttccgggtacgaccggtacccgtacgggccacgggtcccggttacccgtttcggtacctttcggtaccggggg

SEQ ID NO: 208792 - DNA, 518 bp, Homo sapiens
  misc_feature: GYAE6OF02FUMQH.17.25.C03.1.454.CMB.1.raw
  modified_base (290)..(290): a, c, t, g, unknown or other
  misc_feature (290)..(290): n is a, c, g, or t
  modified_base (328)..(328): a, c, t, g, unknown or other
  misc_feature (328)..(328): n is a, c, g, or t
  modified_base (334)..(334): a, c, t, g, unknown or other
  misc_feature (334)..(334): n is a, c, g, or t
  modified_base (340)..(340): a, c, t, g, unknown or other
  misc_feature (340)..(340): n is a, c, g, or t
  modified_base (397)..(397): a, c, t, g, unknown or other
  misc_feature (397)..(397): n is a, c, g, or t
  modified_base (418)..(418): a, c, t, g, unknown or other
  misc_feature (418)..(418): n is a, c, g, or t
  modified_base (449)..(449): a, c, t, g, unknown or other
  misc_feature (449)..(449): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtgcgccaggccgntggacaacgacctgagtggatgggatgggcgaacctanactggngtcacngtgtcttcacccatcctcgggacagacttaccatcgacacgaactcctacataaacncagcctacatggattgaggancctgacatctgacgacacggcctctattacngtgcgagacgtcccacgtcgtccggtagacgccgtacggcaggccggtctttcggacttcgtacggggg

SEQ ID NO: 208793 - DNA, 853 bp, Homo sapiens
  misc_feature: GYAE6OF02JWG76.17.25.C03.1.454.CMB.1.raw
  modified_base (152)..(152): a, c, t, g, unknown or other
  misc_feature (152)..(152): n is a, c, g, or t
  modified_base (155)..(155): a, c, t, g, unknown or other
  misc_feature (155)..(155): n is a, c, g, or t
  modified_base (381)..(381): a, c, t, g, unknown or other
  misc_feature (381)..(381): n is a, c, g, or t
tcagcgtagactagcacgaccggtgctcgatttagtagtgtagatttgggtttggggtacgtcgaacaaccacatctgtcctctagagaaaccctagtgagcacagctcctccaccatggactggacctggaggatcctcttcttggtggcngcngctacaagtgcccactcccaggtgcagctggtgcagtcgtggggctggaggtggaagaaggccgtggggccttcgaaggttgaagggtctccctggaccgaagggtcttcgtacggtattaccgtacgtttacctccgttacttaaggtacttacaaccggttgggtcgccgaccgacggcccggtcgtacgggaccgtaacggtaaccctggaaggtcggtacgnggggtaggtcggggccggtaaccctaacggtaccgtggttcgtacacgtaacgtggttaccttaccgtacccctaacgtttcccgcccgggggtaaacaccggttaacccgttacctaacgtacccgaaccctaccggtaaaccccttccgtttaaccccaaaacttaacccgaactaacccggtaccttaaacccgacgttgggtaacgttagggtaaccggagttacccgacggtaacctacttacccggttacggaaccggtaccccgtaaccgggggtcccttaacgtttaaccttaacggggttaacttcgggtaacccgggtaacggttaccgttaccccgtaaccggggttaaggttacccccgggttagggtaacccccggaccgggttaaccccgcggggttaaccggtccccgggttaaccccggttttccgggacccggtttacccgggttacccgggggg

SEQ ID NO: 208794 - DNA, 567 bp, Homo sapiens
  misc_feature: GYAE6OF02F8LYW.17.25.C03.1.454.CMB.1.raw
  modified_base (280)..(280): a, c, t, g, unknown or other
  misc_feature (280)..(280): n is a, c, g, or t
  modified_base (420)..(420): a, c, t, g, unknown or other
  misc_feature (420)..(420): n is a, c, g, or t
  modified_base (434)..(434): a, c, t, g, unknown or other
  misc_feature (434)..(434): n is a, c, g, or t
  modified_base (445)..(445): a, c, t, g, unknown or other
  misc_feature (445)..(445): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacacgacctgagtggatggggatggggacgaaccctaacactggtgtcacagtgtcttcacccatccgtccgggacagaccttaccgatcgaaccacgtaactcctccaataaacacagaccctanatggagttgaggtncctagacatcnggaccgacacggccgttactattacgtggttcgacgtagacgttacccaaccggtactacccgggtgaccggtaccctacgggcacggtccgggtcctttcggtaccgttcggtaccggggg

SEQ ID NO: 208795 - DNA, 687 bp, Homo sapiens
  misc_feature: GYAE6OF02I3IYL.17.25.C03.1.454.CMB.1.raw
  modified_base (496)..(496): a, c, t, g, unknown or other
  misc_feature (496)..(496): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctgaggtgaagagccgtagggcctcagtgaaggtctaccgtgacaaggtctcgtagtacttcacgtttacctcctaattagtactacaacgttggggtcgccgccgaggcccgacgttaggaaccaaccggacctggaggttggagtagggagttacggggacccgtaaacccctaacgacgttagggtactacctaacggtagtttcgtccttacccgacccctaagttcccggtaccgggacacggtaccttaccacgtacgaaccacgtaacctcctaacaataaccacacgacctanacgtaggtaacgttacggacgtacgcgtagtacacgttacgagaccggtaacgacccggggtacttacgttacgtttaaccgtgtaccgacgtacgaccggttacccaacggtcgtacccgggttacgaaccggtccctaacgggccgaacggttccgggttacctttacgggtaccttcgggtaccgggg

SEQ ID NO: 208796 - DNA, 612 bp, Homo sapiens
  misc_feature: GYAE6OF02IORJ5.17.25.C03.1.454.CMB.1.raw
  modified_base (279)..(279): a, c, t, g, unknown or other
  misc_feature (279)..(279): n is a, c, g, or t
  modified_base (330)..(330): a, c, t, g, unknown or other
  misc_feature (330)..(330): n is a, c, g, or t
  modified_base (337)..(337): a, c, t, g, unknown or other
  misc_feature (337)..(337): n is a, c, g, or t
  modified_base (430)..(430): a, c, t, g, unknown or other
  misc_feature (430)..(430): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggngcgcaggccgctggacaacgactgagtggatgggatgggccaaccgtaacncgtggtntcacgagtgtcttcacccgtatcccgtccgggaactacgaccttaccagtcgaaccacgtaacctcctaccaataaaccactacggccctaancgtaggtacgttaggacggtagtcccgtgaacctgtacgcgggaaaccaccgaccgggtcctacttaacgttacgtggacgacggagtaccggtaccccaggtacgttaccgggtaggaaccgtccccggttaaggccacgggtcccggttaccgttttcggaccgtttcggaaccgggggg

SEQ ID NO: 208797 - DNA, 678 bp, Homo sapiens
  misc_feature: GYAE6OF02FZIOK.17.25.C03.1.454.CMB.1.raw
  modified_base (251)..(251): a, c, t, g, unknown or other
  misc_feature (251)..(251): n is a, c, g, or t
  modified_base (288)..(288): a, c, t, g, unknown or other
  misc_feature (288)..(288): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctaggaggtgaagaagccgtggggcctcaggtgaaggtctccgtgcaaggtcttcnggattctacgtttacctctatagtatcaacgtgggtnccgccgacggccgctggacaacgacccgtggagtggagtggggaagtcggggaaccgaaacccgttaacgaccgttgggtacgtacaacgtaggttcgttccttaccaccccgtacttcccggtaccgggaactaacggtaaccctttaaccgaactcgaaaccccgacgtaacctccctaaccaaacgtaaaccacacgacctaacgagtcgggaagttgggaacgtacgaccgtgactacgtcgtacggtaaccgcgtaaccggtccttacttacgttaccgtaggtacgacgaacgtccgtacccgtacggtacggtaccggttggaaccgtaccgttacggaccgtacggtccccggttctttacggtaccgttcggtacccgggg

SEQ ID NO: 208798 - DNA, 587 bp, Homo sapiens
  misc_feature: GYAE6OF02GCYOU.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacgttaaaacctatttaaattggtatcagcagaaacctggaaaacgccccagacctcctgatctctggtgcactccactctggacgtaaggtcggccgtcccagtcggaggttcaggtggcaggtggatcgtgggacagtatttacaatcctacacctactcacctactctcgaccaaccgttgaaggtattcgtagactaacttccttaacctactcgacaaactaggtacgttaaccaccgtttcccctcgtacttacgtttcggaccgtaacggggtaacctaaggttcgaacgtaacttaaccgaaacgtaacgttggtaggtctacggacctacctacgttcctcgttac

SEQ ID NO: 208799 - DNA, 796 bp, Homo sapiens
  misc_feature: GYAE6OF02H0OP6.17.25.C03.1.454.CMB.1.raw
  modified_base (282)..(282): a, c, t, g, unknown or other
  misc_feature (282)..(282): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtgggctcgagtgaggtctcctgcaaggcttcgtggacttcacgtttacctctatagtatcaacgtgggtnccgcgaggccgctaggacaacgactgagtcgagtgggagtcgggaccaacctaagcgtggtcgtcacgtagttcgtcttacacccgtactccgtacgggactaacggtaacctttaccgagttaccgaacccgtaacgtacccttacccgtaaccctaaaacgttaaaacccgaaccgtaaccgtacccgtaaaaccgtacggtttaggggtaaacggttacgggaaaccgggtaacgttacccgttaaggaacctaaccgtttcgtaaccgggaacccggtaacccggtaaaaccccggggttccccgtttaaccgttttaaccggttttaaccggtacggttaccggggtaaccgtaaaccgggtaccccggtttaacccccgtaacgggtaaccgggttaccccgggttacgggtaacccgtaacccccggttaacgggaccccgtaccggggttaccccggtttaccccggtttttaggtaccccggttttaccgggaaccccggggggg

SEQ ID NO: 208800 - DNA, 626 bp, Homo sapiens
  misc_feature: GYAE6OF02GVWMS.17.25.C03.1.454.CMB.1.raw
  modified_base (284)..(284): a, c, t, g, unknown or other
  misc_feature (284)..(284): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcgagtgaaggtcctcctgcaggcttctggattcacgtttacctcctatagtatcaacgtgggtncggccaggccgctggacaacgcctggagtggatggggactcgggaccaaccctaagacgtggtcgtcacgtagttcgtcttaccacccgtactcccgtacgggactagtacctttacagtcgaacccacgaacctccctaccaaactaaacccacacgaccctaagtactgggacgttaggagacgtccgtagactactcgtacgaccgaccgtaccggtacccgttattacttacgtgtacgccgtaagtccgtacccgaccggttacgtccgggtacggaccggtcccgtaacgggccaaccgggtccggttaccgttttacgccgttcggtaccggggg

SEQ ID NO: 208801 - DNA, 745 bp, Homo sapiens
  misc_feature: GYAE6OF02GG902.17.25.C03.1.454.CMB.1.raw
  modified_base (307)..(307): a, c, t, g, unknown or other
  misc_feature (307)..(307): n is a, c, g, or t
  modified_base (675)..(675): a, c, t, g, unknown or other
  misc_feature (675)..(675): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtacccacctcccaggtgcagctggtgcagtctgaggctgaggtgaagagccgtggggcctcgagtgaaggtctccgtgacgaaggtcttcgtggtacttcgtacgtttacctcctatagtactcaacgtgggtcgcgccgacggccgngtcggacaacggacctggagtggagtgggagtcgggaccgaacctaacgacgtggtcgaccgagagttcgttcctaccgaccctacgtccggtaccggacacgtaccttaccgactacgaacccaacggtaaccttccctaccgaaaactaaaccacgtaccgtaccctaacgagttagggttaaccgtagggaacggtccgtacccttagaccttaacgtccgtaagaacccggaccggtaccggttacccgttacgtttaatttacccggaggtttccggaacggtaaccggttacccgttaccccggaacggtttaaccggttcccggggaaggttaaccccggtccccggttaaacccgggggnttaccccgggggttaccgggtttaccccgttttaacgggttaccccggttttgggggaacccccgggggg

SEQ ID NO: 208802 - DNA, 524 bp, Homo sapiens
  misc_feature: GYAE6OF02JIFQB.17.25.C03.1.454.CMB.1.raw
  modified_base (280)..(280): a, c, t, g, unknown or other
  misc_feature (280)..(280): n is a, c, g, or t
  modified_base (311)..(311): a, c, t, g, unknown or other
  misc_feature (311)..(311): n is a, c, g, or t
  modified_base (332)..(332): a, c, t, g, unknown or other
  misc_feature (332)..(332): n is a, c, g, or t
  modified_base (338)..(338): a, c, t, g, unknown or other
  misc_feature (338)..(338): n is a, c, g, or t
  modified_base (422)..(422): a, c, t, g, unknown or other
  misc_feature (422)..(422): n is a, c, g, or t
  modified_base (433)..(433): a, c, t, g, unknown or other
  misc_feature (433)..(433): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggntgggatgggacgaaccctaanctggtntcacagtgtcttcacccatcctccgggacacgtactaccatcgaccacgactcctccaataacacagcctaacatggagtgagngcctgacatcngacgacacgccgtacttactcgtagtgcgagactccgagtacgtccggtgacgtcctacggcacgcgtcccgtttgaccgttcgtacgggg

SEQ ID NO: 208803 - DNA, 596 bp, Homo sapiens
  misc_feature: GYAE6OF02HM4HS.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctcgagtgaaggtctcctgcaggcttctggattcacgtttacctcctatagtatcaactgggtcgcgccgaggccgctggacaacgacctggacgtggagtgggatcggggacaaacccgtacacgtgggtgtacacgagtcgtcttccacccatccctacgggacacgaacttaccgatacgacccacgaaccttccctaccaaagtaaaccacgacaccctaacagtaggtagttcgaggcgtaccgtgaactactcgacgaccgtacaccggtccgttaacttagttaccgtggtacgagacgtacgtcccaacggtacgtcccggtgacgtcccgtacgcgtaccggtccggtcctttaggaccgtttcggaccgggg

SEQ ID NO: 208804 - DNA, 608 bp, Homo sapiens
  misc_feature: GYAE6OF02GYU0A.17.25.C03.1.454.CMB.1.raw
  modified_base (276)..(276): a, c, t, g, unknown or other
  misc_feature (276)..(276): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagatacaagtacccactcccaggtgcagctggtgcagtcgtggggctgaggtgaagagcgtgggcctcagtgagtctctgcaggcttctggtacttctacgttacctctatagtatcacgtgggtncgcacggccgcgtcggacaacgcgtgaggtggagtgggacgtcgggaccgaaccctacgtacgttcggtcgtacgacgtagtcgttcttaccacctactcccggtaccgggactacgacttaccacgtacgaccaacgtaccctcctacaactaaaccacacgtacctactaacgtggtacgtaggacggacgtcctagactactcgacgaccgacgccggtaccttattacgttacgtcggtcacggtacgtacctaccgacggtcgtcgggtacgtaccgaccgtacggcgtaccggtccggttccgttcggacgttccggacgggccgg

SEQ ID NO: 208805 - DNA, 626 bp, Homo sapiens
  misc_feature: GYAE6OF02HJ975.17.25.C03.1.454.CMB.1.raw
  modified_base (295)..(295): a, c, t, g, unknown or other
  misc_feature (295)..(295): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagccgtggggcctcgagtgaaggtctcctgacgaaggcttctggattcacgtttacctcctatagtatcaacgtggtgcgcacggccgntcggacaacgaccgtgagtggagtgggatggggaccaaccgtaacacgtggtcgtcaacgtagtcgtcttaccacccgtactcccgacgggacacgtaccttaccatcgaaccacgaactcctaacaataaaaccacgacacctaacagtacggtagttacggagacgtcctagaactacgtcttaacggaacccgacgtaacccgggtcccttacgttaactttaaccgtgttacgacgaacggtccgtacccgacggtacggtccggtacgaccgacccgtaaccggcggtacggccggttaccctttaggtaccgttccggtacgggg

SEQ ID NO: 208806 - DNA, 720 bp, Homo sapiens
  misc_feature: GYAE6OF02HNCIW.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcgagtgaaggtctcctgcaaggcttcgtggattcacgtttactcctatagtatcaacgtgggtacgcgccaggccgcgtcggacaacgaccgtggacgtggactggggatcgggacgaaaccctaacgacgtggtgtaccacgtagtgtaccttcacccgactcccgtaccgggactacggtaccttaccatcgacccaacgtaacctccctacctaaacaaaccacaacgtaccctacacgtagggaattcggagggacgtaccctaggacctaacgttccgtacggaacccggaacccgtacccggggtacccgttaccgtttaaagttacccgttaggttaccgggaccgtaacgtacccggttacccccgtaaacccggtcggttaccccggggtttaggaaccggtacccccggtttaaccggggaccctaaccggggttcccgggtttacccccggttttttacgggaacccgttttcccggggtacccggggggg

SEQ ID NO: 208807 - DNA, 809 bp, Homo sapiens
  misc_feature: GYAE6OF02I2GZT.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgccccactcccaggtgcgacgtcggtggtcgacgtacgttcgggtcgggtcgtagggtagggtaacgaaacggaccgtccggggtccgggtccctacggtaggtaacggtaccgttcccgttccgtcgaacggtacggttccttcggtaggttaccttaccgtttacccgttacccttacgttaagttagtactaacgtacgggtgggtccgccgaccggacggcccgtcggtaacggaaccgaaccgtccgtaggtggtaggtgggtagggtagggtaccggtaaacccgtaaaccctacgtcggttcggtaccgtacacgttacgtttccgttccctacccaacccgttaccgtcccgggaccgaacgtaccttacctaccgtcgtaacccgaacccgtaaccttacccctacctaactaaactaaccgacgccgtaacctagaggtacggttaggtaacggacgtcctcgaacactacgtcggtaaccgacccggacggtcccgttctttaacgtttaccttacggcggtaccgacggttacgtaccccgacccggtaaggtcccggtttggaaccggttcccaaccgggttaccgccggttccggttcccgtttaccgtacgttcccgggtacgggtcccggggg

SEQ ID NO: 208808 - DNA, 764 bp, Homo sapiens
  misc_feature: GYAE6OF02JGW8Z.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcgagtgaaggtctcctgcaaggcttctggattcacgtttacctcctatagtactcaactgggtagcgccaggccgcgtacggacaacgacctgacgtggagtgggagtcgggacaaccgtacacgtgggtctacacgtagtcgtccttaccaccctaacgtcccgtaccggggaacctaacggtaacccttaaccgacgtacgaaaccccgtaccgtaaacccttcccgtaacctaaaaccgttaaaaccgaaacctaaaccgggtacccttaaaccgtaacggttagggttaacggtttacgggaaccgggtaacgtacccgtacgtaaacctacgttaccggtacggtaacccggtaaaccgtaccggggaacccgtttaccgttaaaccgtttaccggttacggtaccgggaccggtaacggtacccggttacccccggtaacggtaacccggttcccgggtaaggaccggtacccggttaaccgggaccgtacgggtacccgggttaccgttttacggtaaccggtcccggttaccgggggg

SEQ ID NO: 208809 - DNA, 922 bp, Homo sapiens
  misc_feature: GYAE6OF02FXM3Q.17.25.C03.1.454.CMB.1.raw
  modified_base (279)..(279): a, c, t, g, unknown or other
  misc_feature (279)..(279): n is a, c, g, or t
  modified_base (290)..(290): a, c, t, g, unknown or other
  misc_feature (290)..(290): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagccgtgggcctcagtgaggtctcctgcaaggcttctggacttcacgtttacctcctatagtatcaactgggtncgccaggccgntcggacacgacctgaggtggatgggagtgggacccgaaacctaacacgtcggtcgtcacgtagtcgtccttcgacccctctcccgtaccgggacacgtaccttaaccgctacgacccacgtaacctccctacaaacgtaaccacgtacgtaccctaacgtagtacggtacgttacgggacggtacgtacccgtagtaacctacgttacccggtacgaacccggtaccgtaacccggggttaccccgtttaccgtttaaaacgtttacccggtttacgggttaacggaaccccggggtaaaggtttaccccccgggttaacccccggtaaacccggggtttaaaccccggggtttttaacccccccccgggggggggttttaacggggtaaaaacccccccgggggttttaaaccccccccggggggtttttaaacccccccggggggggtaaaacccggtttttaaccccccccgggggggggggggttttacccccccccgggggtttttttaaaaccccccgggggtttttttttttttaccccccggggggttaaaaccccccccgggggggtttttttttttccccccgggggggggtaaaacccccccccggggggggggggggggg

SEQ ID NO: 208810 - DNA, 615 bp, Homo sapiens
  misc_feature: GYAE6OF02I8UB5.17.25.C03.1.454.CMB.1.raw
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
  modified_base (338)..(338): a, c, t, g, unknown or other
  misc_feature (338)..(338): n is a, c, g, or t
  modified_base (412)..(412): a, c, t, g, unknown or other
  misc_feature (412)..(412): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcagtgaaggtctcctgcaaggcttcgtggacttcacgtttacctcctatagtatctaacgtgggtcncgccaggccngtggacaacgcctgagtggatgggatcgggacgaaccctanacgtggtcgtacacgtagtgtcttcacccatccgtacgggacagacttaccatacgaccacgacctcctacaanaaactacacgacctacacgtggtaacgttggaacgggtacaccgtggaacctgtacgtagaccgtaacaccggtccgttacttaacgttaccgtgtacgacgtacgtaccgtacccgtaacggcggttaccggaggtaaacccgtcccgttaaccggcggtaccggccggttaccgtttacggtaccgttcggtacccggggg

SEQ ID NO: 208811 - DNA, 556 bp, Homo sapiens
  misc_feature: GYAE6OF02G4HDW.17.25.C03.1.454.CMB.1.raw
  modified_base (347)..(347): a, c, t, g, unknown or other
  misc_feature (347)..(347): n is a, c, g, or t
  modified_base (411)..(411): a, c, t, g, unknown or other
  misc_feature (411)..(411): n is a, c, g, or t
  modified_base (420)..(420): a, c, t, g, unknown or other
  misc_feature (420)..(420): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaaggcttctggattcacgtttacctctatagtatcaacgtgggtgcgccaggccgctggacaacgacctgagtggatgggatgggacaaccctaacacgtggtgtacacagtntccttacacccatccgtaccggacacgtacttaccatcgaccacgacctcctaccaataaaccncacgcctanagtggagttggagacgccgtagacatctacgacgaccgacgaccttactacgttctgtgacgacgacgtccccgaggcgttccgggagtaccgcccgtaggcgacggtccggtccgtttgccgttcggtaccgggg

SEQ ID NO: 208812 - DNA, 741 bp, Homo sapiens
  misc_feature: GYAE6OF02I6UV8.17.25.C03.1.454.CMB.1.raw
  modified_base (298)..(298): a, c, t, g, unknown or other
  misc_feature (298)..(298): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagcgtggtgcagtctggggctgaggtgaagaagcctgggcctcagtgaaggtcctccgtgacgaaggtcttcgtggtacttcaccgtttacctctatagtatcaacgtggtgcgcaggtccncgtaggaccaacggtacctggacgtggtacgtggggtaacgtcggggaccctaaacccgtaacgacgttcggtcgtactacgaggttcgtacctttacccgacccgtaacgtcccggtaccggggaactaacgtacccgtttaaccacgtttaccgaaccctaaccggtaaacccttaccccgtaacctaaactaaaacccaccgtaaacggtaccccttaaacgtaggttaaccggttaacgggttaacggaacgggtaccgtaaccccgtggtaaacccttacgttaccgtacggtaacccgaccgtaccgggtccgttaacttactttacggagttaccgggacgtaaccgtaccgtacccggtacgtccggttcccggtagcccggtcccgaacggcgtacggtacccggttacctttcggttaccgttcggtacgggg

SEQ ID NO: 208813 - DNA, 744 bp, Homo sapiens
  misc_feature: GYAE6OF02G8CEH.17.25.C03.1.454.CMB.1.raw
  modified_base (217)..(217): a, c, t, g, unknown or other
  misc_feature (217)..(217): n is a, c, g, or t
  modified_base (289)..(289): a, c, t, g, unknown or other
  misc_feature (289)..(289): n is a, c, g, or t
  modified_base (301)..(301): a, c, t, g, unknown or other
  misc_feature (301)..(301): n is a, c, g, or t
  modified_base (357)..(357): a, c, t, g, unknown or other
  misc_feature (357)..(357): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctggggcctnagtgaaggtctacctgacaaggtcttctggattcgtacgtttacctccttatacgtatccaacgtggggtcncgccaggcccgnttcgggacaacgacctgacgtggacgtgggatggggacaacccgtacacgtgggtntccacgtagtcgtccttacgaccctacgtccgttaccggggaactaaggtaccctttaaccgagttaccggaacccgaaccgtaaccctttacccgtaacccgtaaacttaaaaacccgacgtaaaccggtacccctaaaccgaggttacgggtaaacgtttcgggaagggaaccggtacccctttagggaaccttacggttccttaacggggaacccgaaaccggtacccgggtcccgtttaacctaacgtttaaccgtgggttaacgaccggtaacgtacccgggttcccaaacggtcggtacccgggtttgaaccgttaccccggtaggaccctacgggtcccggtttaacccttttgggtaaccctttcccggggaccggggg

SEQ ID NO: 208814 - DNA, 622 bp, Homo sapiens
  misc_feature: GYAE6OF02IDQL3.17.25.C03.1.454.CMB.1.raw
  modified_base (281)..(281): a, c, t, g, unknown or other
  misc_feature (281)..(281): n is a, c, g, or t
  modified_base (295)..(295): a, c, t, g, unknown or other
  misc_feature (295)..(295): n is a, c, g, or t
  modified_base (307)..(307): a, c, t, g, unknown or other
  misc_feature (307)..(307): n is a, c, g, or t
  modified_base (318)..(318): a, c, t, g, unknown or other
  misc_feature (318)..(318): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatccctccctgtctgcctctggtgggggtcagagtcaccatcacttgaccggacaagtcacggtacgttaaaacctatttaaattggtatcagacaagaaacctggaaaacnccccaagacctccngtatctctggtncactccactcngacgaagtcggcctaccatcgaggttcaggtgctaggtggatcgaggacagttatttacaattctaccactactaccacctactcgacgtaccaaacgtgaaggtacttgtcgaactaatccttaacgtacttcgtaacaacgtacgtaacgtttaccgtacccgtttccccgtcgtaccgtttaaccgtttcggaaccgtaacggggtaaccttaaggttacggtaacggtaactaaaccggtaaaccgttaacgttcggttacggtaccgttacgacccgtactacgtttacctgttacccg

SEQ ID NO: 208815 - DNA, 612 bp, Homo sapiens
  misc_feature: GYAE6OF02IG9SY.17.25.C03.1.454.CMB.1.raw
  modified_base (246)..(246): a, c, t, g, unknown or other
  misc_feature (246)..(246): n is a, c, g, or t
  modified_base (290)..(290): a, c, t, g, unknown or other
  misc_feature (290)..(290): n is a, c, g, or t
  modified_base (346)..(346): a, c, t, g, unknown or other
  misc_feature (346)..(346): n is a, c, g, or t
  modified_base (476)..(476): a, c, t, g, unknown or other
  misc_feature (476)..(476): n is a, c, g, or t
  modified_base (552)..(552): a, c, t, g, unknown or other
  misc_feature (552)..(552): n is a, c, g, or t
tcagcgtagactagcacgaccggtgctcgatttagtagtgtagatttgggtttggggtacgtcaacaaccacatctgtcctctagagaaaaccctgtgagcacagctccctcaccatggactggacctggaggatcctcttcttggtggcagcagctacaagtgcccactcccaggtgcagctggtgcagtctgggctgaggtgaagaagccgtgggctcgagtgaaggtctcctgcaaggcttcnggattcacgttactcctatgtatcaacgtggtgcgcacggtccncgtgacaacgcctagacgtgagtgggatcgggacgaaccctaacgacgtgtgcacnggtacgtcttccaacccgtacttcccgacggggtaacacgtacttaaccgactacgaaccacgtaactacccgtccaaataaaccacgaactcctaaccgtagtaggagttagacggcgaccttacgaanacttcgtacgaacgacctaccggccgttaccgtattacgcgtacgtgacgacgttcccacggaacgtcccgggtanacgggtacccgtaccggacgaccggtccggtacccgtttcggtaccttcggtaaccgggg

SEQ ID NO: 208816 - DNA, 565 bp, Homo sapiens
  misc_feature: GYAE6OF02FV9J8.17.25.C03.1.454.CMB.1.raw
  modified_base (244)..(244): a, c, t, g, unknown or other
  misc_feature (244)..(244): n is a, c, g, or t
  modified_base (414)..(414): a, c, t, g, unknown or other
  misc_feature (414)..(414): n is a, c, g, or t
  modified_base (445)..(445): a, c, t, g, unknown or other
  misc_feature (445)..(445): n is a, c, g, or t
  modified_base (456)..(456): a, c, t, g, unknown or other
  misc_feature (456)..(456): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcnggattcacgtttacctcctatagtatcaactgggtgcgccaggccgctggacaacgacctgacgtggatgggatgggaccgaacctaacacgtggtcgtcgacagtgtccttcacccatcccgtcgggacacgtacttaccatcgaccacgaactcctaccaataaaccncagccctaacagtcgggagttcggaggtacnccgttgaactntcctggaaccacgaccggtccttctaactttcggttacgcgtagaccgtcccaagtcgtccggtagaccggcctacgggcaggtcccggcctttggacctttggccggg

SEQ ID NO: 208817 - DNA, 659 bp, Homo sapiens
  misc_feature: GYAE6OF02GAPY3.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagccgtggggcctcagtgaaggtctcctgcaaggcttctggattctacgtttacctcctatagtatcaacgtgggtgcgccaggccgctggacaacgacctggagtggatgggatggggaccgaaaccctaacgacgttggtgtacactagtgtccttaccacccagtcccgtaccgggacacgtaccttaccatacgaaccacgtaacctccctaccaataaaaccaccacgtaccctaacagtacggtacgttaggacggtacgcccttaggaacctagttccgttaagaacccggtaccgaccgggtacccgttactttaacgttaccgtggttacgaccgtaggacccgttaccccgaacgggttaccgtcccgggtaacgaccgtaccccggtacgggccgtacgggtcccggttaccgttttacggtaccgtttccgggtaccggggg

SEQ ID NO: 208818 - DNA, 533 bp, Homo sapiens
  misc_feature: GYAE6OF02FHXB2.17.25.C03.1.454.CMB.1.raw
  modified_base (280)..(280): a, c, t, g, unknown or other
  misc_feature (280)..(280): n is a, c, g, or t
  modified_base (332)..(332): a, c, t, g, unknown or other
  misc_feature (332)..(332): n is a, c, g, or t
  modified_base (408)..(408): a, c, t, g, unknown or other
  misc_feature (408)..(408): n is a, c, g, or t
  modified_base (420)..(420): a, c, t, g, unknown or other
  misc_feature (420)..(420): n is a, c, g, or t
  modified_base (434)..(434): a, c, t, g, unknown or other
  misc_feature (434)..(434): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatcgggatggggcaaccctaanactggtgtcactagtgtcttcacccatcctccggggacagaccttaccatcgaccacgaactcctaccataaaccncacgcccttaanatggagttgaggancctgacatctgacgacacgggcctcgtattactgtgcgagacgtcccaggactccggagacgccgtaacggcaggccggcctttgacctttcgtcgggg

SEQ ID NO: 208819 - DNA, 553 bp, Homo sapiens
  misc_feature: GYAE6OF02GVMGJ.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcaagaaacctggaaaagccccagacctcctgatctctggtgcatccactctgcgaagtgcgtccatcgaggttcagtgcagtgatcgtgggacagtattcaatctacaccatcacactctgacaactgagtattgtagtacaatctactactagtacaacgtagtaacgttactacgttcccctacgtaccttacgttttcggaccgtaacggggtaacctaaggttcgaagtaacgtaaccgtaaaaccgtaacgttcggtaggcgttcgaccaacctacttccgttacgttccc

SEQ ID NO: 208820 - DNA, 718 bp, Homo sapiens
  misc_feature: GYAE6OF02JLXJL.17.25.C03.1.454.CMB.1.raw
  modified_base (307)..(307): a, c, t, g, unknown or other
  misc_feature (307)..(307): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctgggaggatcctcttcgttggtggcagcagctacaagtgcccactcccaggtgcagctgggtgcgagtctggggctggaggtgaagaagcgtggggcctcaggtgaacggtctcctgacaagggtctcgtggtacttcctaacggttttaccctcttaactagttatacctaacttggggtcncggcccgtagggccgcgtacggaacctaacgaccctaggaggtacgggtagtcggggagtggggaccgtaaaccctaacgacgtgggtgtacacgtacggtcgtccttcgaacccctacgtcccgtaccggggtaaccacggtaccttaaccacgttacgaacccgaacgttaaccctacccgttaccaaacttaaaaccaacgacgtaacccttaacgaacgttagggtaaagtttcgggaaacgggaccgttaccgtacgtaacgacgttataccgggtaaccaccggtaacggtcccgtttacttaacgtttccaggtcgcgtaacgacctaccgtaggtacggttccggtagaccggaccgttccggactccggggttcggtaccctttcgtaccgttcgggcgggg

SEQ ID NO: 208821 - DNA, 562 bp, Homo sapiens
  misc_feature: GYAE6OF02F35JL.17.25.C03.1.454.CMB.1.raw
tcagcgtagactagcacgaccggtgctcgatttagtagtgtagatttgggtttggggactcaacaaccaaatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgttacctcctatagtatcaactgggtgcgccaggccgctggacaacgacctgagtggatgggatgggcaaccctaacacgtggtgtcactagtcgtcttcacccatccgtccgggacacgacttaccatcgacacgaactcctaccaataaacacacgcctacatggagttgacggagccctagacatcgtagacgacacggtcctactatttcgtgtgacgagtacgtcccgagacgtccgggtagaccggtccgtaacgggccacgggtccggttaccgtttacggaccgtttcggtgggggacccgg

SEQ ID NO: 208822 - DNA, 556 bp, Homo sapiens
  misc_feature: GYAE6OF02HO4KF.17.25.C03.1.454.CMB.1.raw
  modified_base (278)..(278): a, c, t, g, unknown or other
  misc_feature (278)..(278): n is a, c, g, or t
  modified_base (453)..(453): a, c, t, g, unknown or other
  misc_feature (453)..(453): n is a, c, g, or t
  modified_base (456)..(456): a, c, t, g, unknown or other
  misc_feature (456)..(456): n is a, c, g, or t
  modified_base (481)..(481): a, c, t, g, unknown or other
  misc_feature (481)..(481): n is a, c, g, or t
  modified_base (500)..(500): a, c, t, g, unknown or other
  misc_feature (500)..(500): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaggcttctggattcacgtttacctcctatagtatcaactgggtncgccaggccgctggacaacgacctggagtggatgggatcggggacgaacccctaacgacgtgggtgtaccacgagttcgtccttccaccctactccgtccgggacagaccttaccatcgaccacgaacctcctccaataaaccacacgcctacagtggagttgagagcctagacntcngacgacgacggccgtcttattccgngtcgcgagacgtcccacgngtcccggtagacgtcccgacggcacggccggttcctttaggaccttcggtccgggg

SEQ ID NO: 208823 - DNA, 629 bp, Homo sapiens
  misc_feature: GYAE6OF02F3I0Z.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcgagtgaaggtctcctgcaaggcttctggacttcacgtttacctctatagtatcaacgtggtgcgccaggccgctggacacgacctgagtggatgggagtcgggcgaaccctacgacgtggtgtcacgtagttcgtccttccaccctactcccgaccgggacaacgtaccttacactacgaccctacgtaacctcctaacctaaataaaccacacgacctactacgtggtacgttagacgggactcccgtagaactacgtacgtacggaacggaccgtaccggtacccgttacgttacttacgtggttacgaccgtaggtacgtaccccaacggtacgttcccgggtaggaccggtcccgtaaccggcgtaccgggccggttcccgtttaggacccgtttcgtaccgggg

SEQ ID NO: 208824 - DNA, 755 bp, Homo sapiens
  misc_feature: GYAE6OF02HZBHN.17.25.C03.1.454.CMB.1.raw
  modified_base (283)..(283): a, c, t, g, unknown or other
  misc_feature (283)..(283): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagcctggggcctcagtgaagtctctgacaaggtcttctggattcacgtttacctcctatagtatcaacgtgggtncgcaggccgctaggacaacgacctggagtggagtgggatcggggaccgtaaaccctaaagacgtggtacgtccgacgtacgttcgtaccttaccacccgtactcccggtaccgggaacgacgtaacctttaaccgaagttacgaacccaacggtaacccttcccgttaaacccaaattaaaaacccgacgtaaaccggtacccttaaacgtacgttagggtacgtttacgggaaacgggtaccgacccgttagaaaccctagttccggtaaccggaaaccggaaccgtaacccggggtccgttaccttaaagttttaacccgtcgggtacgaccgggtaaacgtaccgttaacccccgaagggtaaccggtttacccgggtacggtaacccggtaccccgttaaacgggggacctaacggggttccccgggttacccttttttacgggaacccgttttccgggacggggggg

SEQ ID NO: 208825 - DNA, 712 bp, Homo sapiens
  misc_feature: GYAE6OF02GOJFE.17.25.C03.1.454.CMB.1.raw
  modified_base (258)..(258): a, c, t, g, unknown or other
  misc_feature (258)..(258): n is a, c, g, or t
  modified_base (599)..(599): a, c, t, g, unknown or other
  misc_feature (599)..(599): n is a, c, g, or t
tcagcgtagactagcacgaccggtgctcgatttagtagtgtagatttgggtttggggactcaacaaccacatctgtccctctacgaggaaaaacccttgtgagtcactagctcctcaccatggactggacctggaggactcctcttcgttggttggcagcagctactaagtgcccactccctaaggtgcagcgtggtgcagtctgggctgagtgaaggaggcgtgggcctcgagtgacggtctccgtgcagtcttcgnggattcacgtttacctctattacgtacttcaacgttgggtcgcgccgaggccgcgtggaccgaaccgacccggaggttcggacgtgggacgtcggggacctaacccgttaacgacggttggtcgtacgtaacgtaagttcgtacgttcccaacccgtacttcccgtaccgggtaacacgtaccctttaacccgagtacgaaccccgtaaccgtaaccttccctaacctaaattaaacccaccacgacctaacaagttacggtaagttacggaacgtactccgttagaaccatacgttacgaaccggtaacccgacggttacccgtacttaacgtttaccgngggtacgaccggtacgacccgtacccctagtaccggttccggaagaaccggtcccgtaacggcgaacggtcccgttacccgtttaaggaccgtttaccgggcgggaaccccgg

SEQ ID NO: 208826 - DNA, 568 bp, Homo sapiens
  misc_feature: GYAE6OF02IXM4M.17.25.C03.1.454.CMB.1.raw
  modified_base (361)..(361): a, c, t, g, unknown or other
  misc_feature (361)..(361): n is a, c, g, or t
  modified_base (443)..(443): a, c, t, g, unknown or other
  misc_feature (443)..(443): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctcgtggtgggggtcagagtcaccatcacttgccggacagtcacggacgttaaaacctatttaaattggtaatcagcaacgaaacctaggaaaacgcccccagaccctcctgactctcgtggtgcatccactctgcgaagtgacgtccatcgaggttcagtgcagtgatcgtagganagtatttcaaatctacactactaccaacctactactacgaccaaccgtagtaaggtattagtcgactaattctaactacgtntacaacgtaagtacgtttactaccgttccctacgtcgttacgtttacggccgaagggtacctaagttgaagtaactaacgaaacggtactcggtacgactacgacctaccgacttcgtacgttac

SEQ ID NO: 208827 - DNA, 691 bp, Homo sapiens
  misc_feature: GYAE6OF02F3YBL.17.25.C03.1.454.CMB.1.raw
  modified_base (283)..(283): a, c, t, g, unknown or other
  misc_feature (283)..(283): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtgggcctcgagtgaaggtctcctgcgaaggcttcgtggtattcacgtttacctctatagtatcaactgggtncgccaggccgctggacacgcctgagtggagtgggatgggaccgaaccctaagacgtggtgtaccgacgaggttcgtaccttccacccctagtcccgtacccggggtacacgtacccttaccaacgtcggaacccacgtaaacccttccctaaccgaacttaaaaccaccaactcccgtaactacgtcggttaagttacgggaacggtaccgtccgtaacgtaactaccgttacgtaccggaacccggaaccggtacccgggtacctttaacgtttaacgtttccgtcggtacggaaccgtaacgggtaccctcccggaaccgttcggtcccggttaggaacccgtcccgtaaacgacgtaccggggtcccgtttacccgttacggtacccgtttggggaaccccgggg

SEQ ID NO: 208828 - DNA, 634 bp, Homo sapiens
  misc_feature: GYAE6OF02GJV25.17.25.C03.1.454.CMB.1.raw
  modified_base (338)..(338): a, c, t, g, unknown or other
  misc_feature (338)..(338): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtntcacagtgtcttcacccatccgtccgggacagacttaccatcgaccacgaacctcctaccaactaaaccacacgccctaacagtggtaagttaggagggtacgccttagactaagtcgtaggtaaccgaccgtaccgggtcccgttacttaagttaaccgttggtacgaccggtagtaccggttacccccgacggtaacggttccccgggtaggaaccgtaccccggttaaccgggccgtaaccgggtcccgggttaccccgttttcgggtacccgttttcgggtacccggggggg

SEQ ID NO: 208829 - DNA, 653 bp, Homo sapiens
  misc_feature: GYAE6OF02I7GIX.17.25.C03.1.454.CMB.1.raw
  modified_base (282)..(282): a, c, t, g, unknown or other
  misc_feature (282)..(282): n is a, c, g, or t
  modified_base (334)..(334): a, c, t, g, unknown or other
  misc_feature (334)..(334): n is a, c, g, or t
  modified_base (461)..(461): a, c, t, g, unknown or other
  misc_feature (461)..(461): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggtcttctggattcacgtttacctcctatagtatcaactgggtcncgccaggccgctggacacgacctggagtggatgggatgggacaacccgtaanacgtggtgtcacgagttcgtcttcgaccctatcccgtacgggactacgtaccttaccatcgaccaccgtaacctccctaccaaactaaacacacgacctaactacgtaggtaggttagacgggtacncccgttagacctagttccgtagggaaaccgtaccggtaaccgggtcccgttactttaacgttaccgttacggtacgtaacggacgtaccggtacccgtacggtcggttcccgggtacgtaccggtacccgttaacgggacgtaccggtacccgggtacccttttacgggtaccgttccgggtacccgggggg

SEQ ID NO: 208830 - DNA, 512 bp, Homo sapiens
  misc_feature: GYAE6OF02FOJ5I.17.25.C03.1.454.CMB.1.raw
  modified_base (298)..(298): a, c, t, g, unknown or other
  misc_feature (298)..(298): n is a, c, g, or t
  modified_base (400)..(400): a, c, t, g, unknown or other
  misc_feature (400)..(400): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaacgccccagacctcctgatctctggtncatccactctgcgaagtggcgtcccatcgaggttcagtggcagtggatctgggacagtatttcaatctcaccatcaccactctcgcaacctgaggtattgtnacaatctactactgtacaacagtagttacacgttccctcgtactacgtttcggccgacgggaccgtaagttagagtaactacaaacgaactagtggctcgcaccactctgtc

SEQ ID NO: 208831 - DNA, 632 bp, Homo sapiens
  misc_feature: GYAE6OF02GVJDQ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggaccaacgacctgaggtggatggggatggggacaaccctaacacgtggtgtcacgagtgtccttcacccatccgtccgggacacgaccttaccatacgaccacgaacctccctaccaataaaccacacgccctaacagtgggagttaggagggacgtcccgtagacctagttccgtacggaaccggtaaccgaccggggtcccgttacttaacgtttaccgtggttcggaccgtaggaccgttaccccgacggtacgttcccggggtagaccggtaccccgtagggacccgtagggtcccgggttacccttttagggaccctttccgggtaccgggggg

SEQ ID NO: 208832 - DNA, 722 bp, Homo sapiens
  misc_feature: GYAE6OF02FWRSB.17.25.C03.1.454.CMB.1.raw
  modified_base (409)..(409): a, c, t, g, unknown or other
  misc_feature (409)..(409): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtaggaagaagccgtggggcctcgaggtagaacggtcctccgtgacgaaggtccttcgtggtacttcgtaccgttttacctcctagttacgtactccaacgttgggtcgcggccgacggccgcgtcggaaccaaccggaccgtggaggtgggagtggggacgtcggggaaccgtaaacccgtaacacggttcggtcgtaccgaacgnggttcgttcccttacccgaacccctacgtcccggtaccggggaactacgtaacctttaccaagttaccggaaccctaaccggtaaaccccttccctaacccaaacttaaaccaccaccgtacctaactagtagggtaacgttaggacggtacgcccgtagactactcgtacgaccgacgtaccggtccgttacttaacgttctcggtacgaccgtacgtaccgtacccgacgtacggtcccgggtagacccggtacccgtacggacggaccggtacccggttaccgttacggttacccgttcggtaccggggg

SEQ ID NO: 208833 - DNA, 735 bp, Homo sapiens
  misc_feature: GYAE6OF02H08C2.17.25.C03.1.454.CMB.1.raw
  modified_base (285)..(285): a, c, t, g, unknown or other
  misc_feature (285)..(285): n is a, c, g, or t
tcagcgtagactagcacgaccggtgctcgatttagtagtgtagatttggttttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtgggcctcagtgaaggtctccgtgcaaggcttctggattctacgtttacctcctatagtatcaacgtgggtcncgccgaggccgctggacaacgacctgagtggatgggatcggggaccgaaaccctaacgacgtaggtcgtaccacgtagtttgtccttccgaacccctagtcccgtacccgggaatacggtaccttaaccagtaccgaaccaacgtaacctccctaaccaaactaaaccacgaaccgtaccctaacgaacgttagggtaacgttagggaacgggtactcccgttaggaaacctacgttaccgtacgggaaacccgttaacccgaacccggggttccccttaacgttaaactttacccgtaggtaccgggaccgtaacggtaacccggttacccccgaacgggtaaccgttaccccgggggttagtaacccggtaccccgttaacgggggcccaacggggttccccggtttacccggtttttaaggaccccgttttcggggaacccgggggg

SEQ ID NO: 208834 - DNA, 656 bp, Homo sapiens
  misc_feature: GYAE6OF02FF8Z9.17.25.C03.1.454.CMB.1.raw
  modified_base (279)..(279): a, c, t, g, unknown or other
  misc_feature (279)..(279): n is a, c, g, or t
  modified_base (449)..(449): a, c, t, g, unknown or other
  misc_feature (449)..(449): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctctgcaaggcttctggattcacgtttacctctatagtatcaactgggtncgccaggccgctggaccaacgacctgagtggagtgggatcgggaccgaaccctaacgacgtgggtctcacgtaggtcgttacttcccgaaccctagtcccgtaccgggaacacgtaccttaccatcgacctaacgaacctccctaccaaataaaccgcacgtaccctaanacgtagggtacgttaggacggtacgtacccgtagaacctacgttccgtacggaaccggaccgtaacccgggtccgttactttaattacgtcggtacggaccgtaggtacccgttaccccgaacggtcgtcccggggtagaaccggtcccgtaaccgggacgtacggtccccggttacttttaccggaccgttttccgggaccggggg

SEQ ID NO: 208835 - DNA, 663 bp, Homo sapiens
  misc_feature: GYAE6OF02I1RG6.17.25.C03.1.454.CMB.1.raw
  modified_base (220)..(220): a, c, t, g, unknown or other
  misc_feature (220)..(220): n is a, c, g, or t
  modified_base (283)..(283): a, c, t, g, unknown or other
  misc_feature (283)..(283): n is a, c, g, or t
  modified_base (294)..(294): a, c, t, g, unknown or other
  misc_feature (294)..(294): n is a, c, g, or t
  modified_base (470)..(470): a, c, t, g, unknown or other
  misc_feature (470)..(470): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctgggaggatcctcttcttggtggcagcagctacaagtcgcccactcccaggtgcagctggtgcagtcgtgggctgaggtgaagagccgtgggcctnagtgaacgtctctgcaaggtctcgtgattctacgtttacctctatagtatacaacgtgggtcncgcacggccgngtacggaacaacgacctggacggtggagtgggagtcgggaccgaaacccgtaacgacgtggtcgtacgacgtagttcgttcttaccgaccctacgtcccgtaccgggaacacgtaccgttaaccagtacgaacctacgtaacctacccgtacaaactaaaccgcaacgtacctaanacggtaggtacggttacggaggtaccgtacctagaaccacttacggtacgaacccgtaacgaccgggttcccgttaacttaaccgtttcgtcggtacgacggtaacgtccgttacccgaacggtaacgtcccggtaagacgtacccgtacggcgacgggtaccgttcctttacgtaccgttccgggtacgggg

SEQ ID NO: 208836 - DNA, 549 bp, Homo sapiens
  misc_feature: GYAE6OF02FNDKB.17.25.C03.1.454.CMB.1.raw
  modified_base (434)..(434): a, c, t, g, unknown or other
  misc_feature (434)..(434): n is a, c, g, or t
  modified_base (445)..(445): a, c, t, g, unknown or other
  misc_feature (445)..(445): n is a, c, g, or t
  modified_base (492)..(492): a, c, t, g, unknown or other
  misc_feature (492)..(492): n is a, c, g, or t
  modified_base (529)..(529): a, c, t, g, unknown or other
  misc_feature (529)..(529): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaacgtgggtcgcgccgaggccgcgtggaccaacgacctggacgtggacgtggggatcggggaccaaaccctaacgacgtgggtgtacacgtagttcgtccttacaccctatcccgtaccgggacacgtaccttaccatcgaaccacgaactcctacaataaacncacgtcctaancgtaggagttgagacgcctagacagtcagacgacgcgtcgtctatcngtcgagcgtacgccaggtctccggtgacgtctaggcncggccgtcttgcgtgtcggg

SEQ ID NO: 208837 - DNA, 651 bp, Homo sapiens
  misc_feature: GYAE6OF02HEBQL.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcagtgaaggtctcctgcaaggcttcgtggattcacgttttacctcctatagtatcaactgggtgcgccaggccgctggacaacgacctgagtggatgggatcggggcaacccctaagacgtggtgtccacgagttgtcctttccaccctagtcccgtaccgggacacgtaccttaccatcgaccacgaacctccctaccaaactaaaccacacgacctaacagtggtagttaggagggactcctagactagtacgtacggaaccgtaccgaccggtacccgttacttaacgtttacgtcggtacggaccgtaagggacccgttaccccgaacgggtcgttacccggggtacgtaaccggtaccccggttacgggacccgtacggggtcccggttacccgttttacgggtacccgtttcgggtaacccgggggg

SEQ ID NO: 208838 - DNA, 795 bp, Homo sapiens
  misc_feature: GYAE6OF02ID4N4.17.25.C03.1.454.CMB.1.raw
  modified_base (297)..(297): a, c, t, g, unknown or other
  misc_feature (297)..(297): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttgggtggcagcagctacaagtcgcccactcccaggtgcagctggtgcagtcgtgggctggaggtgaagagccgtggggcctcgagtgaaggtctcctgcaaggtcttcgtggtattctaccgtttacctaccttaatagttatcaacgttggggtcncgccgacggccgtcgtaggaaccaaccggtaccgtggacggtggaaggtacggggtaggtcggggaacccgtaaaaccccgtaaaccgtcggttagggttacgtaccacgtaacggtttcgttcctttacccgaacccctacgtccccggtaccgggaacacgttaaccgttacccagtttaccggaaccctaacgtaacccttccctaaccgtaaattaaaacccacgaaacggtaccccttaaacgacggtttacgggtaggtttaacggaacgggtacggacccgtttaagaaccgtactttaccggtaacgggtaaacccgacccggtacccggggttcccgtttaactttaacgtttaccggtaacggttcgaacccggtagtaacccgtcccgtaaccggtacggttccccgggtagtacccgtacccggttaccgggactaccggggtcccggttttaccgtttaacggtcccggttccgggtaccggggg

SEQ ID NO: 208839 - DNA, 777 bp, Homo sapiens
  misc_feature: GYAE6OF02JEXO1.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagccgtggggcctcagtgaaggtctcctgcgaggcttctggacttcacgtttacctcctagtagtatctaacgtgggtcgcgccgaggccgcgtaggacaacgcctaggagtggagtggggagtcggggacccgtaaacccgtaacgaccgttagggtcgtaccaacgtaggttcgttacccgttaccaccccgtaacttcccggtacccggggaacctaacgggtaaccctttaccgaaccgtttcgaaaccccgtaaccggtaaacccttcccctaacctaaaccgtaaaaacccacctaaacgccccttaaacgtaacggtcgggttaacggtttggaacgggtacggtccctacggtaactagtaccgttaggaaccggtaccggtaacccggtcccgttagtttaacgtttaaccgtggtacgggtaccggtaacggttaccggtacccgtaccgggtaaccggttcccgggtaaacgtacccgggtaccccgttaccgggaccgtccggggtacccccggttttccggttttacggtaccccgggttttccgggtaacccgggggg

SEQ ID NO: 208840 - DNA, 687 bp, Homo sapiens
  misc_feature: GYAE6OF02JZZT1.17.25.C03.1.454.CMB.1.raw
  modified_base (192)..(192): a, c, t, g, unknown or other
  misc_feature (192)..(192): n is a, c, g, or t
  modified_base (261)..(261): a, c, t, g, unknown or other
  misc_feature (261)..(261): n is a, c, g, or t
  modified_base (282)..(282): a, c, t, g, unknown or other
  misc_feature (282)..(282): n is a, c, g, or t
  modified_base (355)..(355): a, c, t, g, unknown or other
  misc_feature (355)..(355): n is a, c, g, or t
tcagcgtagactagcacgaccggtgctcgatttagtagtgtagatttgggtttggggtacgtcaacaaccacatctgtcctctagagaaaaccctagtgagcacagctcctcaccatggactggacctggaggatctcttcttggtggcagcagctacaagtgcccactcccaggtgcagctggtgcagtcngggctgaggtgaagagcctggggcctcagtgaaggtctcctgcaagggcttctggattcacgtttaccncctatagtactcaacttgggngtcgccgaggccgcgtgggactaaacgcctggacgtagggactggggacgtcggggacgaacccccgttaaanccgtgggttcgtacacgtaggtgtccgtttacacccctagttccctaccgggggacctacgggtaaccttaaccacgttccggaaacccgtacccgaaacttaccctacccaaacgttaaaacaccaacgtacccgtaactataacgggagtttacggacggtaggacccttagaacctacgtactcgggaaccgaacgtaccggggacctacttaacgttacggttacggacgttcgaacggtacccgtaccgacgtaccggtcggttacgggactacccggttaaggccggtacggccggtacccttttggtacccgttcgtaccggggg

SEQ ID NO: 208841 - DNA, 586 bp, Homo sapiens
  misc_feature: GYAE6OF02G7WBY.17.25.C03.1.454.CMB.1.raw
  modified_base (243)..(243): a, c, t, g, unknown or other
  misc_feature (243)..(243): n is a, c, g, or t
  modified_base (279)..(279): a, c, t, g, unknown or other
  misc_feature (279)..(279): n is a, c, g, or t
tcagcgtagactagcacgaccggtgctcgatttagtagtgtagatttgggtttggggactcaacaaccacatctgtcctctagagaaaacccagtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttcnggattcacgtttacctcctatagtatcaactgggtncgcaggccgcgtggacaacgacctgagtggagtgggagtcgggaccgaaccctaacgcgtggtcgtcacaggtgtccttacgacccatcccgtccggggacacgaccttaccagtcgacccacgaaccctcctaccaactaaacactacgcctaacagtggtagttggaggacgcctagctaactctaggaccgacgaccggccgtacgttacttacgtgtagccgtagaccgtcccgacggtacgtccgggtacgcgtacccgtacggcgacggtccggttccctttaggacctttcggaccgggg

SEQ ID NO: 208842 - DNA, 556 bp, Homo sapiens
  misc_feature: GYAE6OF02G3D9G.17.25.C03.1.454.CMB.1.raw
  modified_base (275)..(275): a, c, t, g, unknown or other
  misc_feature (275)..(275): n is a, c, g, or t
  modified_base (300)..(300): a, c, t, g, unknown or other
  misc_feature (300)..(300): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctcgcctctggtgggggtcagagtcaccatcacttgccggacaagtcacggacgttaaaactattaattgtatcagcaagaaacctaggaaaacnccccagacctcctgactctctggtncactccactctgacgaaggtcggcctccagtcgtaggttcagtcgcaggtggatcgtggactagtatttacaatctacacatcactactctcgacctaacgtgaggtatgtcgtactatactactactctacaacagtaacttaccgtaccgttccctcgtaccttcgtttacggaccgacgggtaaccgtagttacgacgtaactaactaaaccggtaacgtacggtagtctcgacctacctacttcgtcgttcc

SEQ ID NO: 208843 - DNA, 680 bp, Homo sapiens
  misc_feature: GYAE6OF02FTOQQ.17.25.C03.1.454.CMB.1.raw
  modified_base (279)..(279): a, c, t, g, unknown or other
  misc_feature (279)..(279): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaaggcttctggattcacgtttacctcctatagtatcaactgggtncgccgaggccgcgtcggaccaacgacctagaggtggagtggggagtcggggaccgtaaacccgtaacgtacggtggttcgtacaacgtggtcgttccttacccaccctactcccggtaccgggactaaccggtaaccttaaccgtacgtaccgaaccaaccggtaaccttccctaccaaaactaaaccacgaccgtaccctacacgtggtaacggttggacggacgtccgtagacctatcgtacgacgtaccgaccggtaccgttacttaacgttacgtacggtgaccgtacggtacccgttaccccgaaggttacccggttaccgggtacgtaaccggttacccttaggtccggtaccgtaccgggtcccggtttacgtttacggtccctttccgggggg

SEQ ID NO: 208844 - DNA, 751 bp, Homo sapiens
  misc_feature: GYAE6OF02JJWYQ.17.25.C03.1.454.CMB.1.raw
  modified_base (245)..(245): a, c, t, g, unknown or other
  misc_feature (245)..(245): n is a, c, g, or t
  modified_base (299)..(299): a, c, t, g, unknown or other
  misc_feature (299)..(299): n is a, c, g, or t
  modified_base (360)..(360): a, c, t, g, unknown or other
  misc_feature (360)..(360): n is a, c, g, or t
tcagcgtagactagcacgaccggtgctcgatttagtagtgtagatttgggtttggggtacgtcaacaaccacatctgtcctctagagaaaaccctagtgagcacagctccctcaccatggactggacctggaggatcctcttcttggtggcagcagctacaagtgcccactcccaggtgcagctggtgcagtcgtgggctgaggtgaagagccgtgggctcgagtgagtctcctgcaggcttcgnggtacttctacgtttacctcctatacgtatcaacgtgggtgcgccgaggtcccncgtgggacctaaccggaccgtggaacggtggaacgtggggagtcggggaccaacccctaanaccgtgggtacgtacacaggttctaccttaccaccgaacttcccgtaccgggaacgtacgtaccttacccgagttccgaacccaacgttaaccctccctaaccgtaaactaaaccgaccgtactacccgtaacgaacggtcggttacgggttacgtaacgggaacgttcccgtaacgtaccgtaagtttacccgagggaaaccccggtaaccgacccggggtttacccgttaccttaacgttttaaccggtgtaaacccgggtcgtaaacggccccgttaaccccgtaacggtaccggtacggggttaccgacccgggttaacccgtaacgggcccgtaccgggttaccgggttcccttttacgggtaacccgttccggtaacccgggggg

SEQ ID NO: 208845 - DNA, 593 bp, Homo sapiens
  misc_feature: GYAE6OF02FFQBI.17.25.C03.1.454.CMB.1.raw
  modified_base (230)..(230): a, c, t, g, unknown or other
  misc_feature (230)..(230): n is a, c, g, or t
  modified_base (439)..(439): a, c, t, g, unknown or other
  misc_feature (439)..(439): n is a, c, g, or t
  modified_base (467)..(467): a, c, t, g, unknown or other
  misc_feature (467)..(467): n is a, c, g, or t
  modified_base (474)..(474): a, c, t, g, unknown or other
  misc_feature (474)..(474): n is a, c, g, or t
  modified_base (480)..(480): a, c, t, g, unknown or other
  misc_feature (480)..(480): n is a, c, g, or t
  modified_base (538)..(538): a, c, t, g, unknown or other
  misc_feature (538)..(538): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtcncctgcaaggcttctggattcacgtttacctcctatagtatcaactgggtgcgccagccgctggacaacgacctgagtggatgggatcggggacgaaacccctaacacgttgggtcgtcacgtagtgttacttaccacccctatcccgtcggggaccacggtaacccttaccatcggaacccaaccgtaacctcctaccaactaaaaccncacgtaccctacatcggagttgaggacncctgacncgttcncgacgacacggccttacttatactgtcgaccgtagacgtccccaggtacctccggganaccggtcccgttacggaccgtacggccggttcctttggaccgtttcgtccggggg

SEQ ID NO: 208846 - DNA, 713 bp, Homo sapiens
  misc_feature: GYAE6OF02G1FGI.17.25.C03.1.454.CMB.1.raw
  modified_base (246)..(246): a, c, t, g, unknown or other
  misc_feature (246)..(246): n is a, c, g, or t
  modified_base (566)..(566): a, c, t, g, unknown or other
  misc_feature (566)..(566): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcgagtgaaggtctcctgcaaggcttcgnggattcacgtttcctctatagtatcaacgtggtgcgccgaggccgcgtaggaccaaccgcctaggagtggagtgggacgtggggaccgtaacccgtaacgaccgtgggtacgtaccgacggtaacggttcgtacccgtttacgaaccccttacgttaccccgtaccgggggaaccctaacggtaacccgttttaacccgaacgtttaccggaaaccccgtaaccggtaaaccctttccccgtaaccctaaacgttaaaacccaacctacgtaccctaactacgtacgggtaaggtttacggacggacgtcccgtagtacncgttactacggaaccgaccgtacgtccgttacttaacgttacgtaggtacacggtacggacttacccgacgtacggttccggtacggtacgtacccgtacggtaccgagggtcccgttaccggtttacgtaccgttccggtccgggg

SEQ ID NO: 208847 - DNA, 823 bp, Homo sapiens
  misc_feature: GYAE6OF02IDOPV.17.25.C03.1.454.CMB.1.raw
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtcgcccactcccaggtgcagctggtgcagtcgtgggctggaggtgaaggaagccgtgggcctcgaggtgaaggtctcctgcgaaggtcttcgtggtatttccgtaccgttttacctaccttaagtagttactcaaacgttggggtcgccggtaccgacgggcccgtaccgtacgggaaaccaaacccggtaccgtgggaacgggtttagggaaggttacgggggtacgtacgggggaaccccgtaaaaccccgtaaacgtccggttcgggtacgtaccgtacgtaggttcgttcccttaccgacccctacgttaccccggtaccgggaacctaacgtacccgttaaccaacgttacccggaaccccgtaaccgtaacccttaccccgtaaaccctaaaacttaaaaccccgaacctaaccgtacccttaaccgaacggttacgggtaacggttaacgggaaagggtcgacccttacgaacgtaacgttcgaacggaaccggtacccggaccggttccgttactttaacgttaccgtaggtacggaccggtacgtaccgtacccgtaacggtacggttaccgggtcgaaccggttacccgtaccgggtacgaaccgggtcccggtttaccgttttacggtaccggtttcccgggtaaccggggg

SEQ ID NO: 208848 - DNA, 697 bp, Homo sapiens
  misc_feature: GYAE6OF02JU6TS.17.25.C03.1.454.CMB.1.raw
  modified_base (187)..(187): a, c, t, g, unknown or other
  misc_feature (187)..(187): n is a, c, g, or t
  modified_base (190)..(190): a, c, t, g, unknown or other
  misc_feature (190)..(190): n is a, c, g, or t
  modified_base (205)..(205): a, c, t, g, unknown or other
  misc_feature (205)..(205): n is a, c, g, or t
  modified_base (223)..(223): a, c, t, g, unknown or other
  misc_feature (223)..(223): n is a, c, g, or t
  modified_base (229)..(229): a, c, t, g, unknown or other
  misc_feature (229)..(229): n is a, c, g, or t
  modified_base (268)..(268): a, c, t, g, unknown or other
  misc_feature (268)..(268): n is a, c, g, or t
  modified_base (320)..(320): a, c, t, g, unknown or other
  misc_feature (320)..(320): n is a, c, g, or t
  modified_base (371)..(371): a, c, t, g, unknown or other
  misc_feature (371)..(371): n is a, c, g, or t
  modified_base (576)..(576): a, c, t, g, unknown or other
  misc_feature (576)..(576): n is a, c, g, or t
  modified_base (605)..(605): a, c, t, g, unknown or other
  misc_feature (605)..(605): n is a, c, g, or t
tcagcgtagactagcacgaccggtgctcgatttagtagtgtagatttgggtttggggtacgtcgaacaaccacatctgtcctctagagaaacctagtgagcacacgctcctcaccatcggtactggacctggaggacttctctttcgttggtgggcacggcagtcctacgtaagcgcccacctccgnggngcagtcgtggtcgcngtcgtggggtacgtaggngggtanaaggaagcccgggtggggcctcgagttggaacgggttcnccgttgacgacgggtcttctggttctcgttaccgtttactccttattacgtntcctaggtcgggttacgccgccggcggtccgcgtaggcctaacgcctaggnggtcggtggcggtaggcggggaacctaaccggtagaccggtaggtctacgaccgttaggtgttccttaccgtacccgacgttccgacccgggataacgtacccgttaaccgtagacccgtaccgtaaccgtaacccgtacccttaacccgtaaactaaaccaccgaccgtacctacgtaacgtacgttaggacggtagcggtacnccggaactgtactcgaaccgcggtaccgngttacctattacgtgacgtcgacgctaccgtaggaccgtcgtacgacgtccgaacggtccggaggtccgttacgttccggtctacgggtcgg

SEQ ID NO: 208849 - DNA, 680 bp, Homo sapiens
  misc_feature: GYAE6OF02HUVH2.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtagaagaacgccgtggggcctcgagtgaggtctcctgcaaggtcttcgtggattcacgtttacctcctatagtatcaacgtgggtcgcgccgacggccgtcgtacggaaccgaacgtaccgtggaggtggagtggggagtcgggaccgaaacctaagcgtggtctacgactagtcgttacttaccaccctcgtccgtccgggacacgtaccttacacgtccgaacctacgaaaccctcctaccaaactaaaccacaccgtacctactaggtagggtaagttgggaacggacgtccgtgacctacgttcgacggaaccgaccgtaaccgggtccgttacttaagtttccgtaggtacgacggaaccgtccgtaccccggtagtccgggttaccgggtacggtaccgtaccccggtacggtaccggtaccgggtcccggtttaacccgttttacgggttaccgtttcccggggtacgggg

SEQ ID NO: 208850 - DNA, 646 bp, Homo sapiens
  misc_feature: GYAE6OF02JSLHB.17.25.C03.1.454.CMB.1.raw
  modified_base (439)..(439): a, c, t, g, unknown or other
  misc_feature (439)..(439): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtcgcagctggtgcagtctgggctgaggtgaagagcctgggctcagtgagtctctgcagctcgtggattcacgttacctctatagtatcaacgtgggtcgcgccgacggccgctcggacaacgtacctggacggtggagtgggtagtcgggaccgtaaaccctacgacgttggtcgtacgacgtaggttcgtacttccacccgtactcccgtacgggacacgtaccttaccagtacgacccacgaaccctcctaccaaacgtaaacncgacgccttaacaggtacggagttagacggtactcctagactacttcgacggaacccgtaacgtaccggggcctttaacgtacgtttaccgtagtacggccgtaacggtaccgtaccccgaagggtccgttacccgggtagacccgttacccggtaagggctaaccgggtcccggtttacctttaggtacccgttcgggtaccgggg

SEQ ID NO: 208851 - DNA, 581 bp, Homo sapiens
  misc_feature: GYAE6OF02HDZ4S.17.25.C03.1.454.CMB.1.raw
  modified_base (274)..(274): a, c, t, g, unknown or other
  misc_feature (274)..(274): n is a, c, g, or t
  modified_base (301)..(301): a, c, t, g, unknown or other
  misc_feature (301)..(301): n is a, c, g, or t
tcagcgtagactagcacgaccggtgctcgatttagtagtgtagatttgggtttgggagtcagtctcagtcaggacacagcatggacatgagggtccccgctcagctcctgggctcctgctactctggctccgagctgccagatgtgacatccagatgacccagtctccatcctccctgtctgcctctgtgggggtcagagtcaccatccacttgccggacaagtcacggacttaaaacctatttaaattggtatcagcagaaacctggaaaacnccccaagacctcctgactctctggtcncatccactctgcgaagtcgctcccatcgaggttcagtgcagtggatcgtgggacagtatttcgaatcctacacctactaccaacctactcgtacgacctaacctggaggtagttgacgtactaacttctaacttacgtagtaccaacgtagtaacgttactaccgtttcccctagtccttacgtttcggaccgtacggggtaacctaaggttcgaagtaactaaccgaaacggtacgtggtacggtactacggaccaaccgtacttacgtacgtttaccg

SEQ ID NO: 208852 - DNA, 741 bp, Homo sapiens
  misc_feature: GYAE6OF02G9B0R.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcgagcgtggtcgctagtcggtgggctggaggtagaaaggacgtccgggtcgggtcctacgaggtaggtaacggtcctccgtcgacgaacggtccttcggtaggtacttaccgttaaccgttttacccctaccgttaattaagtacttacctaacggttgggtcgaccgccggacggtccgtacggtacggaaccgaaccgtaccgtggaggtggaggtgggacggtcggggaaccctaaaccccgtaacgtacggttcggtcgtaccacgtacggttcgttacccttacccgaccctaccgttcccggaccgggacaacggttaaccctacacgtccgaacccgtaacgtaccctcctaaccaaactaaaccacgactaccctaatacggtaggtagtaggacggtacctcgtacgacctacgttccgaaggaccgaccggtaccggtccgtacttaacgttcgtggtaccgacgacggtacccgaccggacggttccggtccggtagacccggtaccgtaccggcgtcgggtacccgttccgtttcgtacccgttgggaccgggg

SEQ ID NO: 208853 - DNA, 747 bp, Homo sapiens
  misc_feature: GYAE6OF02JPRZE.17.25.C03.1.454.CMB.1.raw
  modified_base (243)..(243): a, c, t, g, unknown or other
  misc_feature (243)..(243): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgccactcccaggtgcagctggtgcagtctgggctgaggtgaagaagcctgggcctcgaggtaacggtctcctgcaaggcttgnggattcacgtttacctctatagtactctaacgttgggtgccggtaccagggcccgacgtacgggaacctaacggacctggaacggtggaagtggggacgttcggggaccgtaaacccgtaacgacgttagggtacgtacgaacgtacgtcgttacgttaccgacccgtacgtcccgtaccgggtaactacggtaaccttaccgacgttaccgaaccgtaacgtaaccttacccgtaacctaaacgtaaaacccaacgtaaccgtaaccgtaaaccgaacgtacgggtaagttacggaacggtaacgtacccgtaagtaacctacgtacgtacgaacccgtacgtaaccgggtaccgttaaccgttaaccgtttaccgtacggtacgtaccggtacgtaccgtacccgtaaccggtaaccgttacccgggtaggaaccggtacccgtaacggtaccgtaacgggtcccggttaccgtttacggtaccgtttaccgggtaccgggg

SEQ ID NO: 208854 - DNA, 660 bp, Homo sapiens
  misc_feature: GYAE6OF02F96MR.17.25.C03.1.454.CMB.1.raw
  modified_base (203)..(203): a, c, t, g, unknown or other
  misc_feature (203)..(203): n is a, c, g, or t
  modified_base (288)..(288): a, c, t, g, unknown or other
  misc_feature (288)..(288): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatcgacccagtctccatcctccctgtctgcctctggtggggtcagngtcaccatcacttgaccggacaagtcaacggtacgttaaaaacctatttaaattggtaatacagacaagaaacctaggaaaaccnccccaagaccctcgtagactctcgtggtcaccactccactcgagacgtaacgtcggtaccgtaccctaagtcggacggttacgaggtcggtactacggtaggtaacgtcgtaggggaaacctaaggttaattttaccgaaattccctaacgaaccctacgtaccaaccctaactcgtacgacctaacgtaggaacgtagttcgtacgtactaattccttaaactacgtactacaaacgtagtaacgttacctaaccgttcccgtagtccgttaacgttacggaccggtaacgggaacctaagtacgaagtaacgtaaaccgtaaacggtacgtaggtacgtacgtacgtacctacgtacttacgtcttaccg

SEQ ID NO: 208855 - DNA, 572 bp, Homo sapiens
  misc_feature: GYAE6OF02H0Z8F.17.25.C03.1.454.CMB.1.raw
  modified_base (174)..(174): a, c, t, g, unknown or other
  misc_feature (174)..(174): n is a, c, g, or t
  modified_base (250)..(250): a, c, t, g, unknown or other
  misc_feature (250)..(250): n is a, c, g, or t
  modified_base (274)..(274): a, c, t, g, unknown or other
  misc_feature (274)..(274): n is a, c, g, or t
  modified_base (284)..(284): a, c, t, g, unknown or other
  misc_feature (284)..(284): n is a, c, g, or t
  modified_base (293)..(293): a, c, t, g, unknown or other
  misc_feature (293)..(293): n is a, c, g, or t
  modified_base (325)..(325): a, c, t, g, unknown or other
  misc_feature (325)..(325): n is a, c, g, or t
  modified_base (332)..(332): a, c, t, g, unknown or other
  misc_feature (332)..(332): n is a, c, g, or t
  modified_base (338)..(338): a, c, t, g, unknown or other
  misc_feature (338)..(338): n is a, c, g, or t
  modified_base (399)..(399): a, c, t, g, unknown or other
  misc_feature (399)..(399): n is a, c, g, or t
  modified_base (410)..(410): a, c, t, g, unknown or other
  misc_feature (410)..(410): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatctcttcttggtggcagcagctacaagtgcccactcccaggtncagctggtgcagtcgtggggctggaggtgaagaagccgtggggcctcgaggtgacggtctccgtgcaaggcttcgnggattcacgtttcctctatagtancaactgggtncgcaggccntggacacgctgagtgatggatggacaacctancgtggtntcacgngtctcttacacccatcccgcggacacgtacttacatcaccacgacctcctacaactaaacncacgtacctanagtggagttgacggtacgccgtagactatcgacgaaccgacgaccgtccgtacttaagttacgagtacgacgaacgtacgacccgtaaggaccgttcccgggtagaccgtcccgtacggaccgtcgggtcccggttccgtttaggtccttcggtaccggggg

SEQ ID NO: 208856 - DNA, 636 bp, Homo sapiens
  misc_feature: GYAE6OF02GQ1MK.17.25.C03.1.454.CMB.1.raw
  modified_base (280)..(280): a, c, t, g, unknown or other
  misc_feature (280)..(280): n is a, c, g, or t
  modified_base (291)..(291): a, c, t, g, unknown or other
  misc_feature (291)..(291): n is a, c, g, or t
  modified_base (344)..(344): a, c, t, g, unknown or other
  misc_feature (344)..(344): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgntggacaacgcctgagtggatgggatggggaccaaccctaacacgtggtctcangtgtcttaccacccactccgtccggacagtaccttaccatcgaccacgaacctccctaccaataaaccacacgtccctaatacgtaggtacggttagaacgggtacgcccgttagacctagtccgtgaacccggtaccgaccgggtcccgttacttaacgtttacgtcggttacgaccgggtagtaccggttacccccaagggtaccgttcccgggaggtacccggtacccgtaccgggacaccgggtccccgggtttaccctttcggtaccccgttgggtaccccgggggg

SEQ ID NO: 208857 - DNA, 596 bp, Homo sapiens
  misc_feature: GYAE6OF02F40WO.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaagcttctggattcacgtttacctcctatagtatcaactgggtgcgccgagccgcgtggacaacgcctgagtggatgggatgggcgaaccctaagacgtggtcgtcaactaggttcgtccttcaccctatcccgtccgggaacacggtaccttaccgatcgaacccacgtaacctccctaccaataaaccacaacgtcctaacagtgggaagtttcgaaggtacgccttaggaccagtccgtgacgaccgtacgggtccttactacgtttactcgtcgacgacgacgtaccccgaggtcgtaccggttgaacgtcccgtacggctacgggccgttccgtttacgtaccgtcgtaccggggg

SEQ ID NO: 208858 - DNA, 676 bp, Homo sapiens
  misc_feature: GYAE6OF02I7E55.17.25.C03.1.454.CMB.1.raw
  modified_base (202)..(202): a, c, t, g, unknown or other
  misc_feature (202)..(202): n is a, c, g, or t
  modified_base (241)..(241): a, c, t, g, unknown or other
  misc_feature (241)..(241): n is a, c, g, or t
  modified_base (245)..(245): a, c, t, g, unknown or other
  misc_feature (245)..(245): n is a, c, g, or t
  modified_base (276)..(276): a, c, t, g, unknown or other
  misc_feature (276)..(276): n is a, c, g, or t
  modified_base (610)..(610): a, c, t, g, unknown or other
  misc_feature (610)..(610): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcctttcgttggtggcagcagctacaagtgcccactcccgaggtgcagctggtgcagtcgtgggctgnggtgaagagcctgggctcgagtgaggtctctgcaggctntggnttcacgtttactctatagtatctaagtgggngcggccgacggtccgtcgtaggaaccacgtaccgtggtacggtggtagtggggtaggtcggggaaccgtaaccctaagaccgtcggtacgtacgtagacggtttcgcccttactaccccgtaccggtccgtacgggaacctacgtaaccgttccgacgtacggaacctacccggtaacctccctaaacgaactaaacgaccctaacgaaccttacggaggtttagacggttaggaccttacgggaccctagtacctaagtacccgtaagacccggtaccgttaccgggaccttacttagtaccgtcggtacgacgtaccgtcgaccgacgggtnttacccgggcgtaacgtcccgagggtccgaccggtccgttacgtttcggacggttccgtaacgggg

SEQ ID NO: 208859 - DNA, 758 bp, Homo sapiens
  misc_feature: GYAE6OF02ILQKF.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaggcttctggacttctacgtttaccctcctatagtatcaacgtgggttgccgtcccagggcccgtcgtacgggactaaccgaccgtaggagtgggacgtaggggtacgtcggggaaccgtaaaccctaacgtacgttcgggtgttaccgacgtaagtccggttaccctttcccaacccgtaccgttcccggtacccggggtaacaacgttaacccgttaaccctaacgtaccgaacccgtaaaccggtaacccttaccccctaacctaaactaaaaccaccgaaccgtacccttaaccgacgtacgggtaggttaacggacgggaaccgtccgtaaccgacctaacgtaccgttacggaacccgtacggaacccgggttcccgttacgttaacttacgtggtacgaccgggtacgaccggtacccacgggtccgttacccgggtcgaaccggttacccggtaccgggccgtaaccggggtcccggtttacccgtttacgggtacccgtttcgggtacccggggg

SEQ ID NO: 208860 - DNA, 576 bp, Homo sapiens
  misc_feature: GYAE6OF02FYW2U.17.25.C03.1.454.CMB.1.raw
  modified_base (448)..(448): a, c, t, g, unknown or other
  misc_feature (448)..(448): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggagtggggatggggccgaaccctaacacgtgggtgtcacgtaggtcgtccttcaccccatcccgtaccgggacagtaccttaccatcgaccacgaacctccctaccaactaaacacacgcctacatggagttgaggacncctagactatcgtacgaccgacgaccggtccgtactattacgtgtgcgagtaccgtcccgacgtcgtccggtagacgtcccgtaacggccgacggccggttccctttaggtacctttccggtacgggg

SEQ ID NO: 208861 - DNA, 552 bp, Homo sapiens
  misc_feature: GYAE6OF02HNYUF.17.25.C03.1.454.CMB.1.raw
  modified_base (434)..(434): a, c, t, g, unknown or other
  misc_feature (434)..(434): n is a, c, g, or t
  modified_base (447)..(447): a, c, t, g, unknown or other
  misc_feature (447)..(447): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcgagtgaaggtctcctgcaaggcttctggattcacgtttacctctatagtatcaacgtggtgcgccaggccgctaggacaacgacctgagtggatgggatgggacgtaaaccctaacacgtggtgtcacgagtgtccttacaccccatcccgtccgggaactacggtaccttaaccatcgaacccacgaaccctccaccaataaacacagacctanatggagttgagcnctgacatctagacgataccggccttacgtattacgtgagcgtagacgtcccaggtctccggtagacgcccgtaggcgacggtccgtcctttgtacgtcgtacggg

SEQ ID NO: 208862 - DNA, 595 bp, Homo sapiens
  misc_feature: GYAE6OF02G6GQF.17.25.C03.1.454.CMB.1.raw
  modified_base (243)..(243): a, c, t, g, unknown or other
  misc_feature (243)..(243): n is a, c, g, or t
  modified_base (334)..(334): a, c, t, g, unknown or other
  misc_feature (334)..(334): n is a, c, g, or t
  modified_base (416)..(416): a, c, t, g, unknown or other
  misc_feature (416)..(416): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttntggattcacgtttacctcctatagtatcaactgggtgcgccaggccgctggacaacgacctgaggtggatgggatcgggcgaacccgtaanctggtgtacatagtgtcttcacccatccgtacgggacacgacttacactgaccacgaactcctacaataaacacacgcctanatggagttgagagccgtgacatcgtagacgaccgacgggtcccgttacttacgtttaactggtacgcggtaacgtaccgttaccccgaacggtaaccggttacccggtaggaccgtacccgttaacgggccacgggtccggttacccgttttcggtaacccggtttcggtaccgggggg

SEQ ID NO: 208863 - DNA, 518 bp, Homo sapiens
  misc_feature: GYAE6OF02G9YSG.17.25.C03.1.454.CMB.1.raw
  modified_base (245)..(245): a, c, t, g, unknown or other
  misc_feature (245)..(245): n is a, c, g, or t
  modified_base (261)..(261): a, c, t, g, unknown or other
  misc_feature (261)..(261): n is a, c, g, or t
  modified_base (293)..(293): a, c, t, g, unknown or other
  misc_feature (293)..(293): n is a, c, g, or t
  modified_base (337)..(337): a, c, t, g, unknown or other
  misc_feature (337)..(337): n is a, c, g, or t
  modified_base (345)..(345): a, c, t, g, unknown or other
  misc_feature (345)..(345): n is a, c, g, or t
  modified_base (417)..(417): a, c, t, g, unknown or other
  misc_feature (417)..(417): n is a, c, g, or t
  modified_base (488)..(488): a, c, t, g, unknown or other
  misc_feature (488)..(488): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcnggattcacgtttaccncctatagtatcaactgggtgcgccaggcccgntggacaacgacctggacgtggatggggatggggcgaaccctaanacgtggtntcacagtgtcttcacccatcctcgggacagacttaccatgaccacgaactcctaccataaaccacagcctanactggattgacggagcctagacatctagaccgacacggcctctattactgtgcgagacgtccagctccggncgacctggctagcgtctttgacttgtcggg

SEQ ID NO: 208864 - DNA, 715 bp, Homo sapiens
  misc_feature: GYAE6OF02F1LTQ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaacgtgggtcgcgccgtaggcccgtcgtgggaccaacgacctggacgtgggatggggagtgggaccgaaaccctaacgacgttcgggtgtacaaccgtagtcggttccttccaaccctacgttcccgtaccggggaacctacgtaacccgtttaccaacgttaccggaaccctaaccggtaaaccctttcccccgtaacccaaaactaaaaccctaccgaaaccgtacccccttaaagaacgttacggggtaacggtttaggaacgggtaacgtcccgttaaggaacctacgttaccgtacggtaaccggaccgtacgggtaccccgttatttaacgttaacctgggttacgccgtagtaccgtcccacgggtaccgttccggtacgacgtacccgtacgggacgtaccggtccgggtccttttccggacgtttccggaccgggg

SEQ ID NO: 208865 - DNA, 774 bp, Homo sapiens
  misc_feature: GYAE6OF02FF17D.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaggcttctggattcacgtttacctctatagtatcaactgggtgcgccaggccgctggacaacgacctgacgtggagtcgggatggggaccgaaccctaacgacgttcgggtacgtccaacgtaggttcggttacctttacccgaaccccgtaacgttcccggtaccccgggggtaacctaacgggtaacccctttaacccgtaacgttaccggaaacccccttaaaccgggtaaaccccttcccccgtttaaaccccaaaaactttaaaaaaccccgacccggtaaaccggtaacccccctttaaacgaaacggttttaggggggtaaaccgtttacgggaaacggggttaaccgttacccccgttaggaaaccctttacgttaccgttaccggaaaccgggtacccgtacccggggtacccgttactttaacgttacccgtggtacgacgtacggtaccgtacccgacggttaacgtccggtagacccgtaccgtacggcgtacggtaccggtcttttaggcccgtttcggaccggggg

SEQ ID NO: 208866 - DNA, 565 bp, Homo sapiens
  misc_feature: GYAE6OF02HSN89.17.25.C03.1.454.CMB.1.raw
  modified_base (136)..(136): a, c, t, g, unknown or other
  misc_feature (136)..(136): n is a, c, g, or t
  modified_base (337)..(337): a, c, t, g, unknown or other
  misc_feature (337)..(337): n is a, c, g, or t
  modified_base (413)..(413): a, c, t, g, unknown or other
  misc_feature (413)..(413): n is a, c, g, or t
  modified_base (420)..(420): a, c, t, g, unknown or other
  misc_feature (420)..(420): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctnttcttggtggcagcagctacaagtgcccactcccaggtgcagctggtgcagtctggggctgaggtgaagagcctggggcctcagtgaaggtctcctgcaaggcttctggattcacgtttacctccttatagtatcaacgtgggtgcgccaggccgctggaccaacgacctggagtggatggggagtgggacgaaccctaanacgtggtgtcacgtagtgtcttcaccctatcccgtcgggactacgacttaccatcgaccacgactccacataaccnagcctanagtgagttgacggagccgtgacatctagacgacgacggctacttagttacgtcgtacgtcgacgacgtcccgacgtacgttccgggagtacgtcccgtacggactcgggtcccggttacgttttcgaccgtttcggtaccggggg

SEQ ID NO: 208867 - DNA, 569 bp, Homo sapiens
  misc_feature: GYAE6OF02FOPO2.17.25.C03.1.454.CMB.1.raw
  modified_base (361)..(361): a, c, t, g, unknown or other
  misc_feature (361)..(361): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaggcttctggattcacgtttacctctatagtatcaactggtgcgccaggccgctggacaacgacctgagtggatgggatggggaccaacccgtaacactggtcgtcacagtgtcttcacccatccncgggacagaccttaccatcgaccacgaactccctacaactaaacacacgaccctacgactaggtagttagaaggacgtccctagacctatacgtcgaaccgtacgacccgggtccgtacttaacttaccgtgtgacgagacgtcccgagtacgtccggtagacgtccctacggcaggtcccggtcctttaggaccttcggtaccgggg

SEQ ID NO: 208868 - DNA, 688 bp, Homo sapiens
  misc_feature: GYAE6OF02IDKO1.17.25.C03.1.454.CMB.1.raw
  modified_base (217)..(217): a, c, t, g, unknown or other
  misc_feature (217)..(217): n is a, c, g, or t
  modified_base (278)..(278): a, c, t, g, unknown or other
  misc_feature (278)..(278): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctgggcctnagtgaaggtctctgcaggcttcgtggattcacgtttacctctatagtactcaacgtgggtncgccaggccgcgtggacaacgacctgagtgggatggggatcggggaccgtaaccctacgacgtggtcgtcacgaggtgtcgttccacccgactaccgtaccgggacacgtaccgttaaccgtactacgtaccaaccggtaacctacccgtccaactaaaaccgaccacgtaccctaacgtacgtacggtacggttagaacgggtacaccgttcgaaccgtagtcgttacggaaccggtaccgtaaccgggtcccgttaccgtactttacgtaccggttacgacccgtaaggaccgttacccgtaaccggtacggttacccggttaacgggaccgttaccccggtaaccgggaccgaccgggtacccgggttcccgttttaacggttacccggttccggttaacccggggg

SEQ ID NO: 208869 - DNA, 612 bp, Homo sapiens
  misc_feature: GYAE6OF02G4APE.17.25.C03.1.454.CMB.1.raw
  modified_base (280)..(280): a, c, t, g, unknown or other
  misc_feature (280)..(280): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgcgtggacaacgacctgagtggatgggagtgggacgaaccctaacgacgtggtgtacactagtgtcttaccaccctactcccgttccgggactaacgtaccttaccacgtcgaaccacgaacctccctaccaaactaaaccacaacgacctaacacgtaggaagtttacggaggacgacctgacagtctagaccgacgaccggcgttacgtactttacgtcgttcggacgtacggacgtaccctaacggcgttaccgggtacggtacgcccgtaacggccgtacggtccggttacccgtttcgtaccgtttcggtaccggggg

SEQ ID NO: 208870 - DNA, 642 bp, Homo sapiens
  misc_feature: GYAE6OF02JXPQH.17.25.C03.1.454.CMB.1.raw
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
  modified_base (354)..(354): a, c, t, g, unknown or other
  misc_feature (354)..(354): n is a, c, g, or t
  modified_base (384)..(384): a, c, t, g, unknown or other
  misc_feature (384)..(384): n is a, c, g, or t
tcagcgtagactagcacgaccggtgctcgatttagtagtgtagatttgggtttgggtaggtcgagtctcagtcaggacacagcatggacatgagggtcccgctcagctcctgggctcctgctactctgctcgagctgccagatgtgacatccagatcgacccagtcctcctactcctccctgtctcgcctctggtgggggtcagngtcacntcacttcgccggacagtcacggtacgttaaaacctatttaagtgtactacagacaagtaaacgtaggaaacgtcccacgaccttcctagtacttccgctagggtcactactaccactctggaccggaagtcggccttccgacncggttaggtcaaggtcggtcagttgggtancgggtacggaacagttacttttacgaacttcgtacccactactaccacctactctcgacacgtagagtagtgtacgacttacgtacttactacgtactaaccgtactaacggtacgttaacctaccgttacccttaccgtacgtttaacgttcggttaaccggtaccgggtaacttacggtacgtaacggtactaacgtaaacgtaaccggttagtaccgtacgttccggtacctaaccgtcgtttactacgttaccg

SEQ ID NO: 208871 - DNA, 736 bp, Homo sapiens
  misc_feature: GYAE6OF02JTD4F.17.25.C03.1.454.CMB.1.raw
  modified_base (297)..(297): a, c, t, g, unknown or other
  misc_feature (297)..(297): n is a, c, g, or t
  modified_base (626)..(626): a, c, t, g, unknown or other
  misc_feature (626)..(626): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagccgtggggcctcagtgaaggtctcgtgcgaaggtcttcgtggtacttcctaccgttttaccctccgtatagtactacaacgttgggtcncgccgaggcccgtgtacggaccaacgtcctaggacgtggagtgggagtcgggaacctaacccgtaactacgtgggtacgtaccaacgtacgttcggttcctttaccaaccccgttacgtccccggtaaccgggacctaacggttacccttaaccgagtttacccgaaaccccgtaaccggtaaacccttccctaaccgtaaactaaaaccgaccgtaaccgtaccctaacgacgtacgggtacgttacggacgggtaacgtccgtaagtacctacgtaccgtacggtaacccgaccgtaacccggtcccgtttaactaacgtttaccgnggttaccgacggtaacgtcccgtaccgtaaccggtacggtcccggtacgaccgtaccgtaccgggtacgtaccggtccggttaccgttcggtacccgtttcgggaccggg

SEQ ID NO: 208872 - DNA, 657 bp, Homo sapiens
  misc_feature: GYAE6OF02IOQ8I.17.25.C03.1.454.CMB.1.raw
  modified_base (283)..(283): a, c, t, g, unknown or other
  misc_feature (283)..(283): n is a, c, g, or t
  modified_base (349)..(349): a, c, t, g, unknown or other
  misc_feature (349)..(349): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttcgtggattcacgtttacctcctatagtatcaacgtggtncgccaggccgcgtaggacaacgacctgagtggagtgggatggggaccaaacccgtaacacgtggtntacgacgtagttcgtaccttacaaccctagtcccgtacgggaactacgtacttaccagtacgaaccaacgaactcctaccaaataaaaccacacgacctaacagttacggaagtttaggaaacggacgtacccgttagaacctagttccgtaggaacccgtaccgtaccgggtccgttactttaaacgttacgtcggtcgacggaacgtaccgttacccacggtaacgttcccgggtagtaccgtacccgttaacgggcctaacgggtcccggttaccttttaacggtaccgttccgggtaccggggg

SEQ ID NO: 208873 - DNA, 706 bp, Homo sapiens
  misc_feature: GYAE6OF02FW5U9.17.25.C03.1.454.CMB.1.raw
  modified_base (277)..(277): a, c, t, g, unknown or other
  misc_feature (277)..(277): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggctctggattcacgtttacctctatagtatcaactgggtncgccaggccgcgtggaccaacggacctgagtggatggggagtcgggacgaacccctaaacgaccgtagggtcgtccactaggttcgtacctttaccgaacccctacgttcccgtacccggggaacctaacggtaaccctttaacccgattcgaaccccgtaccgtaaacctccctaccctaaactaaaaccaaccaacgtaccctaacctacgttacgggtaggtttacggaagggtacgtaccctagaactactacgtcggaaccgacgaccgggttacccgttaccgttaacgtttaaccgtcggttacgtaccggtaacggtaccgttacccgaaccggtaacgtcccgggttagaccggtaccccgttaaccgggcctaacgggtcccgggtacccttttcggtaccgtttccgggtaccggggg

SEQ ID NO: 208874 - DNA, 613 bp, Homo sapiens
  misc_feature: GYAE6OF02JLXCA.17.25.C03.1.454.CMB.1.raw
  modified_base (134)..(134): a, c, t, g, unknown or other
  misc_feature (134)..(134): n is a, c, g, or t
  modified_base (200)..(200): a, c, t, g, unknown or other
  misc_feature (200)..(200): n is a, c, g, or t
tcagcgtagactagcacgaccggtgctcgatttagtagtgtagatttgggtttgggagtcagtctcagtcaggacacagcatggacatgagggtccccgctcagctcctgggctcctgctactctggctccganctgccagatgtgacatccagactgacccagtctccatcctccctgtctgcctctggtggggtcagngtcacatcacttgaccgacagtcacgacgttaaacctatttaatggtatcagacagaactaggaaacgcccagacctcagacgtctcgtgtgcatccactctgacgagtcgccgtccagtccggtagttcgaggtcggactagtaggtactcggtaggactaagtactttacgaacttccgtacaacctactacctaccgtactccgtactactaaccgtaggtagtacttcgtacgactaacttctaaccttaacgtacctacaacgtaggtaaccttaccgtaaccgttcccgttaccgtacctttaacgggttcccggtaaccggtacgggttaaccctaagttacggacgtacgtaacgaaacgtaaccgtgtacggtaccctgacccgtactacgttccgtcgttacg

SEQ ID NO: 208875 - DNA, 549 bp, Homo sapiens
  misc_feature: GYAE6OF02GHRSF.17.25.C03.1.454.CMB.1.raw
  modified_base (442)..(442): a, c, t, g, unknown or other
  misc_feature (442)..(442): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaggcttcgtggattcacgttacctcctatagtatcaactgggtgcgccaggccgctggacaacgacctgagtggatggggatgggcgaaccctaacacgtggtgtcacagtgtcttcacccatccgtccggacagacttaccatcgaccacgaacctcctaccaataaacacacgcctacagtggagttgaggacgcctgactatcngaccgacgaccggtccgtacttattctaggtcacgagtacctccgacgacgtccggtagacgaccgtacggcgacggtccggtacctttggtaccttcggtccgggg

SEQ ID NO: 208876 - DNA, 596 bp, Homo sapiens
  misc_feature: GYAE6OF02FM31Y.17.25.C03.1.454.CMB.1.raw
  modified_base (280)..(280): a, c, t, g, unknown or other
  misc_feature (280)..(280): n is a, c, g, or t
  modified_base (331)..(331): a, c, t, g, unknown or other
  misc_feature (331)..(331): n is a, c, g, or t
  modified_base (342)..(342): a, c, t, g, unknown or other
  misc_feature (342)..(342): n is a, c, g, or t
  modified_base (345)..(345): a, c, t, g, unknown or other
  misc_feature (345)..(345): n is a, c, g, or t
  modified_base (355)..(355): a, c, t, g, unknown or other
  misc_feature (355)..(355): n is a, c, g, or t
  modified_base (366)..(366): a, c, t, g, unknown or other
  misc_feature (366)..(366): n is a, c, g, or t
  modified_base (417)..(417): a, c, t, g, unknown or other
  misc_feature (417)..(417): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggacaaccctaanactggtgtcangtntcttcacccntccgtccgganagacttaccatcgaccacgtaacctccctacaataaaccacacgaccctanactgggtagttggaaggtacgccgtgaacctatcctacggtaccgaaccgccgggccctacttaacgtttactcggtcggaccgtagaccgtcccaacggtaccgttccgggtacgaaccggtcccgtaacgggccgaccggtaccggttcctttacggtacccgtttcggtccggggg

SEQ ID NO: 208877 - DNA, 566 bp, Homo sapiens
  misc_feature: GYAE6OF02FW431.17.25.C03.1.454.CMB.1.raw
  modified_base (280)..(280): a, c, t, g, unknown or other
  misc_feature (280)..(280): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatggggatgggcgaaccctaacactggtgtcgacagtgttcttcacccatcctccgggacagacttaccatgaccacgaacctcctaccaataaacacacgacctacactggtagttgaggagcctgacatcgtagacgaccacgggcccttacttaactttacgtggtagccggagacggtacccacgtacgtccggtagacgtacccgtacggccgaggtcccggtaccttttcggacctttcggtaccggggg

SEQ ID NO: 208878 - DNA, 618 bp, Homo sapiens
  misc_feature: GYAE6OF02HWZ4G.17.25.C03.1.454.CMB.1.raw
  modified_base (280)..(280): a, c, t, g, unknown or other
  misc_feature (280)..(280): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcaccgtttacctctatagtatcaactgggtncgcaggccgctggacaacgacctgacgtggagtgggatcggggaccaaaccctaacacgtggtgtacacgtagtcgttcttccaaccctatcccgtccgggaactacgtaccttaccatcgaccaacgaccctcctaccaataaaccacacgaccctaacagtcggaagttcggacgacgcctgaacattctacggaaccgacgaccgggtccgttacttaacgttaccgtgtcgacgaacgtaccgtaccccgtaggtaccgtcccgggtaggaaccgttacccgtacgggccacgggtacccggttcccgttttagaccgttttccggtccggggg

SEQ ID NO: 208879 - DNA, 676 bp, Homo sapiens
  misc_feature: GYAE6OF02IT4IU.17.25.C03.1.454.CMB.1.raw
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctccgtgcaaggtcttcgtggtattctaacgtttacctctatagtatcaacgtgggtgccgccaggcccgcgtggaccaacggaccgtggacggtggagtgggagtcgggaccgaaacccgtaacacgttggtcgtacgacgtaggtcgttacttaccaacccgtacgtcccgtaccgggactaacgtaccttaaccgataccgaaccctaaccgaaccttccctaaccgaaactaaaccgaccaacgtaccctaacgaggttagggaagttcggaacggtacgtccctagaacctagtccgacggaaccgacgtaccgggtcttacgttaattcgtagtcgaccgtaagaccgtacccaacggtacgttacccgggtagacccggaccgttaacgggctacgggttcccgttacccggtttagtacccgttgggacccggggg

SEQ ID NO: 208880 - DNA, 601 bp, Homo sapiens
  misc_feature: GYAE6OF02IFQYT.17.25.C03.1.454.CMB.1.raw
  modified_base (290)..(290): a, c, t, g, unknown or other
  misc_feature (290)..(290): n is a, c, g, or t
  modified_base (358)..(358): a, c, t, g, unknown or other
  misc_feature (358)..(358): n is a, c, g, or t
  modified_base (439)..(439): a, c, t, g, unknown or other
  misc_feature (439)..(439): n is a, c, g, or t
  modified_base (449)..(449): a, c, t, g, unknown or other
  misc_feature (449)..(449): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctccgtgacaaggtcttcgtggacttcacgtttacctacctatagtatcaacgtgggtncgccaggccgcgtggacaaccgacctagaggtggagtgggatggggacctaaacccgtacacgttggngtcaacgtgttcgtcttccaaccctagtcccgtacgggacaacgtaccttaccatcgaaccacgtaactccacaataaacncacgcctaanagtaggagttcgaaggacgtcctagacatcgtagaccgacgaccggtaccgtattaagttaccgtggtcgacggagtaccgaccgtacgtacgtccggtagaccgtaccgtacggcgtacggccggttacctttacgtaccgtcggtacggg

SEQ ID NO: 208881 - DNA, 592 bp, Homo sapiens
  misc_feature: GYAE6OF02HGGOM.17.25.C03.1.454.CMB.1.raw
  modified_base (283)..(283): a, c, t, g, unknown or other
  misc_feature (283)..(283): n is a, c, g, or t
  modified_base (431)..(431): a, c, t, g, unknown or other
  misc_feature (431)..(431): n is a, c, g, or t
  modified_base (438)..(438): a, c, t, g, unknown or other
  misc_feature (438)..(438): n is a, c, g, or t
  modified_base (453)..(453): a, c, t, g, unknown or other
  misc_feature (453)..(453): n is a, c, g, or t
  modified_base (456)..(456): a, c, t, g, unknown or other
  misc_feature (456)..(456): n is a, c, g, or t
  modified_base (461)..(461): a, c, t, g, unknown or other
  misc_feature (461)..(461): n is a, c, g, or t
  modified_base (464)..(464): a, c, t, g, unknown or other
  misc_feature (464)..(464): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcgagtgaaggtctcctgcaaggcttctggattcacgtttacctcctatagtatcaacgtgggtncgccaggccgcgtggacacgacctgagtggatgggagtgggacgaacctaacacgtggtgtacacgagtcgtccttacaccctatcccgtaccgggacacgtaccttaccatacgaccaacgtacctccctaccaataaacccacganccctaanagtggagttgagacnccngaccntcnggaccgacgccggctacttacttacgtggtacgcgacgacgttcccgaaggtcgtcccgggttagaaccgtcccgtaacgggcctaacgggtcccggttcccgttttagacccgttcggtaccggggg

SEQ ID NO: 208882 - DNA, 661 bp, Homo sapiens
  misc_feature: GYAE6OF02GEV3J.17.25.C03.1.454.CMB.1.raw
  modified_base (293)..(293): a, c, t, g, unknown or other
  misc_feature (293)..(293): n is a, c, g, or t
  modified_base (449)..(449): a, c, t, g, unknown or other
  misc_feature (449)..(449): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcagtgaaggtctcctgcaaggcttctggattcacgtttacctctatagtatcaacgtgggtgcgccaggccgntcggacaacgcctgagtggagtcgggagtcgggaccgtaacccctaagtacgtgggtcgtcacgaggttcgttccttccacccgtactcccgtacgggacacgtacctaccatcgaaccacgtaacctccctacaactaaacacgactaccctaangtacggtagttcgggaggtacgtccttagacctattcctacggtaaccggaccgtacccgggtacccgtagtttaccgttaccgttcggtcggtaccggaggtacccgtacccgtaacggtccggttaccggggtacgtaccgggtccccggttacggaccggtcgggtacccggttccggtttacgtacccggttttcgggacccgggggg

SEQ ID NO: 208883 - DNA, 584 bp, Homo sapiens
  misc_feature: GYAE6OF02FUPE9.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtgcgccaggccgctggacaacgacctgagtggatggggatggggcgaaccctaacactgggtgtcacagtgtcttccacccatccgtccgggacagacttaccatcgaccacgaacctccctacaataaaccacacgccctaacagtcgggaagtttcggagggacgtccctgactatcctagaccgacaccgggtccgtacttacttactggtgacgacgtacgcccacgtacgtccgggtgaaccgtcccgtaacgggcctaacggtcccgggttccttttacggtaccgtttcggtaccggggg

SEQ ID NO: 208884 - DNA, 623 bp, Homo sapiens
  misc_feature: GYAE6OF02JQPXB.17.25.C03.1.454.CMB.1.raw
  modified_base (459)..(459): a, c, t, g, unknown or other
  misc_feature (459)..(459): n is a, c, g, or t
  modified_base (468)..(468): a, c, t, g, unknown or other
  misc_feature (468)..(468): n is a, c, g, or t
  modified_base (496)..(496): a, c, t, g, unknown or other
  misc_feature (496)..(496): n is a, c, g, or t
tcagcgtagactagcacgaccggtgctcgatttagtagtgtagatttgggtttggggtacgtcaacaaccacatctgtcctctagagaaaaccctagtgagcacagctcctcaccatggactggacctggaggatctcttcttggtggcagcagctacaagtgcccactcccaggtgcagctggtgcagtcgtggggctggaggtgaagaagccgtggggccttcgagtggaaggtctcctgcgaggtctctggattcacgtttcctctatatactcacgtgggtgccggccacggccgcgtcggacaacgtacctggacggttggagtcggggagtcggggaccgtaacccgtaacgtacgtgggtacgtcgacgtaggttcgtcttccgacctacgttccgaccgggacacgtaccttaccgatcgaacctacgtacctacctccaaactaaccacncgtacctanacgtggtccgttaggagacgactgactntacgtacgacgacgaccgttccgtacttacgttcgtcgtagcggtaacgaccgttccacggtaacgtccggtggtaacgtcccgtcgacggtccggtccggttccttacggtccgttcgggaccggg

SEQ ID NO: 208885 - DNA, 652 bp, Homo sapiens
  misc_feature: GYAE6OF02JSE7X.17.25.C03.1.454.CMB.1.raw
  modified_base (641)..(641): a, c, t, g, unknown or other
  misc_feature (641)..(641): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagccgtggggcctcgagtagaacggtctccgtagcgaaggtcgttcgtggtattcctaccggttttacctccttaattacgtattaccaaacgttggggtcgtaccgccgacggccgcgtacggaacctaaccggtacctaggaggtaggaagtggggagtcgggaccggaaccctagacgtgggtactcacgagttcgtccttacacccgtctcccggtacgggaactaggtaacccttacgactacgaacccgtaacgtaacccttcccgtaaccaaactaaacgacccgaacgtacctaagacgtaggtacgttagacggagtcctagactagtcgtagaaccgacgtcggaccttattacgtacgtcgacgtacgacgtccaacccggtgtacgtccgagcgaccggtagaccgtgcccggttattaccgngttacggcggg

SEQ ID NO: 208886 - DNA, 789 bp, Homo sapiens
  misc_feature: GYAE6OF02IQ6RI.17.25.C03.1.454.CMB.1.raw
  modified_base (680)..(680): a, c, t, g, unknown or other
  misc_feature (680)..(680): n is a, c, g, or t
tcagcgtagactagcacgaccggtgctcgatttagtagtgtagatttgggtttggggactcaacaaccacatctgtcctctagagaaaccctgtgagcacagctcctcaccatggactggacctggaggactcctcttcttggtggcagcagctacagtgcccactcccgaggtcgcagctggtgcagtcgtggggctggaggtgaagagccgtgggcctcaggtgaggtctcctgcaaggcttcgtggatttccgtaccgtttacctcctagttagtatcgaacgttgggtcggccgccgtagggcccgtcgtacggaacctaaaccggaaccgttggagggtacggtacggtacgggggagttacggggacccggtaaaaccctaacgaccgttgggtacgtaccgacgtaagggtttcgttacccgtttaccgaacccccgtacgttccccgggttaacccggggaaacctaacggttacccctttaacccgtaaaggttcccgaaacccggtaccggttaaaaccccgttcccgtaaaccccgttaaaataaacccgaaccgtacggttaacccccgtaactagggttacgggtaatttaacgggaggtaccgtacgtcggaactcggtacgttacggaaccgaaccgtaccggggtaccttaccgtatttaacgnggtacgaccgtaacgcgtaacccgacggtccggttaccggcgtaacgttacccgacggtacgtaaccggccgggtttaccctttacggtaccgttccgggaaccggggg

SEQ ID NO: 208887 - DNA, 729 bp, Homo sapiens
  misc_feature: GYAE6OF02JE9PJ.17.25.C03.1.454.CMB.1.raw
  modified_base (248)..(248): a, c, t, g, unknown or other
  misc_feature (248)..(248): n is a, c, g, or t
  modified_base (284)..(284): a, c, t, g, unknown or other
  misc_feature (284)..(284): n is a, c, g, or t
  modified_base (355)..(355): a, c, t, g, unknown or other
  misc_feature (355)..(355): n is a, c, g, or t
tcagcgtagactagcacgaccggtgctcgatttagtagtgtagatttgggtttggggtacgtcaacaaccacatctgtcctctagagaaaaccctgtgagcacagctcctcaccatggactggacctcggaggatcctcttcttggtggcagcagctacaagtgcccactcccaggtgcagctggtgcagtctggggctgaggtgaagaagcctggggcctcagtgaaggtctcctggcaaggcttcnggattcgacgttacctcctatgtatcacgtggtgcnccaggtccgcgtaggacgaacgacctggacgtcgggacgtggggaatcggggacgaaaccccgttaaaccncggtagggttcgtacccgaagtacggttggtacctttaccgaccccgtaacgtcccgtacccgggggtaaaccctacggtaaccctttaaccgaacgttcggaaccctaaaccgggtaaaccttccccggttaacccaaaacttaaacccgaacgtaacccgggtaccctaacgaacgttacggggaagtttacggaacggtaacgggtccttacgaaccgtagttaccttgggaaaccgttcggaacccgtcccgtaacgtttactttaaacccgtgggtaaaccgcgtaaggaccgttccggaaccgttacggtccggtacggtacgacccgttcggatacgggtcccgtcgtttacgcgttcgtaccgggg

SEQ ID NO: 208888 - DNA, 579 bp, Homo sapiens
  misc_feature: GYAE6OF02GM9Z2.17.25.C03.1.454.CMB.1.raw
  modified_base (259)..(259): a, c, t, g, unknown or other
  misc_feature (259)..(259): n is a, c, g, or t
  modified_base (279)..(279): a, c, t, g, unknown or other
  misc_feature (279)..(279): n is a, c, g, or t
  modified_base (289)..(289): a, c, t, g, unknown or other
  misc_feature (289)..(289): n is a, c, g, or t
  modified_base (329)..(329): a, c, t, g, unknown or other
  misc_feature (329)..(329): n is a, c, g, or t
  modified_base (439)..(439): a, c, t, g, unknown or other
  misc_feature (439)..(439): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttaccncctatagtatcaactgggtncgccaggccnctggacacgcctgagtggagtgggatcgggacaaacctanacgtggtgtacacgagtgtccttccacccatccgtaccgggacacgtaccttacatacgaccacgtaactccaccaataaaccacacgacctacagtggagttggacganccgtagactagtctagacgacgcggccgttactagttacgtgacgacgacgtacgtacccaagtcggtacccggtagaccgtacccggtacggaccacgggtccggttaccgtttacggtaccgttccgggtaccggggg

SEQ ID NO: 208889 - DNA, 655 bp, Homo sapiens
  misc_feature: GYAE6OF02JJYZX.17.25.C03.1.454.CMB.1.raw
  modified_base (194)..(194): a, c, t, g, unknown or other
  misc_feature (194)..(194): n is a, c, g, or t
  modified_base (201)..(201): a, c, t, g, unknown or other
  misc_feature (201)..(201): n is a, c, g, or t
  modified_base (304)..(304): a, c, t, g, unknown or other
  misc_feature (304)..(304): n is a, c, g, or t
  modified_base (377)..(377): a, c, t, g, unknown or other
  misc_feature (377)..(377): n is a, c, g, or t
  modified_base (446)..(446): a, c, t, g, unknown or other
  misc_feature (446)..(446): n is a, c, g, or t
  modified_base (585)..(585): a, c, t, g, unknown or other
  misc_feature (585)..(585): n is a, c, g, or t
tcagcgtagactagcacgaccggtgctcgatttagtagtgtagatttgggtttgggggtacgtcaacgaaccacatctgtcctctagagaaaaccctgtcgagcacagcgtcctcaccatggactggacctggaggactcctcttcgttggtggcagctagctacagtcgcccactccaggtgacagcctggtncagtcgngggctgaaggtgaacggaacgccgtggggcctctaggtcgaacggtctccctgcgaagggccttgcggtattctacgtttaactcctatacgtatactaccgnggtgccgacaggtcccgcgtaggccaaacgcctggtaagtcgacgtggagtcggacgacctaactacgtcggngtccagtacgttgccttctacccagttcccgcgggtaaccgataacccgtttcccgaattcccggaaanacccgtaaaccgtcccgtaccgtaactaaacccgaaaccacggtaaccttacaccgtaggtacggttcgaagtacggtcgaccgtagaacttcgttacgactacgccgtaccgtcgttactaacgttcgtagccgtagngtacccgacgtacgtaccgttggacgtaccgttcggcacggtccggccttacgttacggtcgtaccgggg

SEQ ID NO: 208890 - DNA, 726 bp, Homo sapiens
  misc_feature: GYAE6OF02JU76E.17.25.C03.1.454.CMB.1.raw
  modified_base (595)..(595): a, c, t, g, unknown or other
  misc_feature (595)..(595): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagccgtgggcctcagtgaaggtctcctgcaaggcttcgtggattcacgtttacctcctatagtactcgaacgtgggtagccgccgaggcccgcgtaggaccaaccgtaccgtgaggtggacgtgggagtcgggaccgaaccctaacgacgttcgggtactaccgacgtagttacgttcctaccaccctacgtcccgtaccgggaacaacggtacccttaccgagttccgaacccgtaaccgtaacctttcccacctaaacgttaaaccaacccgtacgtacccttaaagacgttacgggtaagttacggaacggttaccggtcctaaacgggaactacgtttccgaacggaacccgaacggcccggggtcccttagttaacgtttaccgnggttcggacctaacgggtcctaacccccggtacgtaacggtttcccggacgggaaccgttacccgggtaacggacccgtaacgggtccggttaccccgtttttcgtaacccgggtttccgggacccggggg

SEQ ID NO: 208891 - DNA, 563 bp, Homo sapiens
  misc_feature: GYAE6OF02GHI67.17.25.C03.1.454.CMB.1.raw
  modified_base (297)..(297): a, c, t, g, unknown or other
  misc_feature (297)..(297): n is a, c, g, or t
  modified_base (343)..(343): a, c, t, g, unknown or other
  misc_feature (343)..(343): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtncatccactctgcgaagtggctccatcgagttcagtggcagtgatcngggacagtatttcaatctacaccatcaccactctgacaacctgagtattgtgacaattctactactgtacaacagtagttacacgtttcccctgtaccttacgttttcggaccgtaacggggtaaccctaaggttacggaagtaaacgttaaccgaaaaccggtaaacgttcggttacggtaccttacggaccctaacccgtacttaccgttcgttaccc

SEQ ID NO: 208892 - DNA, 585 bp, Homo sapiens
  misc_feature: GYAE6OF02JIOCL.17.25.C03.1.454.CMB.1.raw
  modified_base (457)..(457): a, c, t, g, unknown or other
  misc_feature (457)..(457): n is a, c, g, or t
  modified_base (462)..(462): a, c, t, g, unknown or other
  misc_feature (462)..(462): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctggaggtgaagaagccgtggggcctcagtgaaggtctcctgcaaggtctcgtggtacttcgtaccgtttacctccgtaatagtatcaacgtggtgcgccacggccgctggacacgacctgagtgagtgggatcgggccaacctaacgacgtggtgtcacgtagtcgtcttacacccgtagtccgtcggaactacgtactacagtcgaccacgtacctcctacaactaaccacacgtactaacagtcggagttacggacgtacnccgtnaccgtagtcgtaggaccaccgtaccggtccgttaactacgttacgtgtcgacgtagtacgtaccgacgtacgtcggtcgaacgtccgtagctacggtccgttacgttcgtacgtcggtacggg

SEQ ID NO: 208893 - DNA, 797 bp, Homo sapiens
  misc_feature: GYAE6OF02FYZDM.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctctatagtatcaacgtgggtgcgccgaggcccgcgtgggaaccaaccggaccgtggacggtggagtggggatggggaccgaaacccgtaacgacgttgggtacgtacacgtagttgtcctttaccaccccgaacgttccccggtaccggggtaacctacggtaaccctttaacccgaacgttacggaacccgtaacccggtaaaaccctttcccctaacccgtaaactaaaaacccctaccgtaaaccggtaccccttaaaacgaacggtttaggggtaacggttttacggggaacggggtaccgtacccgttacggaaacccgtaaccgtttaccgtacgggtaaaccccggtaacccggaacccggggttaccccgttacgtttaaaccgttttaacgttcggtacgggtaccggtaacggtacccggttaccccgtaacgggtaaccgttaccggggttacgaaccgggtaccccgttaacgggccgtaccgggtcccgggttaccttttacggtaccggtttccggtaccggggg

SEQ ID NO: 208894 - DNA, 661 bp, Homo sapiens
  misc_feature: GYAE6OF02I5SWZ.17.25.C03.1.454.CMB.1.raw
  modified_base (430)..(430): a, c, t, g, unknown or other
  misc_feature (430)..(430): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccgaggtgcagctggtgcagtcgtgggctgaggtagaagaagccgtaggggcctcgagtggaaggtcctccgtgaccgaaggtcttcgtggtattccaccgtttacctcctatagtatcaacgtgggtcgcgcccgaggcccgtcgtacggaaccaacgaccgtggacggttggagtggggatcgggaccgtaaaccgtacgactgggtatccacgtaggttcgtcctccaccctagtcccgtacggacacgtacttaccancgacctacgaacctcccaacaactaacacgacactagacgtagtacggttgaggtacgccgtacgactaacgtcgtacgaacgtccgaccggtccgttacttacgtaccgttggtcgacggtaagtaccggtacccgaacggtaaccggttcccggacggtaccggtacccggtacgggccgtacgggtcccggtttaccggtttaccgtaccggttttcgggaccggggg

SEQ ID NO: 208895 - DNA, 554 bp, Homo sapiens
  misc_feature: GYAE6OF02GZ03L.17.25.C03.1.454.CMB.1.raw
  modified_base (280)..(280): a, c, t, g, unknown or other
  misc_feature (280)..(280): n is a, c, g, or t
  modified_base (424)..(424): a, c, t, g, unknown or other
  misc_feature (424)..(424): n is a, c, g, or t
  modified_base (476)..(476): a, c, t, g, unknown or other
  misc_feature (476)..(476): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgcgtggacaacgacctgagtggatgggatgggcgaaccctaacacgtgggtgtcacgagttgtcttcacccatccgtaccgggactagacttaccatcgacccacgaactcctaccaataaaccacagaccctanatggagttgagacgcctgacatctagaccgacgacgtccgtacgtattacgngtacgcgtagacgtcccagacgtccggtagacgccctacgggcaacggtccggtacctttggaccttcggtaccgggg

SEQ ID NO: 208896 - DNA, 706 bp, Homo sapiens
  misc_feature: GYAE6OF02H8A39.17.25.C03.1.454.CMB.1.raw
  modified_base (591)..(591): a, c, t, g, unknown or other
  misc_feature (591)..(591): n is a, c, g, or t
tcagcgtagactagcacgaccggtgctcgatttagtagtgtagatttgggtttggggactcaacaaccacatctgtcctctagagaaaaccctgtgagcacagctcctcaccatggactggaccttgaggatcctcttcttggtggcagcagctacaagtgcccactcccaggtgcagctggtgcagtcgtggggctgaggtgaagagccgtgggcctcgagtgaaggtcctcctgcaggcttgtggattcacgtttacctcctatagtatcaacgtgggtgcgccaggcccgctggaaccaacgtccgtgaggtggacgtgggacgtgggaccgaaccctaacgacgtggtcgtaccgacgtaggttcgttaccttaccgaaccctacgttcccgtaccggggaactacggttaaccctttaacccgagttacgaaacccgtaaccggtaacccttacccgtaacctaaactaaaaccaccgaacgtacccctaaacacggttagggaacgtttcggaacgggtacgtaccgtgaacctcgtacgttacggaacccgacgtaccgggtaccgttacttaacgtttaccgnggttacgacggtaccgtaccgtacccgaacggtccggttaccggtaggaacccgtacccgtacgggtccgacgggtcccggttaccgttttacggtaccggttcggtaccggggg

SEQ ID NO: 208897 - DNA, 532 bp, Homo sapiens
  misc_feature: GYAE6OF02GVGIZ.17.25.C03.1.454.CMB.1.raw
  modified_base (280)..(280): a, c, t, g, unknown or other
  misc_feature (280)..(280): n is a, c, g, or t
  modified_base (335)..(335): a, c, t, g, unknown or other
  misc_feature (335)..(335): n is a, c, g, or t
  modified_base (352)..(352): a, c, t, g, unknown or other
  misc_feature (352)..(352): n is a, c, g, or t
  modified_base (400)..(400): a, c, t, g, unknown or other
  misc_feature (400)..(400): n is a, c, g, or t
  modified_base (424)..(424): a, c, t, g, unknown or other
  misc_feature (424)..(424): n is a, c, g, or t
  modified_base (430)..(430): a, c, t, g, unknown or other
  misc_feature (430)..(430): n is a, c, g, or t
  modified_base (434)..(434): a, c, t, g, unknown or other
  misc_feature (434)..(434): n is a, c, g, or t
  modified_base (457)..(457): a, c, t, g, unknown or other
  misc_feature (457)..(457): n is a, c, g, or t
  modified_base (484)..(484): a, c, t, g, unknown or other
  misc_feature (484)..(484): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgcctgagtgatgggatgggcgaacctaacactggtncacagtgtcttcacccntcctccgggacacgacttaccatcgaccacgaactccaccaataaacncagcctaacagtggagttgaggcnctgacngtcngaccgacacggcctatatttacngtagcgagtactcccgagacttccggngacgtccgtacggcacggtccggtccttttggaccttggtaccggggg

SEQ ID NO: 208898 - DNA, 693 bp, Homo sapiens
  misc_feature: GYAE6OF02J0IM7.17.25.C03.1.454.CMB.1.raw
tcagcgtagactagcacgaccggtgctcgatttagtagtgtagatttgggtttggggacgtcaacaaccacatctgtcctctagagaaaaccctgtgagcacagctcctcaccatggactggacctggaggatcctcttcttggtggcagcagctaacaagtgcccactcccaggtgcagctggtgcagtcgtgggctggaggtggaagaaggccgtggggcctcgaggtgaaggtctcctgacgaagggtcttctggatttcacgtttacctccttatacgtatcgaacgtgggtcgcgccgacggccgcgtaggaccaaccgctggagtgggagtgggacgtcgggaccgaaccctacgacgtggtcgctacgtaggttgtaccttccaacccgtacgtacccggtaccggtaacgtacgtaacctacgacgttacgaccctaacgtaacctccctaaccgaaactaaacccgacaccgtaccttaaccgagttacggtagttaaggaaccggcgtacccgtacgtaacgaaccgtttcgacgggtaaccgacccggtacccggttacgtaccttttaaaggttccgttaggaccgcggtaacgtacccggtcccgaacggtactccggggtaatacccgtccggtaacgggccaacgggtcccgttacgttcgtaccgttcggaccgggg

SEQ ID NO: 208899 - DNA, 813 bp, Homo sapiens
  misc_feature: GYAE6OF02IEFHM.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagccgtgggcctcgagtgaaggtctcctgcgaaggtcttcgtggatttccgacgttttacctaccttatagtaactcaaaccgtggggttacgccgtaccgacgggtcccgtccgttacggggaacctaaaccggtacccgttaggaagggttccgggaagttcggggggaacttacggggggacccgtaaaaaccccgttaaacggaaccgttggggtacgttaccgtaacgtacgggttacgtttccttaccctaaccccgtaacgttccccgtacccgggggtaacaacggtacccgtttaacccagttacccggaacctaaccggtaaaccctttacccctacctaaactaaaacccaccgtaaacggtacccttaaacgacgtttacgggtaacggtttagggacgggtaacgccctacggtaaccaacttccggtaacgaaccgaccgaccggtcccgttaacttaacgttaaccgtcggttagaaccggtagaccgtccccgtaacggtacgttccccggtaggaacccggtacccgtaacgggtccgaacggttccccgggtttaccgtttacggtacccgtttaccgggtacccggggg

SEQ ID NO: 208900 - DNA, 697 bp, Homo sapiens
  misc_feature: GYAE6OF02GTOZP.17.25.C03.1.454.CMB.1.raw
  modified_base (280)..(280): a, c, t, g, unknown or other
  misc_feature (280)..(280): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctcctgcaaggcttctggattcacgtttacctctatagtatcaatggtncgccaggccgctggacaacgacctgagtggagtgggatggggcaacccgtaacacgtgggtcgtacacgagtgtccttcacccgtactccgtaccgggactacgtacttaccagtcgaacccacgtaacctccctaccaaataaaccacaacgtaccctaacgaagttacgggaagtttacggaacgggaacggtccctaagaacctacgttaccgtacggaaccgaacccgtacccggggacccgtttaccgttaaacgttttaacccgtggttacggaaccgggtacgtacccggtacccccgaagggttaacccgttcccggggttaacgggaccggtaccccggtaaccgggtaccgtacgggtaccccgggttaccccttttcggggaccctttttacgggtacccgggggg

SEQ ID NO: 208901 - DNA, 773 bp, Homo sapiens
  misc_feature: GYAE6OF02IXZZE.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatctcttcttggtggcagcagctacaagtgcccactcccaggtgcagctggtgcagtcgtggggctggaggtagaagaagccgtggggcctcgaggtgaacggtctccgtgaccgaaggcttcgtggtattcctacgtttacctcctattagtactcgaacgtggggtctcgccgagggcccgtcgtacgggaacccaaacggaccgtaggtagggtcgggtaaggttcgggggagttaccgggggaacccgtaaaaccccgtaactaccggttgggtacgttaccgaacggtacggtttcgtccctttaccaaccccgtataccccggtaccgggacaaccgtaccttaaccacgttaccgaacctaacccggaccttcccctaacaaaccttaaaacgaacctacgaacccttaacaggtacggtaacggttacggaacggtaacgccgttaacgactaagtcccgtaacgaaccggtaccgaccgggttccgttaaccttaacgtttagacgggtaacgaccggtaacggtaccgacccgtaacggttaacgtacccgggtacggaaccgttccccggaacggtccggtaccggttacccgggttccgttttacggttacccggttcgggtacccggggg

SEQ ID NO: 208902 - DNA, 592 bp, Homo sapiens
  misc_feature: GYAE6OF02H8LAM.17.25.C03.1.454.CMB.1.raw
  modified_base (282)..(282): a, c, t, g, unknown or other
  misc_feature (282)..(282): n is a, c, g, or t
  modified_base (342)..(342): a, c, t, g, unknown or other
  misc_feature (342)..(342): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcaccgttttactcctatagtatcaacgtgggtncgccaggccgctggacaacgacctgagtgatgggatgggacgaaacctaacgactgggtntacacagtgtcttcaccctatcccgtccgggaatacgacttaccatcgaaccacgaactccctacaataaaccacacgacctaacagttagggagttacggacggtaagcccttaggaactatccgttagaacgaccgaccggccgttacttaattaccgtgtacgacgaagtaccgtcccgacggacgttccggtgaccgtacccgtaggccgacggtccggtaccttttcggacgttccggtacgggg

SEQ ID NO: 208903 - DNA, 779 bp, Homo sapiens
  misc_feature: GYAE6OF02IEOCR.17.25.C03.1.454.CMB.1.raw
  modified_base (281)..(281): a, c, t, g, unknown or other
  misc_feature (281)..(281): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtgggcctcagtgaaggtctcctgcaaggtcttctggattcacgtttacctcctaatagtatcaatgggtncgccaggccgctggacaacgacctgagtggatggggatggggaccgaaaccctaacacgtggtacgacacgagtcgtcttaccgacccctatcccgtaccgggactaacgtacctttaaccagttcggaacccaacggtaaaccctttacccctacccgtaaaataaaaacccgtacctaaaggtaccccttaacgtaacgttacgggtaacggtttacgggaaacggtacgggtaccctttaagggaaaccaaacgtttaccgttaaccgggaaacccgggtaacccgtaaacccgggggttaccccggttaactttaaaccgtttaaccgtaacgggttcgggaaccgggtaacgtacccgggttacccccgtaaaccggtaccggttaccccgggtaacggacccgggttaaccccgttaaccggggaccgtaacgggtccccggggtttacccttttttacgggtacccggtttcccgggttaacccggggggg

SEQ ID NO: 208904 - DNA, 547 bp, Homo sapiens
  misc_feature: GYAE6OF02FR08S.17.25.C03.1.454.CMB.1.raw
  modified_base (280)..(280): a, c, t, g, unknown or other
  misc_feature (280)..(280): n is a, c, g, or t
  modified_base (332)..(332): a, c, t, g, unknown or other
  misc_feature (332)..(332): n is a, c, g, or t
  modified_base (507)..(507): a, c, t, g, unknown or other
  misc_feature (507)..(507): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatggggcgaaccctaanactggtgtcacagtgtccttcacccatcccgtaccgggacacgaccttaccatcgaccacgaactcctaccaataaacacacgccctaacagtggagttgaggacgcctgacatcgtaggacgagtaccggccgttactattcgtgtgacgagcgtacccgacggtctccggtancgtccgtacggcacggccgtaccgtttgaccttgtcgggg

SEQ ID NO: 208905 - DNA, 547 bp, Homo sapiens
  misc_feature: GYAE6OF02IJE7R.17.25.C03.1.454.CMB.1.raw
  modified_base (442)..(442): a, c, t, g, unknown or other
  misc_feature (442)..(442): n is a, c, g, or t
tcagcgtagactagcacgaccggtgctcgatttagtagtgtagatttgggtttggggactcaacaaccacatctgtcctctagagaaaaaccctgtgagcacagctcctcaccatggactggacctggaggatcctcttcttggtggcagcagctacaagtgcccactcccaggtgcagctggtgcagtctgggctgaggtgaagagcctggggcctcagtgaaggtctcctgcaaggcttctggattcacgtttacctcctatagtatcaactgggtgcgccaggccgcgtggacaacggacctgagtggatgggatgggcaacccgtaacacgtggtgtcacagtgtcttcacccatcccgtcggacagactaccatgaccacgaactcctccaactaaacactacgcctaacatggtagttgaggagacctgacatacngaacggacacggccgtactagttactgtcgacgagacgtcccaacggactccggtgaccggaccgtacggcacggtccgtaccgtttcgaccgttctaccggggg

SEQ ID NO: 208906 - DNA, 781 bp, Homo sapiens
  misc_feature: GYAE6OF02GY87V.17.25.C03.1.454.CMB.1.raw
  modified_base (243)..(243): a, c, t, g, unknown or other
  misc_feature (243)..(243): n is a, c, g, or t
  modified_base (290)..(290): a, c, t, g, unknown or other
  misc_feature (290)..(290): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttcnggattcacgtttacctcctatagtatcaactgggtgcgccaggccgntggacaacgacctgagtggatgggatcggggcgaaccctaacgacgtggtgtcacgagtgtcttcaccctactcccgtaccgggacacgaccttaaccagttacgaacccgacgtaaacccttccctaccgaaacttaaaaccgaccaacgtacccttaacgtacgttacgggtaacggtttaggaacggggtaacgtacccgttacgggtaacctaacgttcccgttaagggaacccggtaacccgtaacccgggggtaccccgtttaaccgttaaaccgttttaaaccggttccggttaacgggtacccgggtaacgggtacccgggttacccccccgaaacgggttaaccggtttaccccggggggttaacggtaaacccgggttacccccggtttaaccccggggacccgtaaccgggggtcccccgggggtttaaccccgtttttacggggtaccccgtttttaccgggttaaccccggggggggg

SEQ ID NO: 208907 - DNA, 596 bp, Homo sapiens
  misc_feature: GYAE6OF02F7RLT.17.25.C03.1.454.CMB.1.raw
  modified_base (286)..(286): a, c, t, g, unknown or other
  misc_feature (286)..(286): n is a, c, g, or t
  modified_base (434)..(434): a, c, t, g, unknown or other
  misc_feature (434)..(434): n is a, c, g, or t
  modified_base (444)..(444): a, c, t, g, unknown or other
  misc_feature (444)..(444): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggtattccacgtttaccctcctatagtatacaacgtgggtncgccaggccgctggacaacgaccgtgagtggatgggagtggggacgaaccctaacgacgtggtcgtcacgtagtgtccttaccacccctatcccgtaccgggacacgtaccttaccatacgaccaacgaacctcctaccaactaaacncacgcctaanacgtgggaattggagacgtcctagactatctagaaccggtacaccgggtccgttacttagttacctggtagcgaacgtacgtcccaagcgttccgggtagaccgccgttacggcctcggccggttccgtttacggacttccggtaccggggg

SEQ ID NO: 208908 - DNA, 546 bp, Homo sapiens
  misc_feature: GYAE6OF02FXDYF.17.25.C03.1.454.CMB.1.raw
  modified_base (506)..(506): a, c, t, g, unknown or other
  misc_feature (506)..(506): n is a, c, g, or t
  modified_base (519)..(519): a, c, t, g, unknown or other
  misc_feature (519)..(519): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattctacgtttacctctatagtatcaacgtggtgcgccaggccgctggacaacgactgagtggatgggatgggacgaaccctaagacgtggtcgtcacgtgtcgtcttccaccctatcccgtacgggacagtaccttaccgatcgaccacgaactccctacaactaaacacacgacctacatggagttgagcgcctagactagtcgtagacgacgaccggcttctattcgtgtgcgtacgcgtacccaggtactccggtnacgccgtacggcncggccgtacctttgaccgttgacgggg

SEQ ID NO: 208909 - DNA, 814 bp, Homo sapiens
  misc_feature: GYAE6OF02ILALE.17.25.C03.1.454.CMB.1.raw
  modified_base (278)..(278): a, c, t, g, unknown or other
  misc_feature (278)..(278): n is a, c, g, or t
  modified_base (287)..(287): a, c, t, g, unknown or other
  misc_feature (287)..(287): n is a, c, g, or t
  modified_base (334)..(334): a, c, t, g, unknown or other
  misc_feature (334)..(334): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctctatagtatcaactgggtncgcaggccnctggacaacgcctgagtggatgggatcgggcaaccctacacgttggngtacaccgtagtgtacctttaccgaccctacgttcccgtacccgggggaactacgtaaccctttaccgaacgttacgaaccccgtaaacggaaacccctttccctaacccctaaacttaaaaacccgacctaaacggtaccccttaaacgtaacgttacgggggtaacgttttacgggaaacggggtaaccgtacccgttaacgggtaaaccctaacgtttacccgttaagggaaaccccgggtaaaccggtaaccccgggggttaccccggtttaaccttaaaaccgtttttacccggttacggtaaccgtaccgggtaaacgggtacccggttaaccccccgtaaaccgggtcgggtttaccccggggtaacggtaacccggttaccccgttaacccgggggaccgtaaaccggggttcccccggggttaaccctttttacgggtaaccccggttttccgggttaaccccgggggggg

SEQ ID NO: 208910 - DNA, 612 bp, Homo sapiens
  misc_feature: GYAE6OF02H15UH.17.25.C03.1.454.CMB.1.raw
  modified_base (184)..(184): a, c, t, g, unknown or other
  misc_feature (184)..(184): n is a, c, g, or t
  modified_base (502)..(502): a, c, t, g, unknown or other
  misc_feature (502)..(502): n is a, c, g, or t
  modified_base (571)..(571): a, c, t, g, unknown or other
  misc_feature (571)..(571): n is a, c, g, or t
  modified_base (586)..(586): a, c, t, g, unknown or other
  misc_feature (586)..(586): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtncagtctggggctggaggtagaagaagccgtggggcctcgagtgaaggtctcctgcaaggcttcgtggtattctacgtttacctcctatacgtatcaacgtgggtcgcgccaggccgcgtaggaccaaacgcctaggaggtaggagttggggagtcggggaccgtaaaccctaacgacgtcgggtacgtcacgtaacgttgttccttaccaacccgtactacccggtccgggacacgtaccttaccagtacgaccaccacctcctaccaactaaacacaccgactaactgtaggattcggaaggcgtacagactctacncggaaccgcgacggtccgttatacttacgtggtcgacgagacccgtacgacgtacgttcggaggtaccnccggtacgcgtacgnggttaccctggtccgtcggtacgggg

SEQ ID NO: 208911 - DNA, 622 bp, Homo sapiens
  misc_feature: GYAE6OF02GAVGG.17.25.C03.1.454.CMB.1.raw
  modified_base (260)..(260): a, c, t, g, unknown or other
  misc_feature (260)..(260): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttaccncctatagtatcaactgggtgcgccagggccgctggacctaacgacctggacgtggatggggatggggaccgaacccttacgacgttggtcgtcacgaggtgtccttcacccatcctccgggacagtaccttaccgatcgaccacgtaacctcctccaataacacacgcctaacatggtagttagacggtcgacctagacacgttcgtcgtaacgaccgtaccggtcccgtaccttaagttaccgtcggtacgtacggtacgtacgtaccccgtaacggtaacggtcccgggttaggaaccgtcccggtaacgggacctacgggtacccgggtcctttacggtaccgtttccggtaccggggg

SEQ ID NO: 208912 - DNA, 578 bp, Homo sapiens
  misc_feature: GYAE6OF02F4HXY.17.25.C03.1.454.CMB.1.raw
  modified_base (263)..(263): a, c, t, g, unknown or other
  misc_feature (263)..(263): n is a, c, g, or t
  modified_base (357)..(357): a, c, t, g, unknown or other
  misc_feature (357)..(357): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcagtgaaggtctcctgcaaggtcttctggattcacgtttaccncctaatagtatcaatgggtgcgccaggcccgctggaccaacgcctgagtggatgggatcgggcgaacctagacgtgtgcacgagtgtctcaccngtcctcggacagtacttaccagtacgaccacgactcctacaactaaaccacgacgacctacagtaggacggttagaacggtcgccgtaagacacttcgtacgaccgacgaccgggtcctacttacgttactgtcgacgtacgaccgtcccgtaagcggttccggtacgccggtaccgtaccggcgacggtcccggttctttacgaccgtttccggacgggg

SEQ ID NO: 208913 - DNA, 710 bp, Homo sapiens
  misc_feature: GYAE6OF02IM9HO.17.25.C03.1.454.CMB.1.raw
tcagcgtagactagcacgaccggtgctcgatttagtagtgtagatttgggtttggggactcaacaaccacatctgtcctctagagaaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtctccgtgacaaggcttcgtggattcacgtttacctcctatagtatcaacgtgggtgcgccgaggccgcgtggacaacgacctgagtggagtgggagtggggaccgaaacccgtaacgacgtgggtacgtcaacgaggttcgttccttaccaaccccgtaacgttcccgtaccggggactaacggtaccttaccgaagtaccgaacccaacgtaaaccttcccgtaacccaaactaaaacccgaacctaacgtaccctaacgtacgttagggtaagttcggaaagggacgtacccgtagactacgtcgtacgaccggtaaccgacccgggtccgttacgttaagttccgtaggttacggtacgtacggtacccgtaccggtaccgtaaccggttcccgggtacgaccggtacccggttaaccggaccggacgggttcccggttaccgttttcggtacccggttccgggtaaccggggg

SEQ ID NO: 208914 - DNA, 764 bp, Homo sapiens
  misc_feature: GYAE6OF02JZF6V.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggcctcagtgaaggtctcctgcaaggcttctggattctacgtttacctccgtatagtatcaacgtggtgcgcaggcgctggaccaacgacctggagtcggagtgggaatggggaccgtaacccgtaagacgtgggtacgaccaacgaggttcggttccttaccaacccgtacgttcccgtacccggggtaacacggtaacctttaacccacgttaccgaacccgtaaccgtaaacccttcccgtaacccaaacttaaaaacccgaccgtaaccgtaacccgtaaccctaaggttacgggtaacggtttacggaaaccgggttaacgtacccgttacggtaacctaacgttaccgtacggtaaccggtaaccgtaacccgggttacccgttacgtttaacttaaccgttacggtaacgtccgggtaaacgtcccgttaaccccgtaacgggtaaccgttacccgggtacggtaaccggtcccgttaaaccggggccgtaacggggtaccccggttaccgttttaccggtacccgtttccgggtaacccggggg

SEQ ID NO: 208915 - DNA, 564 bp, Homo sapiens
  misc_feature: GYAE6OF02FTYVD.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtccaccatcacttcgaccggacaagtcacggacgttaaaaacctatttaaattggtatcagcaagaaacctaggaaaacgcccagacctcctgactctctggtgcatccactctgacgaagtcggcgtcccagtcgaggttcaggtggctaggtggatcgtagggacagtatttacaattcctacaaccactccaccctacttctacgactaaccgtggacggtattgtcgacaacttctactactgtaacaactagtacgttacaccgttcccgtagtcttacgtttcggaccgtaacgggacctaagtgaagtactaacgaaacgtagtggtaggctacgacctaaccgtcttctcttac

SEQ ID NO: 208916 - DNA, 697 bp, Homo sapiens
  misc_feature: GYAE6OF02GTVTU.17.25.C03.1.454.CMB.1.raw
  modified_base (280)..(280): a, c, t, g, unknown or other
  misc_feature (280)..(280): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatggggatcggggaccgaaccctaacgacgtgggtcgtcacgagttgtccttacaccctactcccgtaccgggacacgtaccttaccatcgacccacgtaacctccctaccaataaaccactacgaccctaacacgtacgggtacggtttaggaacgggtacgccgttagaaccgtattcccggtaggaacccggaccgtacccggggtcccgtttaccgttaaacttttaacccggtggttaacggaccgtaaggacccggtttaccccaacgggttaccgttacccggggtagtaacccggtaccccggttaccgggaccggtaaccgggttcccggggttacccgttttttacggaccccggttttcggggtaacccggggggg

SEQ ID NO: 208917 - DNA, 589 bp, Homo sapiens
  misc_feature: GYAE6OF02FZSMM.17.25.C03.1.454.CMB.1.raw
  modified_base (441)..(441): a, c, t, g, unknown or other
  misc_feature (441)..(441): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggtattcacgtttacctcctatagtatcaactgggtgcgcacggccgctggacaacgacctgagtggatgggatcggggaccgaaccctaacgacgtgggtcgtcaacgaggtcgtcttccacccctattcccgtaccgggacacgtacttaccatacgaccacgtaacctcctaccaataaaccacacgccctaanagtaggtagttggaaggactccgtagacagttcgagaccgacgaccggtcctacttaattactggtagcgagtacgacccgagtaacgtccggtagccgtccgtaacggcacggtcccggttacctttggtaccttcgggtaccgggg

SEQ ID NO: 208918 - DNA, 577 bp, Homo sapiens
  misc_feature: GYAE6OF02FYAUY.17.25.C03.1.454.CMB.1.raw
  modified_base (175)..(175): a, c, t, g, unknown or other
  misc_feature (175)..(175): n is a, c, g, or t
  modified_base (244)..(244): a, c, t, g, unknown or other
  misc_feature (244)..(244): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtncagctggtgcagtctgggctgaggtgaagagccgtggggcctcgagtgaaggtctcctgcaaggcttcngagggggttcacgtttaccctcctatagtatctaacctgggtgcgcccgaggccgctggacaacgacctgagtggatgggatgggccgaaccctaacacgtggtgtcacgagtgtcttcacccatccctaccgggacacgtacttaccatcgaccacgaactccctaccataaaccacacgcctacatggacgttggaggacgtcctgactatctacggtacgaaccgacgggcccgttcgttaacttacgtgttcgcgagtacgtcccgacgagtcccggtagaacccgtacggacacgggcgtacccgttgtccgttcgcggggtacccgg

SEQ ID NO: 208919 - DNA, 542 bp, Homo sapiens
  misc_feature: GYAE6OF02FGYPK.17.25.C03.1.454.CMB.1.raw
  modified_base (330)..(330): a, c, t, g, unknown or other
  misc_feature (330)..(330): n is a, c, g, or t
  modified_base (476)..(476): a, c, t, g, unknown or other
  misc_feature (476)..(476): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcaaccctaanactggtgtcacagtgtcttcacccatcctccgggacacgacttaccatcgacccacgaactccctaccaataaaccacacgccctacatggagttgaggagcctgacatcgtgacgacgaccggtccgtacttattactgcgcganacgtcccacggactccggtagacgtccgtaacggcacggccggtcctttgacgtttcggtacgggg

SEQ ID NO: 208920 - DNA, 630 bp, Homo sapiens
  misc_feature: GYAE6OF02FQH4N.17.25.C03.1.454.CMB.1.raw
  modified_base (290)..(290): a, c, t, g, unknown or other
  misc_feature (290)..(290): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaggtctcctgcaaggcttctggattcacgtttacctcctatagtatcaactgggtgcgccaggccgntggacaacgacctgagtggatgggatcggggaccgaaaccctaacgacgtgggtgtcacgtagttcgttccttccacccactcccgtaccggggacacggtaccttaccatcgaacccacgaacctccctaccaactaaacaccacgaccctacagtcggtagttaggacggacgcctagacctactcgtagaccgacgaccggtccgttactagtttactcgtacggaccgtaacggtaccgtaccccacggtacgttcccgggtacggtaaccggacccgttacgggaccgtaccgggcccggttacccgtttacggtacccgtttggtacccggggg

SEQ ID NO: 208921 - DNA, 703 bp, Homo sapiens
  misc_feature: GYAE6OF02JZM83.17.25.C03.1.454.CMB.1.raw
  modified_base (164)..(164): a, c, t, g, unknown or other
  misc_feature (164)..(164): n is a, c, g, or t
  modified_base (193)..(193): a, c, t, g, unknown or other
  misc_feature (193)..(193): n is a, c, g, or t
  modified_base (279)..(279): a, c, t, g, unknown or other
  misc_feature (279)..(279): n is a, c, g, or t
  modified_base (304)..(304): a, c, t, g, unknown or other
  misc_feature (304)..(304): n is a, c, g, or t
  modified_base (411)..(411): a, c, t, g, unknown or other
  misc_feature (411)..(411): n is a, c, g, or t
  modified_base (480)..(480): a, c, t, g, unknown or other
  misc_feature (480)..(480): n is a, c, g, or t
tcagcgtagactagcacgaccggtgctcgatttagtagtgtagatttgggtttggggacgtcgaacaaccacatctgtcctctagagaaaaccctgtgagcacagctcctcaccatggactcggacctggaggatcctcttcttggtggcagcagctacaagtncccactcccagtgcagctggtgcagtcgngggctggaggtgaaggaagccgtggggacctcgaggtagaaggttcctccgtaggcaagggtccttagtggacttcacgtttaccncctatagtactctaacgtgggttancggtccacggtccgtacgacgggaccaaaccggtccctaaggacggttagggacggttaggggaacggtcggggtacccgggaaacctacgtaaccgtggggttacncgtacctaggtcgtcctacgaaccctgtaccgtcgggactacgcttaccagtaccgacctacggaaccncccgttacaacttaaccaacgtaccgtacctaacgtacgtacggtagttacggacggtacggtaccttaacgggactaacgtcgtacaacccgttacgaacgggccttacgacgtttacgtacggacggtacgaacgggtccttaacccacgggttaacctcggttaacgcggaacccggttcgacggtacgtaccggtcctttacggtccttcgggtacggg

SEQ ID NO: 208922 - DNA, 556 bp, Homo sapiens
  misc_feature: GYAE6OF02HQ9K7.17.25.C03.1.454.CMB.1.raw
  modified_base (260)..(260): a, c, t, g, unknown or other
  misc_feature (260)..(260): n is a, c, g, or t
  modified_base (333)..(333): a, c, t, g, unknown or other
  misc_feature (333)..(333): n is a, c, g, or t
  modified_base (412)..(412): a, c, t, g, unknown or other
  misc_feature (412)..(412): n is a, c, g, or t
  modified_base (422)..(422): a, c, t, g, unknown or other
  misc_feature (422)..(422): n is a, c, g, or t
  modified_base (484)..(484): a, c, t, g, unknown or other
  misc_feature (484)..(484): n is a, c, g, or t
  modified_base (514)..(514): a, c, t, g, unknown or other
  misc_feature (514)..(514): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaggcttctggattcacgttttaccncctatagtatcaactgggtgcgccaggccgctggacaacgcctggagtggatggggatggggcaaaccctaanaccgtggtgtacacagtcgtcttcacccatccgtcgggacagtactaccgatcgaccagaacctcctaccaataaaccncacgcctaanacgttggacgttgaaggactccgtgactattcgagacgtacgtaacggccttatatttacgngtcgtacgagtacgtcccgagcgtccggtnaccgcgtacggctaggtccggtcctttgaccgttgtacgggg

SEQ ID NO: 208923 - DNA, 614 bp, Homo sapiens
  misc_feature: GYAE6OF02GB0PC.17.25.C03.1.454.CMB.1.raw
  modified_base (475)..(475): a, c, t, g, unknown or other
  misc_feature (475)..(475): n is a, c, g, or t
  modified_base (483)..(483): a, c, t, g, unknown or other
  misc_feature (483)..(483): n is a, c, g, or t
  modified_base (500)..(500): a, c, t, g, unknown or other
  misc_feature (500)..(500): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtagaagagccgtggggcctcagtgaggtctctgcaggcttctgattctacgtttacctctatagtatacaacgtgggtgccgccgaggcccgcgtggaaccaacggacctggacggtggagtggggagtcggggaccgtaacctaacgtacgtgggtcgtacaagtggtcgttcctaccgaccctacgtcccgtaccgggaacacgtacctaccatcgaaccacgtaactcctaacaactaacacacgacctatagtgtagtagagtactcgngactgtcngaccgacgacgtccttntacttacgtggtacgtacgacgtaccgtacccgaacggtcggtccggtacggtaaccgtccgtaaccggcgtacggtacccggttcctttacggtaccggttcgggtaccgggg

SEQ ID NO: 208924 - DNA, 695 bp, Homo sapiens
  misc_feature: GYAE6OF02FXS1E.17.25.C03.1.454.CMB.1.raw
  modified_base (247)..(247): a, c, t, g, unknown or other
  misc_feature (247)..(247): n is a, c, g, or t
  modified_base (264)..(264): a, c, t, g, unknown or other
  misc_feature (264)..(264): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagcgtggtgcagtcgtggggctggaggtgaagagccgtggggcctcgagtgaaggtctcctgcaaggcttntggattcacgtttaccncctatagtatctaacgtgggtgcgccgtaggccgcgtgggaaccaacgacctggacgtggagtgggatcggggacgaaccctaacacgtggtcgtacacgtacgtgttccgtttaccaaccctacgttcccgtaccggggaaccaggtaaccctttaaccagtacggaacccaacggtaaaccctcccgttaaccaaacttaaaaccactacggaccctaaacgagtacgggtaattacgggaacgggtacgtccccgtaggaacctataccgtacggtaaccggaaccacccggggttaccgttaccttaagtttaaccgtcgggttgaccggaagtcccgtaccccgaaggtaccggttaccgggtacaccgtacccggtaccggcgtaacggtcccggttccttttacggacctttgggtacccgggg

SEQ ID NO: 208925 - DNA, 748 bp, Homo sapiens
  misc_feature: GYAE6OF02JLG5A.17.25.C03.1.454.CMB.1.raw
  modified_base (309)..(309): a, c, t, g, unknown or other
  misc_feature (309)..(309): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtagaagaacgccgtggggcctcgaggtgaaggtcctccgtgacgaagggtccttcgtggtacttccgtaccgtttacctccttaatagttactacgaacttggggtcncggcccagggcccgactgggaccaacggacctggacgtggagtgggagtcgggaccgaacctacgactggtgtccgacgacgttgtaccttccgacccctagtcccgtaccggggaactacggtaacctttaaccgattaccggaaccctaaccggtaaacccttaccctaacccaaacgtaaaacccaaccgaaccgtaccctaactaacgtacgggtaacgttacggaacgggtaccgtaccgtacggaactacgttaccgtaaccggaacccggaccgtaaaccggggtcccttaacgttacgtttaacgtacggtccggtaacggtaccgtaccggtaccctaaccgggtacgttacccggacggtaacccgtaccgtacccgggtacgtaccggtaccggtttccgtttaccggttaccgttcggtaccggggg

SEQ ID NO: 208926 - DNA, 635 bp, Homo sapiens
  misc_feature: GYAE6OF02F3TM7.17.25.C03.1.454.CMB.1.raw
  modified_base (283)..(283): a, c, t, g, unknown or other
  misc_feature (283)..(283): n is a, c, g, or t
  modified_base (441)..(441): a, c, t, g, unknown or other
  misc_feature (441)..(441): n is a, c, g, or t
tcagcgtagactagcacgaccggtgctcgatttagtagtgtagatttggttttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcgagtgaggtctcctgcaaggcttctggattcacgtttacctctatagtactcaacgtgggtncgccaggccgcgtggacaacgccgtgagtggagtgggatcgggacaaccgtaacacgtggtcgtcactagtcgtccttaccgaccctacgttcccgtaccgggactacgtacccttaccgataccggaccaaccgtaacctccctaacaacgtaaacncaacgtcctacagtggagttggacgacgctagactgtcgtcggaacgcgtaccgggtccttagtaacgttacgtgacgtaccggagtacccgtaccgaccggttacggtcccggggttagacccgttacccggtacggtacccgtaacggggtcccggtttacccgttttaggacccgtttcgggtaccggggg

SEQ ID NO: 208927 - DNA, 769 bp, Homo sapiens
  misc_feature: GYAE6OF02I1B1T.17.25.C03.1.454.CMB.1.raw
tcagcgtagactagcacgaccggtgctcgatttagtagtgtagattgggtttggggagtcagtctcagtcaggacacagcatggacatgagggtccccgctcagctcctggggctcctgctactctggctccggagctcgcctagtatgtgactatccgagatcgacctaggtcctccactccctccgtaggtctcgtaccgtcgtggtgggggtcaggtacgtccgaccagtccaacttcggtaccggactaagtccgacggacgttaaactattaatgtatcagtcaagaacctagaaactcccagtacctcctagtactcgtcgtaggtcgtactacgtccacgtctacggtacgtaaggtcgaccgtccgagtccggtacggtttcgaaggttcggacgtaggtacgggtactcggtacgggtaactaggttaacgtttaccgaaccgttacctaccgtaccctaactccctaacctacggttacctacgaacccgtaacggtagggtacggtaacttcgacgttaacccttaagttacccttaacggttactaccggtaaaccctaagggtaccgttaaaccggtttacgttaaccccgttacccgtacgttacttttaaaccggggttcccgtaaacgggttaaaccggggttaaacgttaacgggtaggtaacggttaaactaaacccgggtaaacggtacgtttccgggtaagtcccgggtaaggaccccgtaacgtaccgttttccggtacccgttaacc

SEQ ID NO: 208928 - DNA, 631 bp, Homo sapiens
  misc_feature: GYAE6OF02G65I0.17.25.C03.1.454.CMB.1.raw
  modified_base (280)..(280): a, c, t, g, unknown or other
  misc_feature (280)..(280): n is a, c, g, or t
  modified_base (290)..(290): a, c, t, g, unknown or other
  misc_feature (290)..(290): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtacccactcccaggtgcagctggtgcagtctggggctgaggtgaagaagcctggggcctcagtgaaggtctcctgcaaggcttctggattcacgtttacctcctatagtatcaactgggtncgccaggccnctggacaacgcctgagtggatgggatgggcgaaccctaacactgggtgtcacagtgtacttcaacccagttcccgtccggggtaacacgtaaccttaccgtagttccgaacccacgtaaccctccctacccaataaaaccacagaccctaacagtggtacggttagaaggacgccgtagactaatcgagaaccgacgacccgggtcttactaactttaccgtggttacgacgtaacgtaccgtaccccagggaccgtttcccgggagaaccggtacccggtacgggtccggaacgtccggggttcccttttaggaacccgtttcgggtacggggaccccgg

SEQ ID NO: 208929 - DNA, 609 bp, Homo sapiens
  misc_feature: GYAE6OF02JUCCV.17.25.C03.1.454.CMB.1.raw
  modified_base (283)..(283): a, c, t, g, unknown or other
  misc_feature (283)..(283): n is a, c, g, or t
  modified_base (294)..(294): a, c, t, g, unknown or other
  misc_feature (294)..(294): n is a, c, g, or t
  modified_base (315)..(315): a, c, t, g, unknown or other
  misc_feature (315)..(315): n is a, c, g, or t
  modified_base (483)..(483): a, c, t, g, unknown or other
  misc_feature (483)..(483): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctcctgcaaggcttcgtggtattctacgttacctctatagtatcaatgggtncgcacggccgntggacacgacctgagtggagnggagtgggacctaaccgtaacgtacgtggtcgtcacgtacgtcgttccttccgaaccctcgtccgtacccggtacgtaacgtaccttaccacgtacgacccgtaaccgtactccctaactaactaaaccacactacctacacgtaggtagtacgagaacgcctagacnctacgacgtacgaccgtacggccgttctaattccgtagtcgaacgtacggacgtcccgagtaccgtccggtacgtacgaccgtaggtaccacgggtccggttccttcggttacgtccggtacgggg

SEQ ID NO: 208930 - DNA, 745 bp, Homo sapiens
  misc_feature: GYAE6OF02G2J21.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcgtggattcacgtttacctcctatagtatcaactgggtgcgccaggccgcgtggaccaacgacctggaggtgggagtggggatcggggaccgtaaacccctaacgacgttagggtcgtacacgtaaggttcgttaccgttaccaacccctacgttccccgtacccggggaacctaaccggtaacctttaacccgaactttacggaacccctaaccggtaaacccttcccccgttaacccaaacgttaaaaacccaaccgtaaccgtacccctaaacgtaaacgttacgggaagttttacgggaagggtaaccgtcccgttaagaaccgtagttccgtaccggaaccgaaccggacccgggtccgttaacctttaacgtttaaccgtggttaccggacgaacggtaccgtaccccgaccggtaacggttcccgggtaggtaccgcccggttacggaccgtacgggtcccggttccttttacggacccgtttcggtacccggggg

SEQ ID NO: 208931 - DNA, 587 bp, Homo sapiens
  misc_feature: GYAE6OF02HMG22.17.25.C03.1.454.CMB.1.raw
  modified_base (281)..(281): a, c, t, g, unknown or other
  misc_feature (281)..(281): n is a, c, g, or t
  modified_base (422)..(422): a, c, t, g, unknown or other
  misc_feature (422)..(422): n is a, c, g, or t
  modified_base (430)..(430): a, c, t, g, unknown or other
  misc_feature (430)..(430): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcgagtgaaggtctcctgcaaggcttctggattcacgtttacctcctatagtatcaactgggtncgccaggccgctggacaacgacctggagtggagtgggagtggggaccgtaaccctaacgcgtggtgtcacgagtcgtcttccacccagttcccgtaccggacacgaccttaccgatcgaccacgacctcctacagtaaacncagcctanacgtggtagttgaggactcctgaactagtctagaccgacgaccggtcccgttatacgttactggacgtacgacgaccgtacccgacgtacgtcccggtagtaccgcccgtacggaccgacggtccggtaccttttaggacccgtttcggaccggggg

SEQ ID NO: 208932 - DNA, 821 bp, Homo sapiens
  misc_feature: GYAE6OF02JTIRJ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagagccgtggggcctcgagtgaaggtctcctgcaaggtcttcgtggacttcacgtttacctacctatagtatacgaacgtgggttcgaccgccgacggtcccgcgttacggaacctaacgacccgttggacggtttgggacgttgggggacgtacgggggaacccgtaaaccccgttaaaacgtacggttcgggttacgaaccgtacggtaaggtttcggttacctttacccgtaaccccgtacgttccccggttaccggggtaacacggtaaccctttaaccgacggttaccgaacccgtaaccgaaccctttcccaacctaacgtaaaaccctaccgaacggttaccctaactaacggttacgggtaagttacgggaacggtacccgtaccggtacgtaaacctcgttaaccggttcggaaccccggttaacggacccgggtttacccgttacctttaagtttaccgtacgggtacgaccggtaagggttaccctaccccggtacgggaacccggtttacgggacggtaaccccgtacccgggttaccggtaaccggtccgggttaccccggtttcccgttttaacgggtccggttttacccgggacccgggggg

SEQ ID NO: 208933 - DNA, 529 bp, Homo sapiens
  misc_feature: GYAE6OF02H62RV.17.25.C03.1.454.CMB.1.raw
  modified_base (331)..(331): a, c, t, g, unknown or other
  misc_feature (331)..(331): n is a, c, g, or t
  modified_base (338)..(338): a, c, t, g, unknown or other
  misc_feature (338)..(338): n is a, c, g, or t
  modified_base (393)..(393): a, c, t, g, unknown or other
  misc_feature (393)..(393): n is a, c, g, or t
  modified_base (402)..(402): a, c, t, g, unknown or other
  misc_feature (402)..(402): n is a, c, g, or t
  modified_base (410)..(410): a, c, t, g, unknown or other
  misc_feature (410)..(410): n is a, c, g, or t
  modified_base (423)..(423): a, c, t, g, unknown or other
  misc_feature (423)..(423): n is a, c, g, or t
  modified_base (430)..(430): a, c, t, g, unknown or other
  misc_feature (430)..(430): n is a, c, g, or t
  modified_base (433)..(433): a, c, t, g, unknown or other
  misc_feature (433)..(433): n is a, c, g, or t
  modified_base (440)..(440): a, c, t, g, unknown or other
  misc_feature (440)..(440): n is a, c, g, or t
  modified_base (449)..(449): a, c, t, g, unknown or other
  misc_feature (449)..(449): n is a, c, g, or t
  modified_base (455)..(455): a, c, t, g, unknown or other
  misc_feature (455)..(455): n is a, c, g, or t
  modified_base (486)..(486): a, c, t, g, unknown or other
  misc_feature (486)..(486): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgcctggagtggatgggatgggcgaaccctanactggtntcacagtgtcttcacccatccgtcggacagacttaccatcgaccacgaacctccncataaaccncagcctantggagttgaggcncctgacntcngaccgcncggccttanttacgngtcgacgtagctcccgagtcgtcccgggtancgaccgtacggccagggtccggtcctttggacccttggcgggg

SEQ ID NO: 208934 - DNA, 596 bp, Homo sapiens
  misc_feature: GYAE6OF02HOGHY.17.25.C03.1.454.CMB.1.raw
  modified_base (276)..(276): a, c, t, g, unknown or other
  misc_feature (276)..(276): n is a, c, g, or t
  modified_base (333)..(333): a, c, t, g, unknown or other
  misc_feature (333)..(333): n is a, c, g, or t
  modified_base (421)..(421): a, c, t, g, unknown or other
  misc_feature (421)..(421): n is a, c, g, or t
  modified_base (431)..(431): a, c, t, g, unknown or other
  misc_feature (431)..(431): n is a, c, g, or t
  modified_base (543)..(543): a, c, t, g, unknown or other
  misc_feature (543)..(543): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagctgggcctcagtgaggtctcctgcaggcttcgtggattcacgtttacctcctatagtatcaacgtgggtncgccaggccgctggacaacgcctggagtggagtgggagtcgggaccgaaccctaacncgtggtcgtacacgtagtcgttccttccaaccctactcccgtacggacacgaccttaccatcgaccacgacctcctaccaataaaccncacaccctanacgttggagttaggacggacgtcctagacctagtcgtagaaccggaccgaccgggtccttactaatttcgtagtcgacggacgaccgttacccgacggtacgtcccgggtanaccggtacccgtaacggcacggtccggtccttttcgaccggttcgaccggggg

SEQ ID NO: 208935 - DNA, 614 bp, Homo sapiens
  misc_feature: GYAE6OF02G67YX.17.25.C03.1.454.CMB.1.raw
  modified_base (446)..(446): a, c, t, g, unknown or other
  misc_feature (446)..(446): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcagtgaaggtctcctgcaaggcttctggattctacgtttacctcctatagtatcaacgtgggtgcgccgaggccgcgtcggacaacggacctggaggtggagtgggagtcggggaccgaaaccctaacgtacgtggtgtacactaggtgtccttccaccctatcccgtaccggacacgtacctaccatcgaccacgaacctcctacaataaacgacacgtcctaanacgtggattaggacggcgcctagacatcgaggaaccgacgtaaccggtccgttaacttagttaccgtaggtcgacgaggtaccgttacccgaacgtaccgttcccggtagaccggtacccgtacgggacgacgggtccgtcgtttacggtcccgttcgggtaccgggg

SEQ ID NO: 208936 - DNA, 640 bp, Homo sapiens
  misc_feature: GYAE6OF02H8FYN.17.25.C03.1.454.CMB.1.raw
  modified_base (276)..(276): a, c, t, g, unknown or other
  misc_feature (276)..(276): n is a, c, g, or t
  modified_base (285)..(285): a, c, t, g, unknown or other
  misc_feature (285)..(285): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtgggctcagtgaaggtctctgcaaggcttctggattcacgtttacctctatagtatcaactgggtncgccaggcncgtgacaacgctgagtggagtgggatgggaccaaaccctaagaccgtgggtctcacgtaggttcgtacttccaaccctatcccgtccggggacacgtaccttaccgataccgaccacgtaacctcctaccaactaaaccacagaccctaactgtaggtacgttcgaaggtacgcctagactaactcgtacggaccgaccgaccgggtccgttacttaacgtttcgtcggtacgaccgtaacgtaccggtaccccgacggtaccggtacccgggttacggaacccggtacccgtaacccgggtcgacgggtcccggttacccggttttcggttacccggttccggttacccggggg

SEQ ID NO: 208937 - DNA, 629 bp, Homo sapiens
  misc_feature: GYAE6OF02IEG4N.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcgtggattcacgtttacctcctatagtatcaactgggtgcgcaggccgctggacaacgcctgagtggatggggatgggaccaaacccctaacgacgtggtgtaccacgtagtcgtcttccaccctatcccgtaccggggactacgtaccttaccagtcgaacccacgaacctcccgtaccaactaaaccacacgtaccctaacagtacggacgttggacggtacgtccctagaccagttccgtacggtaaccgaccgtaccggtcccgttacttaacttcgtgtacgacgtaggtaccgtccccgaacggtacgttcccggtaggaccggtccgtaccgggacgacggtcccggttacccttttacggaccgtttcggtaccggggg

SEQ ID NO: 208938 - DNA, 839 bp, Homo sapiens
  misc_feature: GYAE6OF02GQBY9.17.25.C03.1.454.CMB.1.raw
  modified_base (282)..(282): a, c, t, g, unknown or other
  misc_feature (282)..(282): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtcncgccaggcctctggaacaacgacctgacgtggatcgggatggggaccaaacccctaacgacgtggttcgtacacgtagttcgtacctttaccgaacccctagttaccccgttacccgggggaactaacgggtaaccctttaaacccgaattcggaaaccccctaaccgggtaaaaaccctttcccccgttaacccgtaaacctttaaaaaaccaaccctaaacgggtaaccccttaaacgacgttacggggtaaacggttttccggaaacgggtaacggtaccccttaacgggtaaacctaacgtttccccgttaacgggaaaacccggaacccggaaacccgggggttccccgttttaacccgttaaaaccgttttttaaccggttacggtttaaccggggaaccgggtaaccggttaaccggttaccccccggtaaacgggtaacgtttacccggggttaacggtaaccggtacccccggttaaccggggacccgaacgggtccccgggttacccggtttttacggtacccgttttacccgggtaaccggggggg

SEQ ID NO: 208939 - DNA, 620 bp, Homo sapiens
  misc_feature: GYAE6OF02FPZ68.17.25.C03.1.454.CMB.1.raw
  modified_base (275)..(275): a, c, t, g, unknown or other
  misc_feature (275)..(275): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccgacaagtcacggcgttaaaacctatttaaattggtatcagcaagaaacctggaaaacnccccagaccctcctgactctcgtggtcgcatccacttctcgcgaagtggcctcccatcgaggttcaggtggcaggtgatcgtagggactagtacttttacgaattcctacacctactaccacctactactcgaccaaccgtggtaacggtattcggtacactaacgttaccttaacgtacgtagtaccaacgttaagtacgtttaccgtaccgtttccccgtacgttccgttaaccgtttcggaccggtaacggggtaaccttaaggttacggaacgtacgtaaccgtaaacggtaacgttacggtacggtcgtacgaccgtaacccttagttccgttcgttacc

SEQ ID NO: 208940 - DNA, 776 bp, Homo sapiens
  misc_feature: GYAE6OF02JKTE4.17.25.C03.1.454.CMB.1.raw
  modified_base (187)..(187): a, c, t, g, unknown or other
  misc_feature (187)..(187): n is a, c, g, or t
tcagcgtagactagcacgaccggtgctcgatttagtagtgtagatttggtttggggtacgtcaacaaccacatctgtcctctagagaaaaccctagtgagcacagctcctcaccatggactggacctggaggatcctcttctttggtggtcagcagctacaagtgccactcccaggtgcagctggtncgagtcgtgggtcgtgaggtgaaggaacgccgtggggcctcgagtgaaggtcctccgtcgcgaacggtcttcgtggtacttcgtaccgttttaccctccttaacgttagttacgtacctaacgttcggggtaggtccggccgtaacggggcccgcgttacgggaccaaaccggtaccgtggaaggtcgggaagtaggggtacgtcggggacctaaaccccgtaaaccgacgttcgggtacgtaccgaacgtacggtcgtttccgttaccaaccctaacttcccggtacccgggacgaacgttaccttaacctacgtccgtaaccgaacgttaaccctcccgttaacccaaactaaaaccacgaaacgtacctaacgtacgtacggacggtttacggaggtacggtacctaacggtacacttacgacggtaaccgtaacccgaccgggtccgttaacgtacggtttactacggtcgacggttaaccgaccgttaacccgccggtaacgttacgggtacctaacgggtaccctaacggggtaccctacggggtacccgttcccggttttacgacggttccggtaccggggg

SEQ ID NO: 208941 - DNA, 601 bp, Homo sapiens
  misc_feature: GYAE6OF02IWBZC.17.25.C03.1.454.CMB.1.raw
  modified_base (329)..(329): a, c, t, g, unknown or other
  misc_feature (329)..(329): n is a, c, g, or t
  modified_base (404)..(404): a, c, t, g, unknown or other
  misc_feature (404)..(404): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggctctggattcacgtttacctctatagtatcaactgggtgcgccaggccgctggacacggacctgagtggatgggatgggcgaacctaacnctggtgtcacagtgtcttcacccatcccgtcggacacgacttaccatacgaccacgaactccctaccataaaccncacgacctacagtggtacgttgacggtacgccgttagaccatacgtgaaccgacgaccgggtccgttactacgtttacctaggttccgacggtaacgtaccggtaccccacgggtaactcccgggttaggaccggtacccgttaccgggacacggggtcccggttacccgtttcggtacgttttcccggtacggggg

SEQ ID NO: 208942 - DNA, 838 bp, Homo sapiens
  misc_feature: GYAE6OF02I00TD.17.25.C03.1.454.CMB.1.raw
  modified_base (442)..(442): a, c, t, g, unknown or other
  misc_feature (442)..(442): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctctttcttggtggcagcagctacaagtcgcccactccaggtgcagcgtggtgcgagtcgtggggctaggaggtagaaggaacgccgtggggcctcgaggtaggaacggttcctccgagacgaacgggtctttggtaggtactttaccgtaaccgttttaccctacgttattagttactacgtaacgttgggtcgccgtccgacggtcccgtcgtacggaaccgaaaccggtaccgttaggacggttaggggacgtgggggtacgtacggggtaacccgttaaacccgaaccgtaggttccggggttanaccgaaacgtaggttaccgtttacctaccctaacccgtacggttcccgaccggggaactaacgtaaccttaccggactttaccggaacccctaaaggtaacccctttccgaaaccgtaaaacctaaccacccggtaacgacccttaaacgtcgttaagggaacgttaacggtacggaacgttcccgtacggaactaccgttaccgtaggtaaaccggtacccggaacgggttccctttaaacgttacgttaacccggtttggaaacgggttcccggaaacgttaccccgtacccggaaccgttaaccggttccggaacgtaccggttaacccgtacggaaccgtcgggttaaacccgtttcccggttaacgttaccgggtccgggtaacccggggg

SEQ ID NO: 208943 - DNA, 747 bp, Homo sapiens
  misc_feature: GYAE6OF02JLT8S.17.25.C03.1.454.CMB.1.raw
  modified_base (288)..(288): a, c, t, g, unknown or other
  misc_feature (288)..(288): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcctggggcctcgagtgaaggtctcctgcaaggtcttctggacttcaccgtttacctcctatagtatcgaacgtgggtcncgccgacggccgcgtcggacaaccgacctggaggtggagtcggggagtcggggaccgtaaacccgtaacgtacgtgggtcgtaccaacgtacggttcgttccttaccaaccctacgttcccggtaccggggaactaacgtaaccttaacccgagtaccgaacccgaaccgtaaaccctccgtaaccaaacttaaaaccaccgtaacgtacccgtaaactacgttacggtacggttacggaacggtacgtcccgtagacctaacgttccgtaacggaccggtaaccgtaccggggtcccgttaaccgttaacgtttacccggtggttaccggaacgtacggtaccgttacccggtaaccggccggttaccgggtacgtaaccggtaccccgttagggacccgtaacggggtccccggtttaccggttttaccggtacccggttcccgggtaaccgggggg

SEQ ID NO: 208944 - DNA, 647 bp, Homo sapiens
  misc_feature: GYAE6OF02I6ICJ.17.25.C03.1.454.CMB.1.raw
  modified_base (184)..(184): a, c, t, g, unknown or other
  misc_feature (184)..(184): n is a, c, g, or t
  modified_base (244)..(244): a, c, t, g, unknown or other
  misc_feature (244)..(244): n is a, c, g, or t
  modified_base (247)..(247): a, c, t, g, unknown or other
  misc_feature (247)..(247): n is a, c, g, or t
  modified_base (283)..(283): a, c, t, g, unknown or other
  misc_feature (283)..(283): n is a, c, g, or t
  modified_base (559)..(559): a, c, t, g, unknown or other
  misc_feature (559)..(559): n is a, c, g, or t
  modified_base (591)..(591): a, c, t, g, unknown or other
  misc_feature (591)..(591): n is a, c, g, or t
  modified_base (607)..(607): a, c, t, g, unknown or other
  misc_feature (607)..(607): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtncagtcgtggggctgaggtgaagagccgtgggcctcagtgaaggtctcctgcaggtcttcnggnttcacgtttacctcctatagtactcaacgtgggtcncgaccaggccgcgtcggacaacgacctggagtggagtggggattgggggacccgaaacccttaacgacgttcgggtacgttaccaacgtacgggtttcgtacctttacccgaccctaacgttcccgtaccggggactaacggtaaccttaacccgatacggaaccacgtaacctccctaccaataaacccacaacgaccctaacgtatcgggtacgttaggacggtacgccgtagaccacttacgtcgaacgaccgacggtccttactagttaccngtgacgtacgacgtaccgacggacgttccggngaaccgtcgtaccggngacggtccggttacccttaggtaccgttccgggtacgggg

SEQ ID NO: 208945 - DNA, 886 bp, Homo sapiens
  misc_feature: GYAE6OF02G9AJS.17.25.C03.1.454.CMB.1.raw
  modified_base (103)..(103): a, c, t, g, unknown or other
  misc_feature (103)..(103): n is a, c, g, or t
  modified_base (193)..(193): a, c, t, g, unknown or other
  misc_feature (193)..(193): n is a, c, g, or t
  modified_base (239)..(239): a, c, t, g, unknown or other
  misc_feature (239)..(239): n is a, c, g, or t
tcagcgtagactagcacgaccggtgctcgatttagtagtgtagatttgggtttggggacgtcaacaaccacatctgtcctctagagaaaaccctgtgagcacngctcctcaccatggactggacctggaggatcctcttcttggtggcagcagctaacaagtcgcccactcccaggtgcagctggtgcagtcnggggctgagtgaagaacgcctggggcctcgagtgaaggtcctccgngacgaaggcttacgtggaactttcgtaccgtttaacctcctaattaacgtaatcctaaacgtgggtacgccggacccaagggcccgacgttacggaaaccgaaaaccgtacccgttaggaacgtagggaacgttcggggtaacgtaggggaacccgtaaaacccccttaaggaacccgttagggttccgtaccgtaacgtaacggtttacgttacctttaaccaccccggttaaactttcccggttaaccccggggaaaactacggttaaaaacctttacccgaaagtttacccggaaacccgaaaccggtaaaacccgtttcccaaacccggtaaaaacgtttaaaaaacccaccggtaaaccgttaaccttaaacccgtaaaggttacggggtaacgttaagggtaaaccgggtaaccggtacccgtttaggaaaccctagtttaccgaacgttaaccggaaacccggtaacccggttaccggttaaactttaacgttaccgtaggttcggaaccgtaacgggttaccctaacccgtacggtaaccggtttcccgggacggttaacccgaccccggttaaccggtaccggacggtttacccggtaccccgtttttacggaccccgtttaccgggggtaaccgggg

SEQ ID NO: 208946 - DNA, 653 bp, Homo sapiens
  misc_feature: GYAE6OF02I0DWG.17.25.C03.1.454.CMB.1.raw
  modified_base (414)..(414): a, c, t, g, unknown or other
  misc_feature (414)..(414): n is a, c, g, or t
  modified_base (429)..(429): a, c, t, g, unknown or other
  misc_feature (429)..(429): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtgcccacctcccaggtgcagctggtgcagtcgtggggctggaggtagaagaagccgtggggcctcagtgaaggtctcctgcaaggcttctggacttctacgtttacctctattagtatcaacgtgggtgccgccgacggccgacgtcggaaccaaccgtaccgtggaggtggatcggggatcggggacctaaaccctaacgacgttgggtcgtcacgtagttcgtccttaccacccgtatcccgtacccggganacgtaccgttaaccngtacgaaccaccgtaacctcctaccaataaaccacacgtacccatagtggagttacggaaggcgtccctgaactatccgtacggaaccgacgaaccgggtccgttacttactttacgtcgtagaccgaacgtaccgtacccgaagtaccggttccggtaggaaccgtcccgagggtacccgacggtcccggtccgttttacggtacccggttggtacccggggg

SEQ ID NO: 208947 - DNA, 568 bp, Homo sapiens
  misc_feature: GYAE6OF02GX2N1.17.25.C03.1.454.CMB.1.raw
  modified_base (415)..(415): a, c, t, g, unknown or other
  misc_feature (415)..(415): n is a, c, g, or t
  modified_base (422)..(422): a, c, t, g, unknown or other
  misc_feature (422)..(422): n is a, c, g, or t
  modified_base (467)..(467): a, c, t, g, unknown or other
  misc_feature (467)..(467): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggaggccaccttcagcgactatagtttcaattgggtgcgacggggcctctggacaaggccttggagtggagtggggaaggatcgtcctagtcgttgaccacaccaaactacgcacagaacgttccagggcagactcaccataaccgcgaacaaattaacgaacacagtaanctagacntagaacagctgtcatcgtgaggacacgggtctttactacgtttcncggtagcggtaaggacttaagttactaacgtaaactaccgttagtcctttaccttttactacccttcccgttagtcctttcggtcgggtaccttaaccggg

SEQ ID NO: 208948 - DNA, 722 bp, Homo sapiens
  misc_feature: GYAE6OF02JRM3Z.17.25.C03.1.454.CMB.1.raw
  modified_base (177)..(177): a, c, t, g, unknown or other
  misc_feature (177)..(177): n is a, c, g, or t
  modified_base (249)..(249): a, c, t, g, unknown or other
  misc_feature (249)..(249): n is a, c, g, or t
  modified_base (285)..(285): a, c, t, g, unknown or other
  misc_feature (285)..(285): n is a, c, g, or t
tcagcgtagactagcacgaccggtgctcgatttagtagtgtagatttgggtttggggtacgtcaacaaccacatctgtcctctagagaaaaccctgtgagcacagctcctcaccatggactggacctggaggatcctcttcttggtggcagcagctacaagtgcccactcccaggtncagctggtgcagtctggggctgaggtgaagaacgcctggggcctcagtgaaggtctccgtgcaaggcttcgnggattcacgtttacctcctagtactatcaatgggtncgaccaggccgctgggaccaacgacctgacgtggactgggagtcgggcaaaccgtaacgaccttaggggtcaccgttaaccgaggtttcggtacctttaccacccaacgtcccgtacccggggaactacgggtaaccctttaacccgagttaccggaaacccaccgggttaaaacccttccctaaccgtaacgttaaaaaccaaaccgtggaacccctttaagaagttccgggtaagttttaggacgggtacgaccccgttagaacctaagttccgaacggtacgacccgtaccgggcccttagttaactttacggctcgggattaacgggacccttcccgaacggtaaccggttccggggtaatcccgggaacccgtaaggtccgtaccggggacgtttacccccgttttagtaaccccgttgggtaacccggggg

SEQ ID NO: 208949 - DNA, 593 bp, Homo sapiens
  misc_feature: GYAE6OF02HDIVZ.17.25.C03.1.454.CMB.1.raw
  modified_base (412)..(412): a, c, t, g, unknown or other
  misc_feature (412)..(412): n is a, c, g, or t
  modified_base (422)..(422): a, c, t, g, unknown or other
  misc_feature (422)..(422): n is a, c, g, or t
  modified_base (439)..(439): a, c, t, g, unknown or other
  misc_feature (439)..(439): n is a, c, g, or t
  modified_base (474)..(474): a, c, t, g, unknown or other
  misc_feature (474)..(474): n is a, c, g, or t
  modified_base (529)..(529): a, c, t, g, unknown or other
  misc_feature (529)..(529): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggacgaacccctaacactggtgtcacagtgtcttcacccatccctccgggacagaccttaccatcgacccacgaactccctaccaataaaccncagccctaanatgggaatttgaggacncctagacatctacggaaccgacctacgggcccttnttaacttaccgtggtcgacgtacgtacgttccccaagggtaacttcccggggtanaaccggtccccgtaacgggccacggtcccgggttcccttttaggaccctttcgggtacgggggg

SEQ ID NO: 208950 - DNA, 718 bp, Homo sapiens
  misc_feature: GYAE6OF02I7K77.17.25.C03.1.454.CMB.1.raw
  modified_base (299)..(299): a, c, t, g, unknown or other
  misc_feature (299)..(299): n is a, c, g, or t
  modified_base (343)..(343): a, c, t, g, unknown or other
  misc_feature (343)..(343): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcgaaggcttctggattcgacgtttaccctcctaatagtatcaacgtgggtgccgccaggcccgngtcggacaacgcctggagtggatgggatcgggaccaaaccctanacgtggtcgtcacgcgtgtccttaccaccctacgtccgtacccggggactacggtaaccctttaaccagttcgaacccaacgaacctaccctacgaaactaaaccaccgacgtaccctaacgtaacgtacgggtaacgtttacggaacgggtacgtacccttacgaacccgtagttacctaacggaaccgtaacccggacccgggtacccgtttaccttaaaccgtttaacggttcgtaccggtaccggtaacggacccgttaccccgaaccgggttaaccggttccccgggttagaacccggtccccgttaacggggacccgtaacgggtcccgggttaccctttcgggttacctttcccgggtacccgggggg

SEQ ID NO: 208951 - DNA, 678 bp, Homo sapiens
  misc_feature: GYAE6OF02IPTYW.17.25.C03.1.454.CMB.1.raw
  modified_base (281)..(281): a, c, t, g, unknown or other
  misc_feature (281)..(281): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcctggggcctcagtgaaggtctcctgcaggcttctggattcacgtttacctcctattagtatcaactgggtncgccaggccgctggacaacgacctgagtggatgggatggggaccgaaccctaacacgtgggtgtcacgagttcgtcttaccacccatcccgtcggacacgacttaccgatacgacctaacgaacctccctaccaacttaaaaccacctaacgccctaacgaagttcgggtaagtttcggaacgggtacgtcccgtaaggaacctagttaccgtacggaacggaacccgtaaccgggtccccgttacttaacgtttaaccgtggttacgaccggtaaggtaccgtacccccgaaggtaaccgggtttcccggtacggtaccggtaccccgtaacgggtacccgtaacgggtcccggttaccccggttttaggtacccggttttcgggtcccggggggg

SEQ ID NO: 208952 - DNA, 707 bp, Homo sapiens
  misc_feature: GYAE6OF02JSDW4.17.25.C03.1.454.CMB.1.raw
  modified_base (312)..(312): a, c, t, g, unknown or other
  misc_feature (312)..(312): n is a, c, g, or t
  modified_base (314)..(314): a, c, t, g, unknown or other
  misc_feature (314)..(314): n is a, c, g, or t
tcagcgtagactagcacgaccggtgctcgatttagtagtgtagatttgggtttgggagtcagtctcagtcaggacacagcatggacatgagggtccccgctcagctcctgggctctgctactctggctcgagctgccagatgtgacatccagatgacccagtctccatccgtccctgtctgcctcgtgtgggggtacagtagtcaccatctacttgccggacacgtcacggacgttaaaacctgtttaaacttggtactacacgtcaagaacctaggaaaacgccccacgactcctgtactctcgtggtacncncgtacacctcgtcgacggtaagtcggctacccacgtcggtaaggtcctaggtcgcgtaggtacggtattcgggtggactaagttcgttacacgtaccttccaacctgtaccgacctacgttcctacggacctaaccgttacgggtaggttacctttacggacgtactaaccgtttacgttaccgtacgttacgttaaccgaaccgtttaacgtaccgtttacccgtaccggttacccttccgggtaaccgttttaccggtttacggggaacctaacccgggggtaacttaggtttaacggacgtaaccggttaacccgaaaggtttccccgaggggttttaaccaccggggtttaccaaccggttaactccggtttattccgggtttaacccc

SEQ ID NO: 208953 - DNA, 584 bp, Homo sapiens
  misc_feature: GYAE6OF02H9NEL.17.25.C03.1.454.CMB.1.raw
  modified_base (281)..(281): a, c, t, g, unknown or other
  misc_feature (281)..(281): n is a, c, g, or t
  modified_base (319)..(319): a, c, t, g, unknown or other
  misc_feature (319)..(319): n is a, c, g, or t
  modified_base (407)..(407): a, c, t, g, unknown or other
  misc_feature (407)..(407): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatccctccctgtctgcctctggtgggggtcagagtcaccatcacgtgccgacaagtcacggtacgttaaaacctatttaaattggtaatcagcaagaaacctggaaaacnccccaagaccctctgatctcgtggtcgcatccactcgngacgagtcggcctccatcggagttcaggtgcagtgatcgaggacagtacttcatctcacatcacctactctacgactaacctgacgtnttagtagactattacttaacttactgtaccaacgtacgtaacgttacctaccgttcccgtacgtaccgtttacgtttacggaccggtaagggtaacctaaggttacgtaacggtaacgtaaccgtaaacgtaccggttagtcggtactacggaccctaacctacttcgttcgttacg

SEQ ID NO: 208954 - DNA, 630 bp, Homo sapiens
  misc_feature: GYAE6OF02HEPOY.17.25.C03.1.454.CMB.1.raw
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagccgtggggcctcgagtgaaggtctcctgcaaggcttcgtggattcacgtttacctcctatagtatcaactgggtancgccaggccgngtggaccaacgacctggagtggagtgggatggggcctaaacccacgtacgtggtagtcacagtgtcttcacccatccgtacgggacagacttaccatcgaccacgacctcctacaataaaccacacgtacctaacagttacggagttacggaaggtacgacctagtaactacgttacgtcggaacccggaactacccgggtaccgttacttacttaccggtggtcggtaacgacggaccgtacccgaccggtacggttcccgggtacggaaccggtccgttaaccgggactacgggtaccgttcccggtttacgtaccggttcggtacccggggg

SEQ ID NO: 208955 - DNA, 563 bp, Homo sapiens
  misc_feature: GYAE6OF02GGNBW.17.25.C03.1.454.CMB.1.raw
  modified_base (279)..(279): a, c, t, g, unknown or other
  misc_feature (279)..(279): n is a, c, g, or t
  modified_base (434)..(434): a, c, t, g, unknown or other
  misc_feature (434)..(434): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggcctcagtgaaggtctcctgcaaggcttctggattcacgtttacctcctatagtatcaactgggtncgccaggccgctggacaacgacctgagtggatgggatgggacaaccctaagactggtgtacacagtgtcttacaccctatccgtccgggacacgaccttaccgatcgaccacgaactcctacaataaacacagcctacagtggtagttgaggacncctgacatcgtgacgacgacggtccgtactacgttctggtcgacgagacgtcccgaaggtcgtccggtagaccgtcccgtaacggccgtacggtccggttccgtttacggtaccgttacggtccggggg

SEQ ID NO: 208956 - DNA, 795 bp, Homo sapiens
  misc_feature: GYAE6OF02FSRH4.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcaggtgaaggtctcctgcaggcttctggattcacgttacctcctatagtatcaactgggtgcgccaggccgcgtaggacaacgaccgtggaggtacggtaagtggggagtcggggaccgtaaacccgtaacgacgtcggtgtacaacgtacggttgtaccttaccgacccctagttcccggtaccggggtaccaacgtaacccttacccgaagtaccggaacccaacggtaaaacccttccccgtaacccaaacgttaaaaacccgacgaaccggtacccctaaacgacgttaacggggtaaggtttacgggaacgggttaccggtacccgtaagggtaaccttagtaccgttaaggtaaaaccgggacccgtaacccggggttcccgtttaacgtttaaaccgtttaccggtcgggttaacggtacccgggtaaccggtaccggtaccccgtaacgggttacccggttaccccgggggtttaagaacccgggtccccggtttaaacgggggacccgaccgggttacccggggttacccgtttttcggtacccggttttccgggtaacccgggggggg

SEQ ID NO: 208957 - DNA, 585 bp, Homo sapiens
  misc_feature: GYAE6OF02F9DPK.17.25.C03.1.454.CMB.1.raw
  modified_base (196)..(196): a, c, t, g, unknown or other
  misc_feature (196)..(196): n is a, c, g, or t
  modified_base (230)..(230): a, c, t, g, unknown or other
  misc_feature (230)..(230): n is a, c, g, or t
  modified_base (260)..(260): a, c, t, g, unknown or other
  misc_feature (260)..(260): n is a, c, g, or t
  modified_base (291)..(291): a, c, t, g, unknown or other
  misc_feature (291)..(291): n is a, c, g, or t
  modified_base (339)..(339): a, c, t, g, unknown or other
  misc_feature (339)..(339): n is a, c, g, or t
  modified_base (466)..(466): a, c, t, g, unknown or other
  misc_feature (466)..(466): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggcngaggtgaagaagcctggggcctcagtgaaggtcncctgcaaggcttctggattcacgtttaccncctatagtatcaactgggtgcgccaggtccnctcggacaacgacctgacggtggatgggattgggaccaaacccgtaanacgtggtagtccacgagtgtccttaccacccatcccgtaccgggacagtaaccttaccgatcgaccaccgtaactaccctacaactaaacacacgacctacagtaggattaggagtacgcctgaacngcttagacaccgaaccggtccgtacttaagtccgttagcgtacgacggtcgtaccaccggtagtccggtagacggtacctacgggcaccggcggtcctttcggacctttcggacggggg

SEQ ID NO: 208958 - DNA, 645 bp, Homo sapiens
  misc_feature: GYAE6OF02HO1G5.17.25.C03.1.454.CMB.1.raw
  modified_base (280)..(280): a, c, t, g, unknown or other
  misc_feature (280)..(280): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttcgtggattcacgtttacctcctatagtatcaactgggtncgcaggccgctggacaacgacctgagtggatggggatggggacgaaccctaacgactggtcgtccacagtgtcttcacccatcccgtccggacagaccttaccatcgaccacgaacctccctacaagtaaaccacagtacctacagtcgggtagttaggaacggacgtccgtaggaacctcgttacgacgaaccggtaccgaccggggttacccttaccgttaacgtttcctacggttacgccgggtaagacccgggttaccccgaacgggtacgttccccgggttaggacccggtacccggtaaccgggccgtaaccggggcccggttcccggtttttaggacccggtttcgggtaccgggggg

SEQ ID NO: 208959 - DNA, 569 bp, Homo sapiens
  misc_feature: GYAE6OF02FZUMB.17.25.C03.1.454.CMB.1.raw
  modified_base (397)..(397): a, c, t, g, unknown or other
  misc_feature (397)..(397): n is a, c, g, or t
  modified_base (412)..(412): a, c, t, g, unknown or other
  misc_feature (412)..(412): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatccctccctgtctgcctcgtggtgggggtcagagtcaccatcacttgccggacaagtcacggacgttaaaacctatttaaattggtatcagcaagaaacctaggaaaacgccccagaccctcctgactctcgtggtcgcatcccactcgtgcgaagtcggccgtcccatcgaggttcagtggcagtgatcgtgggactagtatttcaatctacacatccaccactcngtaccaacgtgagtnttgtcactaactctaacctactcgtacaacgtagtaacgttaccgtaccgttcccctacgtacgttacctttggaaccgtaacggggtaacctaaggttagacgtaactacgaaacgacgttgtacggtctacgacctacgtacttacgtcgttacc

SEQ ID NO: 208960 - DNA, 564 bp, Homo sapiens
  misc_feature: GYAE6OF02FYOV4.17.25.C03.1.454.CMB.1.raw
  modified_base (278)..(278): a, c, t, g, unknown or other
  misc_feature (278)..(278): n is a, c, g, or t
  modified_base (332)..(332): a, c, t, g, unknown or other
  misc_feature (332)..(332): n is a, c, g, or t
  modified_base (338)..(338): a, c, t, g, unknown or other
  misc_feature (338)..(338): n is a, c, g, or t
  modified_base (440)..(440): a, c, t, g, unknown or other
  misc_feature (440)..(440): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctctatagtatcaactgggtncgccaggccgctggaccaacgacctgacgtggatgggatgggaccgaaccctanactggngtcaacagtgtcttccacccatcccgtaccgggacacggtaccttacatcgaccacgaacctcctaccaataaacacacgacctacatggagttagaggacncctgactatcctagaccgacgacggtccgtacttattacgtgttgacgtagtacgtaccccagtacgtccggtgaaccgtccgttaacggcacggtccggttcttcgtaccgttcgtaccgggg

SEQ ID NO: 208961 - DNA, 546 bp, Homo sapiens
  misc_feature: GYAE6OF02FZXZQ.17.25.C03.1.454.CMB.1.raw
  modified_base (301)..(301): a, c, t, g, unknown or other
  misc_feature (301)..(301): n is a, c, g, or t
  modified_base (342)..(342): a, c, t, g, unknown or other
  misc_feature (342)..(342): n is a, c, g, or t
  modified_base (368)..(368): a, c, t, g, unknown or other
  misc_feature (368)..(368): n is a, c, g, or t
tcagcgtagactagcacgaccggtgctcgatttagtagtgtagatttgggtttggggggagtcagtctcagtcaggacacagcatggacatgagggtccccgctcagctcctggggctcctgctactctggctccgagctgccagatgtgacatccagatgacccagtctccatcctccctgtctgcctctgtggggtcagagtcaccatcacttgccggacaagtcacggacgttaaaacctatttaaatggtatcagcagaaacctaggaaacgccccagacctcctgactctctggtnctactccactctgacgaagtcggctccatcgagtcagtcgnagtgatcgtggactagtattcaatcncacactcacactctacgcctaacctggtaacggtattcggtgactaacttctactatcgtacaactagtaacgttaccaccgtttcccctcgtaccttactttacggaccgtaacgggtaacctaaggttcgaagtaactaccgaaacgtacgtgtcggcagccactactctgttacc

SEQ ID NO: 208962 - DNA, 539 bp, Homo sapiens
  misc_feature: GYAE6OF02JCCJ7.17.25.C03.1.454.CMB.1.raw
  modified_base (353)..(353): a, c, t, g, unknown or other
  misc_feature (353)..(353): n is a, c, g, or t
  modified_base (386)..(386): a, c, t, g, unknown or other
  misc_feature (386)..(386): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
  modified_base (416)..(417): a, c, t, g, unknown or other
  misc_feature (416)..(417): n is a, c, g, or t
  modified_base (474)..(474): a, c, t, g, unknown or other
  misc_feature (474)..(474): n is a, c, g, or t
tcagcgtagactagcacgaccggtgctcgatttagtagtgtagatttgggtttgggagtcagtctcagtcaggacacagcatggacatgagggtccccgctcagctcctgggctcctgctactctggctccgagctgccagatgtgacatccagatgacccagtctccatcctccctgtctgcctctgtgggggtcagagtcacatcacttgccggacaagtcacggtacgttaaaacctattttaaaattggtaatcagcaacgaaacctaggaaaacgccccaagacctctagaatctactggtagcatccactctgacgaagtcgcgtccatcgagttcagtgcagtgancgtggacagtattcatctacactatcacattcngaccacgtgagtnttagngcaattctactnntacaatggtatacgtacgttcccagtcctacttggaccaggggtaacctaacggttnacggtcaacgtaaaccgtacgtcgttacggaccttacgtaccgaaccgttcttaccttaggttac

SEQ ID NO: 208963 - DNA, 764 bp, Homo sapiens
  misc_feature: GYAE6OF02G02BX.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgcaaggcttcgtggattcacgtttacctcctatagtatcaacgtgggtgcgccaggccgcgtaggaccaacgaccgtggagtcggagtgggatcggggaccgtaaaccctaacgaccgttgggtcgtacacgtaggttcgttccttaccacccctacttccccgtaccggggaactaacggtaccttaacccgagttaccggaacccctaaccggaaacccttccccgtaacccaaactaaaacccgaccaacggtaccccttaaacgtaacggttacgggtaacggtttacggaacgggtaccgtacccgtagaacctacgttcccgtacggaaccggtacccgaccggggtacccgtttactttaacgtttaccggttcggttaccggaccggtaacggtacccggttaccccgaacggttaccggttaccccgggtaggaacccggtaccccggttaaccggggaccgtacgggtaccccgggttccccgttttacgggtacccgttttcccgggtacccggggggg

SEQ ID NO: 208964 - DNA, 708 bp, Homo sapiens
  misc_feature: GYAE6OF02JB0O7.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcgagtgaaggtctcctgcaaggcttctggattcacgtttacctcctatagtatcaactgggtgcgccaggccgctaggacacgacctggagtggacgtgggagtcgggaccgaaccctaacgacgtggtcgtccacgagttcgtccttaccaccctacgtcccgtaccggggactacgtaccgttaccacgttacgaacccgaacgtaaccttccctaccgaaacttaaaccgacctaacgtaccctaaacgtagttaccgggtaaggtttcggaacgggtaaccggtcccgttaacggtaacctaagttacccgtaagggtaaacccggacccgtaaccgggggtacccttacgtttaaccgtttaaccgtcggttacgacccgtaaggacccgttaccccgaacggtaccgttcccgggtagaaccggtacccgtaccgggaccacggtcccggttaccctttacggtaccgttcgggtacccggggg

SEQ ID NO: 208965 - DNA, 739 bp, Homo sapiens
  misc_feature: GYAE6OF02I5T1M.17.25.C03.1.454.CMB.1.raw
  modified_base (175)..(175): a, c, t, g, unknown or other
  misc_feature (175)..(175): n is a, c, g, or t
  modified_base (219)..(219): a, c, t, g, unknown or other
  misc_feature (219)..(219): n is a, c, g, or t
  modified_base (232)..(232): a, c, t, g, unknown or other
  misc_feature (232)..(232): n is a, c, g, or t
  modified_base (241)..(241): a, c, t, g, unknown or other
  misc_feature (241)..(241): n is a, c, g, or t
  modified_base (244)..(244): a, c, t, g, unknown or other
  misc_feature (244)..(244): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtncagctggtgcagtctggggctggaggtgaagagcctggggcctnagtgaaggtctcngcagcttcnggnttcacgtttacctctatagtatcaacgtgggtgccgccgaggccgctcgggacaaccgcctggagtggagtggggagtcgggaccgtaaacccgtaacgcgttggtcgtaccgacgtggttcgtccttaccgaaccctacgtcccgtaccgggaactaccggtaactttacccgacgtaccgaacccgtaaccggtaacctacccccgtaacctaaacccgtaaaaccgacccgtaaccggtacccttaaaccgacggttacgggtaacggtttaggaacgggtacgtacccgtagaacctacgtaccgtaacggaccgtaaccggaccggttcccggtactttaaacggttaccgtcgttacgggacgttaccggtacgttaccccgaaggttaccggttacccgggaggtaacccgttcccggtaaacgggcccgtaaaccgggtccccgggtttacctttaccgggtacccgtttacgggtaccccgggggg

SEQ ID NO: 208966 - DNA, 666 bp, Homo sapiens
  misc_feature: GYAE6OF02GKVXT.17.25.C03.1.454.CMB.1.raw
  modified_base (281)..(281): a, c, t, g, unknown or other
  misc_feature (281)..(281): n is a, c, g, or t
  modified_base (306)..(306): a, c, t, g, unknown or other
  misc_feature (306)..(306): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacacgacctgngtggatgggatgggacaacctaacacgtggtgtacagtagtgtccttaccgaccccatcccgtaccgggacacggtacttaccatacgaccaccgaacctcccgacccaattaaaacccactaacgcccctaaacgtacgtacgggtaagttagggaacggtacgtacccgttagaactacgttccgtacggaaccgaccgaacccgggtcccgtttaccgttaatttaccggttgttacggccgtaacggtaccggtacccctaacggtaccggttcccgggtagaccggtacccggttaaccggccgtaccgggtaccggttcccgtttacggttacccgtttcgggaaccccggggg

SEQ ID NO: 208967 - DNA, 576 bp, Homo sapiens
  misc_feature: GYAE6OF02IJX5P.17.25.C03.1.454.CMB.1.raw
  modified_base (245)..(245): a, c, t, g, unknown or other
  misc_feature (245)..(245): n is a, c, g, or t
  modified_base (281)..(281): a, c, t, g, unknown or other
  misc_feature (281)..(281): n is a, c, g, or t
  modified_base (291)..(291): a, c, t, g, unknown or other
  misc_feature (291)..(291): n is a, c, g, or t
  modified_base (430)..(430): a, c, t, g, unknown or other
  misc_feature (430)..(430): n is a, c, g, or t
  modified_base (444)..(444): a, c, t, g, unknown or other
  misc_feature (444)..(444): n is a, c, g, or t
  modified_base (462)..(462): a, c, t, g, unknown or other
  misc_feature (462)..(462): n is a, c, g, or t
  modified_base (502)..(502): a, c, t, g, unknown or other
  misc_feature (502)..(502): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcgnggattcacgtttacctcctatagtatcaactgggtncgccaggccncgtggacaacgacctgagtgatgggatcgggcaaacctaacacgtggtctcaacgagttcgttccttacaccctagtcccgtccgggaacaggtaccttaccacgtcggacctacgaacctcccgtaccaaactaaacnctaacgaccctaanagtaggagttgaacggancctagacatcgagacgcgaccggtccgttactacttacgngtcgacgagtacgtacccgaagtcgtccggtgacgtccgtacggcacgggccgtcttcgaccgttcggacgggg

SEQ ID NO: 208968 - DNA, 760 bp, Homo sapiens
  misc_feature: GYAE6OF02HKGML.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagccgtggggcctcgagtgaaggtctcctgcaaggcttcgtggtacttctaccgtttacctcctaatacgtatcgaacgtgggtgccgccgacggccgcgtacggaaccaaccggtacctggagtgggagtggggagtcggggaccgtaaacccgtaacgacgtggtagtaccgacgtacgtcgttaccttaccaacccctacgtacccgtaccgggaaccaacggtaccttaaccgagtaccgaccgtaaccgaacctacccgtaaccctaaactaaaacccaccaacgtacccttaacgagttacgggtaaggttacggaacggacgtccgtagaacctacgttaccgtacgaacccggaaccggtacccggttacccgttaacgtttacctttaccggtagttaccggaccggaaccggtacccgttaccccgtaccgggtaaccgtacccggggttacggtaacccgggtacccggttaacccgggacgtaaccgggtcccgggtttaacccgttttccgggttacccggtttacccggggtaccggggg

SEQ ID NO: 208969 - DNA, 594 bp, Homo sapiens
  misc_feature: GYAE6OF02ILS96.17.25.C03.1.454.CMB.1.raw
  modified_base (220)..(220): a, c, t, g, unknown or other
  misc_feature (220)..(220): n is a, c, g, or t
  modified_base (346)..(346): a, c, t, g, unknown or other
  misc_feature (346)..(346): n is a, c, g, or t
  modified_base (441)..(441): a, c, t, g, unknown or other
  misc_feature (441)..(441): n is a, c, g, or t
  modified_base (522)..(522): a, c, t, g, unknown or other
  misc_feature (522)..(522): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctnagtgaaggtctcctgcaaggcttctggattcacgtttacctcctatagtatcaactgggtgcgccaggccgctaggacaacgacctgagtggagtgggatcggggaccaaaccctaacacgtggtntacacgtagttcgtccttccgaaccccatcccgtaccgggaacagtaaccttaccatcgaaccacgaacctcctaccaataaacacagacctaanagtggtagttggaacgacgtcctagacatcgtagaaccgacgaccggtccttataacttacgtcggtacgacgaggtaccncccgaaggtcgtaccgggtagacgtacccgtacggctacggtccggttcctttagtaccgttcggtacgggg

SEQ ID NO: 208970 - DNA, 661 bp, Homo sapiens
  misc_feature: GYAE6OF02JGCU0.17.25.C03.1.454.CMB.1.raw
  modified_base (432)..(432): a, c, t, g, unknown or other
  misc_feature (432)..(432): n is a, c, g, or t
  modified_base (445)..(445): a, c, t, g, unknown or other
  misc_feature (445)..(445): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctcagtgaaggtctcctgcagcttctggattcacgtttacctcctatagtatcaacgtgggtgcgccgaggccgtctaggacaacgacctggacggtggagtgggagtcggggacgaaacccctacgatcggtcgtacacgtacgtgttccttaccgaccctactccgtaccgggactacgaccttacatcgaccacgaacctcctaccaataaaccnctacgaccctaanagttacggagttggacggtacgcccaggactacgttcgaggtaacccgaccgtaccgggtcccttaccgttaacgtttaaccgtgttaccgggacgtacggtacccgtacccgtaaggtacccggttccgggtaggttaacccggcccggttaaccgggtccgtacgggttaccccgggttccgttttaccggtacccgttccgggtaaccggggg

SEQ ID NO: 208971 - DNA, 661 bp, Homo sapiens
  misc_feature: GYAE6OF02H9DKJ.17.25.C03.1.454.CMB.1.raw
  modified_base (292)..(292): a, c, t, g, unknown or other
  misc_feature (292)..(292): n is a, c, g, or t
  modified_base (314)..(314): a, c, t, g, unknown or other
  misc_feature (314)..(314): n is a, c, g, or t
  modified_base (345)..(345): a, c, t, g, unknown or other
  misc_feature (345)..(345): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtgcccactcccaggtgcagctggtgcagtcgtggggctgaggtgaagagccgtgggcctcaggtgaaggtctcctgacaagggtcttcgtaggtattccaacgttttacctcctatagtatcaacgtgggtncgccaggccgctggacaacgcngacgtgagtgggtatcgggactaaccctaanacgtggtcgtacacgtagtacgttcgtccaacccagtcccgtccggggaacacgtaacctttaccgaattaccggaaccctaaccgtaacctaccccgtacccaaacgtaaaccacctaacggaccctaaccgagtcgggaagttacgaggtacgtcccttagacatcgtagaaccgaccgtaccggcccgtttattacgtttaccgagtacggtaccggaacgttacccgaccgtaaccggtacgtaccgggttgaaccggttacccgtacggacgacgggtccgttcgtttaccggtacgttcccggtacgggg

SEQ ID NO: 208972 - DNA, 545 bp, Homo sapiens
  misc_feature: GYAE6OF02GDZJT.17.25.C03.1.454.CMB.1.raw
  modified_base (376)..(376): a, c, t, g, unknown or other
  misc_feature (376)..(376): n is a, c, g, or t
  modified_base (413)..(413): a, c, t, g, unknown or other
  misc_feature (413)..(413): n is a, c, g, or t
  modified_base (439)..(439): a, c, t, g, unknown or other
  misc_feature (439)..(439): n is a, c, g, or t
  modified_base (445)..(445): a, c, t, g, unknown or other
  misc_feature (445)..(445): n is a, c, g, or t
  modified_base (508)..(508): a, c, t, g, unknown or other
  misc_feature (508)..(508): n is a, c, g, or t
tcagcgtagactagcacgaccggtgctcgatttagtagtgtagatttgggtttgggggactcaacagccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcaccgtttacctcctatagtatcaactgggtgcgccaggccgctggacaacgacctgagtggatgggagtgggaccgaacccgtaacacgtggtcgtcacagtcgtcttcacccactccgccgganacgtacttaccatcgaccacgacctccacaacaaacncacgacctacagtggtagtgaggacnccgtanacatcagacgacgccggccttactagtactggcgcgagccgtacccgaagtcgtccggtgacnccgtacggactccggcggttacctttcggacttcggg

SEQ ID NO: 208973 - DNA, 674 bp, Homo sapiens
  misc_feature: GYAE6OF02JRXIK.17.25.C03.1.454.CMB.1.raw
  modified_base (202)..(202): a, c, t, g, unknown or other
  misc_feature (202)..(202): n is a, c, g, or t
  modified_base (222)..(222): a, c, t, g, unknown or other
  misc_feature (222)..(222): n is a, c, g, or t
  modified_base (233)..(233): a, c, t, g, unknown or other
  misc_feature (233)..(233): n is a, c, g, or t
  modified_base (243)..(243): a, c, t, g, unknown or other
  misc_feature (243)..(243): n is a, c, g, or t
  modified_base (507)..(507): a, c, t, g, unknown or other
  misc_feature (507)..(507): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggactcctcttcttggtggcagcagctacaagtcgcccactcccaggtgcagcgtggtgcagtcgtgggctgnggtgaagacgcgtgggcctnagtgagtctcngacagcttcnggacttcacgtttcctctatagtatcgtaagtggtcgacgcgttacggccgcgtaggacacgtaccgtggaggtggagtgggacgtcgggaccgtaaaccctacgacgtcgggtgtaccgacgtacgtcgttccttaaccaccgacgttacccgccgggtaactacgtaacctaccgaataccggaacctaccgtaaccctcgttaaccaagtaaaccacgtacgaccttactagtacggttaggtacgtaacggcgtaccgtntacctattacccgtagacccggaaccgtcccggtaaccgtttactaccgtttagcctacgggccgtaactacccgggttaccacggtccggttaccggtcgtacccggacccgttaccggcgacccggttccggtttaccggttccggttacggtccggtaccgggg

SEQ ID NO: 208974 - DNA, 769 bp, Homo sapiens
  misc_feature: GYAE6OF02G5TRY.17.25.C03.1.454.CMB.1.raw
  modified_base (198)..(198): a, c, t, g, unknown or other
  misc_feature (198)..(198): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgnggtagaagaagccgtgggcctcgagtgaaggtctcctgacaaggcttcgtaggtattcgtacgtttacctcctatagtatcaacgtggtgcgccgaggtccgacgtggaccaacggaccgtaggacgtggatggggtatcgggaccgaaaccctaacgacgttggtcgttaccacgagttacgttccttaccgacccctacgttcccgtaccggggtaacctacggtaaccctttaacccgacgttaccggaacccctaacccggtaaaccctttccccgtaaacccgtaaaacttaaaacccgaccgtaaccgtacccctaaacgttaacggtccgggttaaacggtttacggaacgggtaccgtccgtacggtaaccctaacgttccggttaccggaaacccggaccggtaccccgggttaccgtttaaccgttaccgtttaaccgtcgggtacgtaaccggtacggtaccctaccccggtaacggtcggttaccccgggtaggaacccgtacccggtacggacctacgggtcccggttaccttttggtacccgttcggtaacccgggg

SEQ ID NO: 208975 - DNA, 731 bp, Homo sapiens
  misc_feature: GYAE6OF02GUY7N.17.25.C03.1.454.CMB.1.raw
  modified_base (258)..(258): a, c, t, g, unknown or other
  misc_feature (258)..(258): n is a, c, g, or t
  modified_base (276)..(276): a, c, t, g, unknown or other
  misc_feature (276)..(276): n is a, c, g, or t
  modified_base (632)..(632): a, c, t, g, unknown or other
  misc_feature (632)..(632): n is a, c, g, or t
  modified_base (672)..(672): a, c, t, g, unknown or other
  misc_feature (672)..(672): n is a, c, g, or t
tcagcgtagactagcacgaccggtgctcgatttagtagtgtagatttgggtttgggggactcaacaaccacatctgtcctctagagaaaaccctgtgacgcacagctcctcaccatggactggacctggaggactcctcttcgttggtggacagcagctacaagtcgcccactcccgaggtcgcagcgtggtcgcaggtcgtgggctgaggtgaagacgccgtgggctcgagtgaacggtctcctgacgaggtcttgnggtattcgacgtttaccnctagtacgtctacaacgttgggtcgcgtccgacgggcccgtgtacggaccaaccgtaccgtggacgtacggagttacggggaacgtggggaacccctaaacccgtaagtacggttcgggtacgtaccggaacggtacggtcgtttacctttacccgaaccccgtacggtttccccggaccggggtaaaactaccggtaaccctttaacccgagtttacccggaacccgtaaccgtaaccttccctaacgtaactaaacgtaccgacgtacctacgtagtcgtacggttcgagggtactacggaactataccgtcgttacgaccggtacgtacccggtccgtacttacgttacggtntacggacgacgtacgtcccgtaccgtaggtacccgggtanaccgggtaccgtccggacgtacggtccggttacccgttcggttacccgtcggtaccggg

SEQ ID NO: 208976 - DNA, 761 bp, Homo sapiens
  misc_feature: GYAE6OF02IUCVQ.17.25.C03.1.454.CMB.1.raw
  modified_base (261)..(261): a, c, t, g, unknown or other
  misc_feature (261)..(261): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcagtgaaggtctcctgcaaggcttcgtggattcacgtttaccncctatagtatacaacgtgggtgcgccgacgggccgcgtcggaccaaccggaccgtggacgtgggagttggggagtcggggaccgtaaaccccgtaaacgaccgttgggtacgtacgacgtaggtcgttcctttacccgaaccctacgtcccggttaccggggaacctacggtaacccttaaccgaacgtccgaacccgaaccggtaacccttaccctaacccgtaaactaaaacccacgtaaaccgtaccctaacgtaacggttacgggtaaacggtttacggaacgggtacgtaccccgttagaaacctacgttaccgtaacggaacccgtaaccggaacccgggttaccccgttacgtttaacgtttaccgtacggttaccggaaccgtacggtaaccgtaccccgaaacgggtccgttacccgggagtaacccggtacccgttaacgggccacgggtcccggttacccgtttcggtaccgtttcgggtacccggggg

SEQ ID NO: 208977 - DNA, 750 bp, Homo sapiens
  misc_feature: GYAE6OF02JEXLZ.17.25.C03.1.454.CMB.1.raw
  modified_base (259)..(259): a, c, t, g, unknown or other
  misc_feature (259)..(259): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagccgtggggcctcagtgaaggtctcctgcaggcttctggattcacgtttaccncctatagtatcaacgtgggtgccgccaggcccgcgtaggaccaacgatcgtggaggtgggatggggatgggggaccaaacccctaacacgtgggtacgtcaacgaggttcgtctttacccaacccctagttccccgtacccggggaactacgtaacccttacccagtacgaacccaaccggtaacctccctaccaacttaaaaccacacggtaccctaacgtagtacggtaggtttacggaacggtacgtcccgttaacggacctaacgttaccgtacggtaccgaaccggtacccgggtacccgtttacgttaaacgttttaaccgttggttaccgggtaaccgtacgggtaacccggttaccccgaaacccgggtaccggtttaccccggggtaggtaacccggtacccccggttaacccggggtaccggtaaccgggtccccggggttttacccgtttttaccgggaaccccgttttttcccgggggg

SEQ ID NO: 208978 - DNA, 598 bp, Homo sapiens
  misc_feature: GYAE6OF02IZSL8.17.25.C03.1.454.CMB.1.raw
  modified_base (448)..(448): a, c, t, g, unknown or other
  misc_feature (448)..(448): n is a, c, g, or t
  modified_base (457)..(458): a, c, t, g, unknown or other
  misc_feature (457)..(458): n is a, c, g, or t
  modified_base (469)..(469): a, c, t, g, unknown or other
  misc_feature (469)..(469): n is a, c, g, or t
  modified_base (518)..(518): a, c, t, g, unknown or other
  misc_feature (518)..(518): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagccgtgggcctcagtgaaggtctcctgcaaggctcgtggattcgtacgtttacctctatagtatcaacgtgggtgcgccaggccgcgtggacgaacgacctggacgtggacgtggggacgtcggggaccgaaccctaaacgacgtggggtactacgaacgtaacggttcgtaccttaccgaccccgtagtcccgtaccgggaacacgtaccttacgactgaccacgactccactaataaccnacgcctaanngagttgagtancctagacactcgtcgaacgacgtaccgcgttaactacttcaggttacgngaagtacgtacccgacgtcgttcccggagtcgtaccgtacggacacggtcccgtaacgtttcgtaccgttggtaccgggg

SEQ ID NO: 208979 - DNA, 674 bp, Homo sapiens
  misc_feature: GYAE6OF02ISOVQ.17.25.C03.1.454.CMB.1.raw
  modified_base (192)..(192): a, c, t, g, unknown or other
  misc_feature (192)..(192): n is a, c, g, or t
  modified_base (200)..(200): a, c, t, g, unknown or other
  misc_feature (200)..(200): n is a, c, g, or t
  modified_base (276)..(276): a, c, t, g, unknown or other
  misc_feature (276)..(276): n is a, c, g, or t
  modified_base (510)..(510): a, c, t, g, unknown or other
  misc_feature (510)..(510): n is a, c, g, or t
  modified_base (549)..(549): a, c, t, g, unknown or other
  misc_feature (549)..(549): n is a, c, g, or t
  modified_base (581)..(581): a, c, t, g, unknown or other
  misc_feature (581)..(581): n is a, c, g, or t
tcagcgtagactagcacgaccggtgctcgatttagtagtgtagatttgggtttggggtacgtcgaacaaccacatctgtcctctagagaaaccctagtgagcacagctcctcaccatcgactggacctggaggatctcttcttggtggcagcagctacaagtcgcccactcccaggtcgcagctggtcgacncggttcgnggggtcctaggaggtggaagaaggcccgtggggcctcgaggtaggaaggttcctccgtgacgaacgggctttccgnggtacttaccgtacgttttaccctaccttataacggttatactaacggttggggtcgaccgaccgacgggccgtccggtggaccgaaacgtccgtagaggtaggattcggggcgtacgggaccggtaaacccctacgacgttcggggtctaccacgaggtccgttcttacccaccaacttccggaccgggtacgataaccgtccgtaatccgaaccgacgtacctctacccganaaactacacgactacacgtagtacgtggacgacgtccanactagtctacgacccgaggaccgtacccgttnaacgtttccaggttcacgtacgacgttcccaagggcttcgggctacgcccgttggacctacgggtacgtcccgtttacgtagtcccgtcgggg

SEQ ID NO: 208980 - DNA, 792 bp, Homo sapiens
  misc_feature: GYAE6OF02FXVYA.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttcgtggattcacgtttacctctatagtatcaactgggtgcgccaggccgctggacaacgacctgagtggagtgggatgggaccaaccctaagcgtggtcgtcacgagttcgtcttaccaccctactcccgtaccggggaacaggtaacccttaccgaacttacgaaccctaaccgtaaaccctccctacccgaaacttaaaaccacccgtaaccgtacccttaaacgtacgttacgggtaacggtttacgggaagggtacgtaccccgttagggaacctaacggttccgttaacgggaaccggtaacccggtaacccgggttaccccggttaaccgttttaaaccgttttaaccgttacgggttaccgggtaacccgtaacgggttacccggttacccccggtaaccgggttaacccgggtttaccccggggtttaacgggaaccccgggttaaccccgggttaacccgggtaccggtaacccggggttaccccggtttaacccggtttttaccggttaacccggttttcccggggttaaccccgggggggg

SEQ ID NO: 208981 - DNA, 629 bp, Homo sapiens
  misc_feature: GYAE6OF02I2DPV.17.25.C03.1.454.CMB.1.raw
tcagcgtagactagcacgaccggtgctcgatttagtagtgtagattttggggttttgggggggagtcagtactcagtcgaggacgacagcatggacatgagggtccccgctcagctccttggggctcctgctactctggctccgagctcgccgagatgtgacatccagatcgaccagtcctccatcctcctgtctggcctcgtggtcggggtcagagtcaccatcactcgccgacaagtctacggtacgttaaaacctatttaaattggtactacagctaagaaacctaggaaaacgccccaagtacctacctagacttcctacgtggtgactactccacttcctacggacgtaaggtccgggtacctacccagttccgaaggtttcgaaggtcggacgtaggtcgggtactcgttacgggactagtactttaccgaattccacgacctactccaccactcgtgaccaaacgtgaggtatgtacgtactaacgttctactactgtaacaacgtacgtacgtttacctaccgttcccctagtaccttacgtttcggaccgaacgggtacaagttacgaagtaactacaaacggtacgtaggtacgctacgaccacctattctacgttacc

SEQ ID NO: 208982 - DNA, 575 bp, Homo sapiens
  misc_feature: GYAE6OF02ITSBX.17.25.C03.1.454.CMB.1.raw
  modified_base (221)..(221): a, c, t, g, unknown or other
  misc_feature (221)..(221): n is a, c, g, or t
  modified_base (307)..(307): a, c, t, g, unknown or other
  misc_feature (307)..(307): n is a, c, g, or t
  modified_base (353)..(353): a, c, t, g, unknown or other
  misc_feature (353)..(353): n is a, c, g, or t
  modified_base (477)..(477): a, c, t, g, unknown or other
  misc_feature (477)..(477): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctcctgtctgcctctggtgggggtcagagtcacatcacttgccgganaagtcacggtacgttaaaacctatttaaattggtatcagcaagaaaacctggaaaaacgccccagacctcctagactctcgtggtncattccatctgcgaagtcggctcccagtcgaggttcaggtcggacnggtgagtcgtagggacagtatttacattcctacaacctactacccacctacctcgtagacctaaaccgtgaggtattacggtgactaacgttactaacttactcgaacaacgtagtacttaacncgttacccctacgactttacgtttcggacgtaaccgggactaaggttgacgtactaaccgaaacgtataggtgacttcgcctacaacgttcttcgtac

SEQ ID NO: 208983 - DNA, 618 bp, Homo sapiens
  misc_feature: GYAE6OF02F2OD1.17.25.C03.1.454.CMB.1.raw
  modified_base (259)..(259): a, c, t, g, unknown or other
  misc_feature (259)..(259): n is a, c, g, or t
  modified_base (280)..(280): a, c, t, g, unknown or other
  misc_feature (280)..(280): n is a, c, g, or t
  modified_base (284)..(284): a, c, t, g, unknown or other
  misc_feature (284)..(284): n is a, c, g, or t
  modified_base (290)..(290): a, c, t, g, unknown or other
  misc_feature (290)..(290): n is a, c, g, or t
  modified_base (352)..(352): a, c, t, g, unknown or other
  misc_feature (352)..(352): n is a, c, g, or t
  modified_base (422)..(422): a, c, t, g, unknown or other
  misc_feature (422)..(422): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttaccncctatagtatcaacgtgggtncgcnggccgngtggaccaacgcctggagtggatgggatgggacgaaccctaagacgtggtcgtcacgacgtntccttacacccctatccgtccgggacacgtaccttaccgatccgaccgaccgacttcccacaactaaacncagtaccctagagtggtagttggacggtagcccgttagaacctgtaccgtaggaaccgtacacccgggttccttaacttaacgtttcgtcggacggtacgacggtacccttcccgacgggtacgttcccgggtggaacccgtccgtaccgggctaccgggtcccgttccgtttcgggaccctttcgggacccgggg

SEQ ID NO: 208984 - DNA, 711 bp, Homo sapiens
  misc_feature: GYAE6OF02GJ4RB.17.25.C03.1.454.CMB.1.raw
  modified_base (284)..(284): a, c, t, g, unknown or other
  misc_feature (284)..(284): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcctggggcctcaggtgaaggtctcctgcaaggtcttcgtggattcacgtttacctctatagtatcaacgtgggtncgccaggccgcgtggacaacgacctggagtggatggggatggggacctaaccctaacgacgttggtcgtacacgtagtcgttccttaccaccctatcccgtaccggggactaacggtaacccttaccacgtaccggaaccctaaccggtaaaccctcccgtaacccaaacgttaaaacccaccaacgtaccctaacgatagggtaacggtttacggaacgggacgtcccgtagtaacctacgttaccgtacggaaccgaaccgtacccggggtacccggtttacttaacgtttacgttacggtacgggacgtaaccggtaccgtaccccgaacggtaaccggttaccgggtacggtaacccggtcccggtaacggaccggtacggtacccggttcccgtttacgtaccggtttccggtaccgggggg

SEQ ID NO: 208985 - DNA, 689 bp, Homo sapiens
  misc_feature: GYAE6OF02JUDAK.17.25.C03.1.454.CMB.1.raw
  modified_base (252)..(252): a, c, t, g, unknown or other
  misc_feature (252)..(252): n is a, c, g, or t
  modified_base (362)..(362): a, c, t, g, unknown or other
  misc_feature (362)..(362): n is a, c, g, or t
  modified_base (379)..(379): a, c, t, g, unknown or other
  misc_feature (379)..(379): n is a, c, g, or t
  modified_base (527)..(527): a, c, t, g, unknown or other
  misc_feature (527)..(527): n is a, c, g, or t
tcagcgtagactagcacgaccggtgctcgatttagtagtgtagatttgggtttggggtacgtcaacaaccacatctgtcctctagagaaaaccctgtgagcacagctcctcaccatggactggacctggaggatcctcttcttggtggcagcgacgctaacgagtccgccctacctcccgtggtcgcgagtcgtggtgacgtcgtcggtcgggcgtaggagggtaggaagaacggccggtcggggcctacgngtaggacgttctccgtgacgacggtctcgtagtcttctaccgtttcctacttagtagtactaccgtacggtggtcgtccgaccgccggccgtcggacggaaccgtaaccncggtcgtagggtacggnggtagggtacgacggggaaccctaaaccttaacgacggttcggttacgacaacggtacgtttcgtccttaccgaaccctccgttccggaacggaccgtacgtaacctacacgtaccgacacgtaaccctctaactaaacgaacgtacncgtacctacgaacggtggacgtgacggacctcgatctagtcacgtaccgagtccgcgttactacttacgtggccaagttaccgcctacgacgttcggaccggtgtaaccggcgttaaggccccgtagggtaccctttccggtacgttccgtcgggtaccggg

SEQ ID NO: 208986 - DNA, 595 bp, Homo sapiens
  misc_feature: GYAE6OF02F8555.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaacgtgggtgcgccaggccgctggacaacgacctgagtggatgggatgggaccgaaaccctaacacgtgggtgtcacagtgtcttccaccccatcccgtcgggacacggtaaccttaccatcgaccacgaacctccctaccaataaacacacgacctacagtggagttgaggacgcctgacactcgtagaccgacgaccggccgttacttacttactggtcgacgaacggtaccgtacccgaacggtaccgttcccgggtagaccggtacccgtacgggccacgggtcccggtacccgttttcggacccgtttcggtaccgggg

SEQ ID NO: 208987 - DNA, 615 bp, Homo sapiens
  misc_feature: GYAE6OF02HWLZU.17.25.C03.1.454.CMB.1.raw
  modified_base (247)..(247): a, c, t, g, unknown or other
  misc_feature (247)..(247): n is a, c, g, or t
  modified_base (282)..(282): a, c, t, g, unknown or other
  misc_feature (282)..(282): n is a, c, g, or t
  modified_base (294)..(294): a, c, t, g, unknown or other
  misc_feature (294)..(294): n is a, c, g, or t
  modified_base (308)..(308): a, c, t, g, unknown or other
  misc_feature (308)..(308): n is a, c, g, or t
  modified_base (335)..(335): a, c, t, g, unknown or other
  misc_feature (335)..(335): n is a, c, g, or t
  modified_base (341)..(341): a, c, t, g, unknown or other
  misc_feature (341)..(341): n is a, c, g, or t
  modified_base (354)..(354): a, c, t, g, unknown or other
  misc_feature (354)..(354): n is a, c, g, or t
  modified_base (364)..(364): a, c, t, g, unknown or other
  misc_feature (364)..(364): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagaagccgtgggcctcgagtgaaggtctcctgcaggcttcnggattctacgtttacctctatagtatcaagtggtncgccagccgcgnggacaacgcctggngtggagtgggatgggaccaaccctaanacgtgngtacacgtagttntctacacccntcccgtcggacagtactaccagtcgaccacgtacctccgtaccaataaaccacgacgcctaacgacgtggtagttaggacggaccgtccgtacgaacacgttccgtacggaaccgaccgaacccggttacctactttacgtaccttacggcgtacgagtaccgtacccgaccggtcgttcccgggtagaccgtacccgacgtaccggacggtacccggttcggttttaccgaccggtttcggtacccgggg

SEQ ID NO: 208988 - DNA, 692 bp, Homo sapiens
  misc_feature: GYAE6OF02IPKGH.17.25.C03.1.454.CMB.1.raw
  modified_base (243)..(243): a, c, t, g, unknown or other
  misc_feature (243)..(243): n is a, c, g, or t
  modified_base (249)..(249): a, c, t, g, unknown or other
  misc_feature (249)..(249): n is a, c, g, or t
  modified_base (284)..(284): a, c, t, g, unknown or other
  misc_feature (284)..(284): n is a, c, g, or t
  modified_base (326)..(326): a, c, t, g, unknown or other
  misc_feature (326)..(326): n is a, c, g, or t
  modified_base (344)..(344): a, c, t, g, unknown or other
  misc_feature (344)..(344): n is a, c, g, or t
  modified_base (374)..(374): a, c, t, g, unknown or other
  misc_feature (374)..(374): n is a, c, g, or t
  modified_base (399)..(399): a, c, t, g, unknown or other
  misc_feature (399)..(399): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagcctgggcctcagtgaaggtctcctgcaggcttntaaggnttctacgtttacctcctatagtatcaacgtgggtncgccaggccgcgtggaccaacgacctggaggtggagtgggancggggaccgaaccctaancgtggtgtcacgagtctaccttccaccctntccgaccggacacgtaccttaaccngtaccgacccaaccgtacctaccctaccaaactaaaccaccgaacgtaccctaagacggtagggtaagttacgggaaggtacgtacccgtaggtacctagttaccgtacggaaccgaacccggtaccggtacccggttactttaacgtttaccgtcggtaacggaccgggtaacgtacccggtaccccgtaaggtacccggtttacccgggaggtaacccggtacccggttaaccgggccggaccgggttccgggttcccgttttacggttacccggttccgggtaccggggg

SEQ ID NO: 208989 - DNA, 675 bp, Homo sapiens
  misc_feature: GYAE6OF02JLEWO.17.25.C03.1.454.CMB.1.raw
  modified_base (245)..(245): a, c, t, g, unknown or other
  misc_feature (245)..(245): n is a, c, g, or t
  modified_base (300)..(300): a, c, t, g, unknown or other
  misc_feature (300)..(300): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcgagtgaaggtctcctgcaggcttntggtattctaccgtttacctcctatagtatctaacgtgggtgccgccgaggccgngtggacaaccgacctgagtggagtgggagtcgggaccgaaaccctaacgacgttggtcgtcaacgtaggtcgtcctttaccgacccctacgtcccggtaccgggacgtacgtaccttacccagtccgaaccgaaccgtaacctcccctaccaaactaaaccacaacgtaccctaacacgttacggtaggttaggaacggtacgtccgtagaacctacgttaccgtacggaaccgacccgtaccgggtcccgttactttaacgttaccgtaggtaccgtacggacgttaccgtacccgtacgtaacggttccggaggaccgtacccgtaacggcgacgggtccgttccgttttcggaccgtttcgggtaccggggg

SEQ ID NO: 208990 - DNA, 847 bp, Homo sapiens
  misc_feature: GYAE6OF02HB0PO.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaaggtctcctgcaaggcttcgtggattctacgtttacctcctaatagtactcaacgtgggtgcgccaggccgcgtggaaccaacgcctaggacggtggagtgggagtcggggacgaaaccctaactacgtggtcgtcaagtacggttcgttactttacccgaaccctaccgttcccggtacccggggtaacctaacgggtaaccctttaaacccgaacgtttaccggtaaaccccgaaacccggtaaaccctttccccgtaaacccgtaaacttaaaaaacccgacccgtaaaccggttacccttaaacgtaaccggtttaaggggaacggttttacggggaaacgggttaacccggtccggttaacgggaacctacggttaccggttaccggaaacccggtaaccggtacccggggttaaccccgttacgtttaaaccgttttacccgggttagggttaccggtaaccggggtaaccggtaacccgggtttaccccccgaaaacgggtacccgtttacccgggggtacggtaacccggtaaccccgggttaacggcccggtaacgggttcccccgggtttaccgttttacgggtaacccgttttcccggggtcccgggggg

SEQ ID NO: 208991 - DNA, 654 bp, Homo sapiens
  misc_feature: GYAE6OF02JQPAO.17.25.C03.1.454.CMB.1.raw
  modified_base (376)..(376): a, c, t, g, unknown or other
  misc_feature (376)..(376): n is a, c, g, or t
  modified_base (385)..(385): a, c, t, g, unknown or other
  misc_feature (385)..(385): n is a, c, g, or t
  modified_base (463)..(463): a, c, t, g, unknown or other
  misc_feature (463)..(463): n is a, c, g, or t
  modified_base (478)..(478): a, c, t, g, unknown or other
  misc_feature (478)..(478): n is a, c, g, or t
tcagcgtagactagcacgaccggtgctcgatttagtagtgtagatttgggtttggggacgtcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgaggtgaaggtctcctcggcaacgggtcttctggtattccgtaacgttttaccctccttaagttagtattcaacgttgggtgaccgcccgaggcccgcgtaggaaccaaccgaccgtggaacgtggagtgggagtcgggaccgaaaccctaanacgtgggtnaccagagttcgtactacaccctgtcccgacgggacagtacctacgatacgaccacgtaacctcccactaactaaaccnccagacccttaacgngttacgggagttggaacgagtcccgtagtaccaacgttcgagaacccggaccgaaccgggtcgtacttacgttactggtaggcgaacggtaccttacccgaggttaaccggtccggagtaacccgcccgtaacggccggaacggtccggttaccctttaggtccttacgggtcggg

SEQ ID NO: 208992 - DNA, 750 bp, Homo sapiens
  misc_feature: GYAE6OF02JNBO3.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccgaggtgcaggctggtgcgagtcgtggggctggaggtagaagacggcccgtggggcctcgaggtggaacggttccgtccgtcggacgaaggtccttcgtaggtactttaccgtaaccgttttaccctaccgttaattacgtacttaccgtaacgttgggtacgaccggccgtacgggtccgacgtacggaccaacggaccgtaggaggtggagtcgggtaagtcgggaccaaacccgttacggacttgggtaccacgtacgtagtaccgtccttaccgcccgtacgtcccgaccggaacacgtacctacaacgttcgaaccgactaaccgtcctaaccgtaactaaaccaccgtactacctaagtacggtacggtacggtacggaacggtctaccgtaagtactacgttcgtaacgaaccggaaccgtacgtcccgttaaccgttattccgtacggacgtagtaacccggaccgttacccgaacggtacggttacgggttaccggaacgtcccggttacgggccgttacccgggtccgggttttaccctaaccgggttacccgttcccggggtaaccggg

SEQ ID NO: 208993 - DNA, 671 bp, Homo sapiens
  misc_feature: GYAE6OF02GWLE0.17.25.C03.1.454.CMB.1.raw
  modified_base (279)..(279): a, c, t, g, unknown or other
  misc_feature (279)..(279): n is a, c, g, or t
  modified_base (292)..(292): a, c, t, g, unknown or other
  misc_feature (292)..(292): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggngcgccaggcccgntggacaacgacctggagtggagtggggatcggggaccgaaaccctaacacgtgggtgtacgacgagttcgtacctttccacccctagtcccgtacccggggacaacggtaccttaccgacgtacgaaccctaaccggtaacccttccctaacccgtaaacttaaaacccgaccaacggtacccctaaacgacgttagggtaacggttaggaagggaccgtccgtaggaacctacgttccgaggtaaccgaccgaccgggtccgttacgtttaagtttaccgtaggtcggaccggtaggtaccctacccggtaacggcggttacccgggtagcggtacccgtaggccacgggtccgtcgtttcggaccgtttcggcgggg

SEQ ID NO: 208994 - DNA, 786 bp, Homo sapiens
  misc_feature: GYAE6OF02FGLZM.17.25.C03.1.454.CMB.1.raw
  modified_base (282)..(282): a, c, t, g, unknown or other
  misc_feature (282)..(282): n is a, c, g, or t
  modified_base (294)..(294): a, c, t, g, unknown or other
  misc_feature (294)..(294): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggggcctcagtgaaggtctcctgcaaggcttctggattcacgtttacctcctatagtatcaacgtgggtncgccaggccgcncggacaaccgtacctgaaggtggacttggggagtcggggaccgaaaccccttaaccgacgttgggtacgtcgaacgtacggttcggttccttccgaaccccgtaacgttccccgtacccggggaaccacggtaaccctttacccgagttaccgaacccgaaccgtaaacctcccctacctaactaaaaaccgaccaaccgtacccttaacgtaacggttcgggtaaacggtttacggaacgggtaccggtacccgttacgggaaaccttaacgttccgttaaccggaaaccgggtaacccggtaaacccggggtaccccgtttaacgtttaaaccgtttacccggttaggttccgtaaccgggtaacggtacccggtaacccccgtacgggtaaccggttacccgggtacgggtaacccgtaccggtacccgggacgtacccgggtacccggtttcccggttttacggtacccgtttccgggtaaccggggg

SEQ ID NO: 208995 - DNA, 685 bp, Homo sapiens
  misc_feature: GYAE6OF02H9AFD.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctcgcctcgtggtgggggtcagagtcaccatccacttcgaccggacaagtcacggtacgttaaaaccttatttaaacgttggtactcgagacaagaaacctggaaaacgccccaagcctctagatctcgtaggtcgacactcccacttcgcgtacgaaggtcgcctacccgagtccggtagttcgaggtcggacgtagtcggtatcggtagggactaagttactttaaccaacgttcctacctaacctactaccctaaccgtccttacgtaccgtaaccgtaaccgttaggaaggttcttagtacgtaaccgttaagttactacgttaacgttcgaaacctaacgtaccgttaacgttaccgtacccgtttccctacggtaccttttaccggtttcggaacccgggttaacgggtaaccctaagggttacgaacgtaaccgtaaaccgtaaaccgtacgttacggtcgtacctacgtaccgtaccttattacccgtagtttaccc

SEQ ID NO: 208996 - DNA, 590 bp, Homo sapiens
  misc_feature: GYAE6OF02F3U5J.17.25.C03.1.454.CMB.1.raw
  modified_base (262)..(262): a, c, t, g, unknown or other
  misc_feature (262)..(262): n is a, c, g, or t
  modified_base (282)..(282): a, c, t, g, unknown or other
  misc_feature (282)..(282): n is a, c, g, or t
  modified_base (293)..(293): a, c, t, g, unknown or other
  misc_feature (293)..(293): n is a, c, g, or t
  modified_base (335)..(335): a, c, t, g, unknown or other
  misc_feature (335)..(335): n is a, c, g, or t
  modified_base (430)..(430): a, c, t, g, unknown or other
  misc_feature (430)..(430): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcgagtgaaggtctcctgcaaggcttctggattcacgtttaccncctatagtatcaactgggtncgccaggccgngtggacaacgacctgagtggatgggatgggaccaaccctaanacgtggtcgtacacagttgtccttcaccccagttcccgacgggacacgtaccttacatcgaccacgaacctcctaccaataaacacacgcctaanagtggagttgagcgcctagacatcgagaccgacaccggtccttacttagttacctggtcgaccgtagtaccgtacccgacggtaacgtcccgggtagaccgtacccgtaccgggctaacgggtcccggttaccttttacggacctttccgggaccggggg

SEQ ID NO: 208997 - DNA, 634 bp, Homo sapiens
  misc_feature: GYAE6OF02G89OZ.17.25.C03.1.454.CMB.1.raw
  modified_base (239)..(239): a, c, t, g, unknown or other
  misc_feature (239)..(239): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgagagctggggcctcagtgaggtctcctgcaaggcttcnggattcacgtttacctcctatagtatcaactgggtgcgccgaggccgctggacaacgcctgagtggatgggatggggaccgaaccctaacactggtgtcacgagtcgtcttacaccctactccgtaccgggacacgtacttaccacgtcgacccaacgacctcctaccaactaaaccacagaccctaactacgtggaaggttcgacgggtaacgcctaggacctagtctacggaccgtaccacccgggtccgtaaccttacgtttaccgtgttacgacggtaacgacccggttacccaccggtaacggttcccgggttacggaccggtcccgttaaccgggaccgtacgggtcccggttacccgtttacggtaaccgtttccgggtacccggggg

SEQ ID NO: 208998 - DNA, 772 bp, Homo sapiens
  misc_feature: GYAE6OF02H1Y3A.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggacctggacctggaggatcctctttcttggtggcagcagctacaagtcgcccactcccaggtgcagtctggtgcagtcgtggggctgaggtgaacgaagccgtggggcctcaggtgaacggtctccgtgacgaaggtcttcgtggtacttcgtaccgttttacctcttaataggtactcaaacgtcggggtgccgccgaacggccgctacggaacaaccggaccgtggaacgtgggacgtgggacgtcggggaccaacccgtaactacgtcggtcgtaccgacgtacgttcgtaccttccaacccctacgtcccgtacggaccaacgtaccttaaccagttaccgaacccgtaacgaaacccttccgtaacctaaactaaaaccactaaacgtaccctaactacggtaggttacggttagggaacgggtacgtaccttaggtaacctaagtaccgttaacgggaaccggaaaccggtcccgggtacccgttaacgtttacgttacgtacggttacgaccggtaacgtaccgtccccggtaaaggtaccccggttaccggggcgtaaccggtacccgggtaccggtaaacccggcggggttacccccggtttacggtttaacccgggtttcccgtttacccggggttaacccgggggg

SEQ ID NO: 208999 - DNA, 663 bp, Homo sapiens
  misc_feature: GYAE6OF02HQG2R.17.25.C03.1.454.CMB.1.raw
  modified_base (284)..(284): a, c, t, g, unknown or other
  misc_feature (284)..(284): n is a, c, g, or t
  modified_base (340)..(340): a, c, t, g, unknown or other
  misc_feature (340)..(340): n is a, c, g, or t
  modified_base (348)..(348): a, c, t, g, unknown or other
  misc_feature (348)..(348): n is a, c, g, or t
  modified_base (585)..(585): a, c, t, g, unknown or other
  misc_feature (585)..(585): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcgtggattcgaccgtttacctcctatagtatcaacgtgggtncgccgaggccgctaggacaacgacctggagtggatgggatgggaccgaaccctaanacgtggtntcacgtaggtctcttcaccctgtccgtccgggactacgtaccgttaccatacgacccaacgaacctcccgtaccaaataaaccactaccgacctacgaacgttagggagtttagggaacgacgggtccctagggaacctatccgaggaaccggacgaacccgggtcgttcctttaaacgtttcgtaggcgtaccggaggtacccgttaccccgtaagggtacgttccccgggggtanaacccgggtcccgtaacgggccgtaagggtccccggttacccggtttttacggtacccgtttccgggtacccgggggg

SEQ ID NO: 209000 - DNA, 729 bp, Homo sapiens
  misc_feature: GYAE6OF02IMK0K.17.25.C03.1.454.CMB.1.raw
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtagaagaagccgtgggcctcagtgaaggtctcctgacgaaggcttctaggtattcctaccgtttacctccttatagtatcaacgtgggtcgcgccgaggccgctggaccaacggacctggaggtggagtggggatcgggaccgaaaccctaacgacgtggtacgtcaacgtggttacgttccgttaccaaccctacgttcccgtaccggggtaacctaacggtaccttaacccgagttaccgaaccctaaccggtaaacccttccctaaccccgtaaataaaaacccgacctaaccggtacccctaactaacggttgggtaacggtttgggtaaacgggaccggtcccgtaggtaccagttaccgtacggaaccgtaccggacccggtaccggttaacttacgttacggtcgttccgggacggtacggtacccgtacccgacggtaccgtacccgggtaggtacccggaccgtaaccgggcgaaccggtccggttaccgtttcggtaccggtttcgggtcccggggg

SEQ ID NO: 209001 - DNA, 655 bp, Homo sapiens
  misc_feature: GYAE6OF02H6H4I.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcgagtggaaggtctccgtgcgaaggtcttcgtggtattctaaccgttttacctacttaacgtagttactactaacgtgggtcgaccgtcgacggcccgcgtacggaacctaaaccgctaggaggtcggagtcggggagtacggggaccaaaaccccgtaacacggtggtacgtacacgtggtcgttaccttaccgaccctacgttcccgtccgggaacacgtacccttacataccgaaccctaacgtacctccctaacctaactaaaccacgtactacccactagtacggtagttaggacgaacgtccaagactacgtcgacgaacgccgaccggtcttactattcggtacgacgcgacgtccgtaccgtaggtacgtccggagaccgtacgtccggtgccggtccgttccgtttaacgtccggttacggacggg

SEQ ID NO: 209002 - DNA, 677 bp, Homo sapiens
  misc_feature: GYAE6OF02IBNFZ.17.25.C03.1.454.CMB.1.raw
  modified_base (276)..(276): a, c, t, g, unknown or other
  misc_feature (276)..(276): n is a, c, g, or t
  modified_base (308)..(308): a, c, t, g, unknown or other
  misc_feature (308)..(308): n is a, c, g, or t
  modified_base (482)..(482): a, c, t, g, unknown or other
  misc_feature (482)..(482): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggagatcctcttcttggtggcagcagctacaagtcgccactccaggtgcagctggtgcagtcgtgggctagaggtggaagagccgtgggcctcgagtgaaggtctccgtgacgaaggtcttcgtagggtactttcgaaccggttttaaccnccgttaagttagttactccgtaacggtgggtnaccggtccgaggcccgtctaggaacctaaacgccgtagacggtggtagtggggactcggggaacctaaccctaatacggtggttacaccagtagttctcgttaccacccgtacgtaccgtccggggaatacgtactaccgatcgaacctaacgtacctaccgtcaaactaaacngtacactacagtcggaagttcggtacggacgccgtagacgtccttagaccgtaaccgacgaccggttccgttaactcgtttaccgtcggtacggacgtaacgtcccgaaccgtcgggttaacctaccgggtacgtaaccgaccgttacgggcgtaccggttccggttccgttaacgttccggttaacggccgggg

SEQ ID NO: 209003 - DNA, 585 bp, Homo sapiens
  misc_feature: GYAE6OF02GCANK.17.25.C03.1.454.CMB.1.raw
  modified_base (307)..(307): a, c, t, g, unknown or other
  misc_feature (307)..(307): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacgttaaaacctatttaaattggtatcagcaagaaacctggaaaacgccccagtacctcctgactctcgtggtcncatccactctgacgaagtcggccgtcccagtccggaggttcaggtggctaggtggatcgtagggacagtatttacaaattctcaaccactacaccactctcgacaccgtagagtattgtgacacttactactactgtacaactagtacgttacgtacgttccctacgtccttaacgttttcggaccgtaacggggtaacctaagttcggtaaggtaactaaccaaacggtaacgtcgttacggaccgtacggtacctaccgtacttccgttagttacc

SEQ ID NO: 209004 - DNA, 666 bp, Homo sapiens
  misc_feature: GYAE6OF02GR7FO.17.25.C03.1.454.CMB.1.raw
  modified_base (283)..(283): a, c, t, g, unknown or other
  misc_feature (283)..(283): n is a, c, g, or t
  modified_base (561)..(561): a, c, t, g, unknown or other
  misc_feature (561)..(561): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtgggcctcgagtgaaggtctctgcaaggcttctggattcacgtttacctcctatagtatcaacgtgggtncgccaggccgcgtggacaacgcctgagtggatggggatcgggacgtaaccctaacgactgggtacgtcacgaggttcgtcctttccgaccctacgtcccgtaccggggaacaacgtaccttaacccgagttacgaaccccaacgtaaacctcccgtaaccctaaataaaacccgaccaacgtacccttaaacgaagttcgggaagtttacggaacggtacgtctcgaaactacgtcgtacggaacccgacgacccgggtccgttacttaatttaccgnggtacgcgtaacgtaccgtacccgtaacggtacgtccgggtagaccggtaccgtacgggacgtacggtcccggttaccgttttaggacccgtttgggtaccgggg

SEQ ID NO: 209005 - DNA, 620 bp, Homo sapiens
  misc_feature: GYAE6OF02H54FA.17.25.C03.1.454.CMB.1.raw
  modified_base (221)..(221): a, c, t, g, unknown or other
  misc_feature (221)..(221): n is a, c, g, or t
  modified_base (300)..(300): a, c, t, g, unknown or other
  misc_feature (300)..(300): n is a, c, g, or t
  modified_base (413)..(413): a, c, t, g, unknown or other
  misc_feature (413)..(413): n is a, c, g, or t
  modified_base (462)..(462): a, c, t, g, unknown or other
  misc_feature (462)..(462): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagccgtggggcctanagtgaaggtctcctgacaaggcttacgtggtattctacgtttacctccgtatagtatcaacgtggtgcgcgacggccgntacggacaaccgaccgtgacgtggatggggatcggggacctaaccgtaacacgttggtacgtcaacgtagtgttactccgaaccctattcccgtccgggatacggtaccctanactacgaccaacgtaacctccctaccaaataaacacacgaccgttaacncgtaggtagttacggacgacgtaccgtagacacttcgtacgaccgaccgacggtcctatacgttaacgtgtacgagtacgtacgtcccgtacgcgtccggtagaccgtacccgtaggaccgacggtccgttcctttaagtaccgttcggtaaccgggg

SEQ ID NO: 209006 - DNA, 655 bp, Homo sapiens
  misc_feature: GYAE6OF02GWJ4G.17.25.C03.1.454.CMB.1.raw
  modified_base (456)..(456): a, c, t, g, unknown or other
  misc_feature (456)..(456): n is a, c, g, or t
  modified_base (470)..(470): a, c, t, g, unknown or other
  misc_feature (470)..(470): n is a, c, g, or t
  modified_base (490)..(490): a, c, t, g, unknown or other
  misc_feature (490)..(490): n is a, c, g, or t
  modified_base (544)..(544): a, c, t, g, unknown or other
  misc_feature (544)..(544): n is a, c, g, or t
tcagcgtagactagcacgaccggtgctcgatttagtagtgtagatttgggtttggggacgtcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtggaagaagccgtggggcctcgagtggaacggtctcctgcgaaggcttcgtggtattcgaacgtttacctcctatagtactcgaactgggtcgcgccaggccgtctggaccaacgacctggagtcggagtgggatcgggacaaaccctaacacgttggacgttacgacgtagtcgtctttacgaccctacgtcccgtacgggacaacggtaccttaccgatcgtaccacgtaaactcccgtaacaactaaaccncgaacgtccttaanacgtggagttacgaggtacnccttagactagtctaagaccgacgaccgtccgttactaagttaccgtggtacgnggtaaccgaccgttcccgaacgaaccggttccgggtaacgaccgtaacccgggttccgaccggtacggacccggtttccggttttacgacccgtttgggtaacccgggggg

SEQ ID NO: 209007 - DNA, 851 bp, Homo sapiens
  misc_feature: GYAE6OF02I4349.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtagaagaagccgtgggcctcgagtgaaggtctccgtgacaaggtcttcgtggtacttccgaccgttttaccctaccttaattacgttataccgtaaacgttggggtacgccgacccggacggtcccgtcgtacggggaacccaaccggtaccgtagggtaacgggtacgggtaaggttcgggggtaagggttacccgggggaacccgttaaaacccccgtaaaaccgtaccggttaggggttaccgtaccgaaccgtaggttcgttacccttacccaacccccgtacgttcccggtacccggggaaccctaacggtaaccctttaaccgagttacccggaacccgtaaacccgtaaccctccccttaaaccaaacgttaaaaccacccgtaacgtacccttaaactacggttacgggttaacggttacggaacgggtcctaccgttaaccggaacttacgttaccggtacggaacccgtaaccgcccgggttaacccgttacgtttaactttaaccggttggtaccgacggtaccggttaccgtaccccgaaggtacccggttccggtaacggaacccggttacccggtaggtacccggtacggttacccgggttccttttaaccggtccggttccgggtacccggggg

SEQ ID NO: 209008 - DNA, 710 bp, Homo sapiens
  misc_feature: GYAE6OF02JSXWI.17.25.C03.1.454.CMB.1.raw
  modified_base (276)..(276): a, c, t, g, unknown or other
  misc_feature (276)..(276): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctggggcctcagtgagtctcctgcaagcttctggattcacgtttacctcctatagtatcaacgtgggtntccgccaggcctcgtcggacaacgcctggagtggaagtgggatcggggaccgtaacccgtaataccgtgggtacgtaccgaacgtcgttcggtaccttaccaccccgtaagttcccgtaccggggaactacgtaaccgtttacccgaattccggaaccctaacggtaacccttacccgtaccgtaaacctaaaaccaccgtaaccggtacccttaacgacgttacgggtaacgtttacgggaacggtacgtcccgttagaccgttaactccgtaggaacccgtacggaccgggttacccgttacttaacgttaaccggttcgtacggaccgtaaacgccgttacccgaaccggttcgtacccggttaggacccgtacccgtacggccgtacggtacccggttccgtttaccggtaccgtttccggtacccgggg

SEQ ID NO: 209009 - DNA, 660 bp, Homo sapiens
  misc_feature: GYAE6OF02HSGDI.17.25.C03.1.454.CMB.1.raw
  modified_base (281)..(281): a, c, t, g, unknown or other
  misc_feature (281)..(281): n is a, c, g, or t
  modified_base (623)..(623): a, c, t, g, unknown or other
  misc_feature (623)..(623): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagctggggcctcagtgaaggtctcctgcaaggcttctggattcacgtttacctcctatagtatcaacgtgggtncgcaggccgctggacaacgacctggagtgggatggggatgggggaccaaaccctaacgacgtggtgtaccagtaggtcgtacttacccaccctaactcccggtacccgggaacaacggtaccttaacccgagtaccgaacccaacgtaaccctaccctaccgaaataaaaccacgacgtacctaacgagtacggtaggttacgaacgggaactcccgtaagtaaccctacgttacggtcgaaacccgggtaacgtacccggggtcccgttaaccgttaactttacgtggtacgtaccgagtaccgtaccccgaaggcgttccggtagacgcccggtaccggnacgggtccggtcctttacggcgtttccggtacggggg

SEQ ID NO: 209010 - DNA, 672 bp, Homo sapiens
  misc_feature: GYAE6OF02GQ5CZ.17.25.C03.1.454.CMB.1.raw
  modified_base (244)..(244): a, c, t, g, unknown or other
  misc_feature (244)..(244): n is a, c, g, or t
  modified_base (281)..(281): a, c, t, g, unknown or other
  misc_feature (281)..(281): n is a, c, g, or t
  modified_base (337)..(337): a, c, t, g, unknown or other
  misc_feature (337)..(337): n is a, c, g, or t
  modified_base (568)..(568): a, c, t, g, unknown or other
  misc_feature (568)..(568): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcnggtattcacgtttacctctatagttatcaactgggtncgtccaggccgctggacaacgacctgacgtggatgggatcgggacgaacccctaanaccgtggtcgtcaacgtagttgtaccgttccaaccctagtcccgtaccggggaactacggtaaccttaacccgatacgaacccaaccgaaacccttcccgtaccaaactaaaaccaccaggtacccctacaagtcgggtaacgtttggaacggtacgcccgttaaggaccctaagttcccggtagaaaccgggaccctaacggggtaccctttcttaaacgttttaccggnggttacgaccggaacgtaccgtaccccgacggtaccgttccgggtagaccgtacccgtacgggtcacggtacccggtcctttacggtaccttcggtaccggggg

SEQ ID NO: 209011 - DNA, 609 bp, Homo sapiens
  misc_feature: GYAE6OF02G49O9.17.25.C03.1.454.CMB.1.raw
  modified_base (292)..(292): a, c, t, g, unknown or other
  misc_feature (292)..(292): n is a, c, g, or t
  modified_base (367)..(367): a, c, t, g, unknown or other
  misc_feature (367)..(367): n is a, c, g, or t
  modified_base (446)..(446): a, c, t, g, unknown or other
  misc_feature (446)..(446): n is a, c, g, or t
  modified_base (457)..(457): a, c, t, g, unknown or other
  misc_feature (457)..(457): n is a, c, g, or t
  modified_base (482)..(482): a, c, t, g, unknown or other
  misc_feature (482)..(482): n is a, c, g, or t
  modified_base (516)..(516): a, c, t, g, unknown or other
  misc_feature (516)..(516): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctgagtgaaggtcctcctgcgaaggcttcgtggtattccgtacgtttaccctcctaatagtatcaacgtgggtncgccaggccgacgtggacaacgacctggacggtggatggggatcggggacaaaccctaacgacgtggtctacacngttgtccttacaccctacgtcccgtaccgggaacacgtaccttaccactcgacccacgaccctcctaccaactaaaccncaacgacctanagtggtagtgacggcgaccgtgacnttcgacgaaccgacgaccggtccgtactattcgngtcgacgaggtaccgtcccacggacgtccggtagccggtacccgtacgggctacgggtccggttaccgtttacggtaccgttccggaccgggg

SEQ ID NO: 209012 - DNA, 605 bp, Homo sapiens
  misc_feature: GYAE6OF02GFJK9.17.25.C03.1.454.CMB.1.raw
  modified_base (184)..(184): a, c, t, g, unknown or other
  misc_feature (184)..(184): n is a, c, g, or t
  modified_base (339)..(339): a, c, t, g, unknown or other
  misc_feature (339)..(339): n is a, c, g, or t
  modified_base (502)..(502): a, c, t, g, unknown or other
  misc_feature (502)..(502): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtncagtctggggctgaggtgaagagcctgggcctcagtgaaggtctcctgcaggcttcgtggattcacgtttaccctcctatagtactcaactgggtgcgccaggcccgcgtggaccaacgacctgaggtggatgggatcgggacgtaacccctaanacgtggtcgtacacgacggtcgttcttaccgaccctagtcccgtccggggacacgtaccttaccacgtcgaacccacgtaacctcctaccaactaaacacacgtaccctacacgtaggacgttggacggtacgcctagacactcgtagacacgtacgccgttnttaacttacgtgtacgtcgagtcgtacccgaggtacgttccgggtacacggtacccgtacgggctacgggtcccggtacttttacggaccgttggtcccgggg

SEQ ID NO: 209013 - DNA, 647 bp, Homo sapiens
  misc_feature: GYAE6OF02H4F11.17.25.C03.1.454.CMB.1.raw
  modified_base (241)..(241): a, c, t, g, unknown or other
  misc_feature (241)..(241): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggagatcctcttcttggtggcagcagctacaagtgcccactcccaggtgcagctggtgcagtctggggctgaggtgaagagcctggggcctcagtgaaggtctcctgcaggcttcnggattcacgtttacctcctatagtatacaactgggtgcgccaggccgctggacaacgaccgtgagtggatggggatgggccgaacctaacgacgtggtcgtcaacgtagtcgtccttaccacccaacgttcccgtaccggggacaacgtaccttaaccgataccgaccaaccggtaaccctaccctaccaactaaaacccacaacgtccctaactacgtaggtacgttaggaacggtcgccctagacattcgacggacccgacgacggtcccgttattacgtttacgtcgtcgacggtacgaccggttaccccgaacggtccggttaccggtggaacccgttcccggaacggcctaccggggtcccggttaccgttttaccggtaccgtttccgggtaaccggggg

SEQ ID NO: 209014 - DNA, 720 bp, Homo sapiens
  misc_feature: GYAE6OF02JZ35D.17.25.C03.1.454.CMB.1.raw
  modified_base (179)..(179): a, c, t, g, unknown or other
  misc_feature (179)..(179): n is a, c, g, or t
  modified_base (193)..(193): a, c, t, g, unknown or other
  misc_feature (193)..(193): n is a, c, g, or t
  modified_base (356)..(356): a, c, t, g, unknown or other
  misc_feature (356)..(356): n is a, c, g, or t
  modified_base (450)..(450): a, c, t, g, unknown or other
  misc_feature (450)..(450): n is a, c, g, or t
tcagcgtagactagcacgaccggtgctcgatttagtagtgtagatttgggtttggggtacgtcaacaaccacatctgtcctctagagaaaccctagtgagcacagctcctcaccatgactggacctggaggatcctcttcttggtggcagcagctacaagtgcccacctccctagggcncagctcgggtgacnggtcgtggggctaggaggtgaaggaacgccgtcgggggcctacaggtggaaaggtcctcctcggacaagggtccttacgtggaatttaccgaccgttttaacctccttaatacgttaatcctaacgtgggtcgacgccgagcccgtgtcggacctaacgaccngtcggtacggagtgggtagtacggggacctaacccgtaaactaccgtgggttccactacgtagtcgtacttaccacccgcttaccgccgggaanacggtactaccacgtacgaacccaccgaaccgtccctacctaacaaacctacgaactaccctaacacgttaggacggttacggacgacgtaccgacgtacgaccttacgtacggaaccgtcgaacccggtccgtacttacgttaaccgtcgtaacgacgtacgtactacccggtaccgtacgtacccgggttagacccgggtaaccggtccggtaccggtaccggtcccgggttaaccggttccgttaccggttcccgggtaacccgggg

SEQ ID NO: 209015 - DNA, 564 bp, Homo sapiens
  misc_feature: GYAE6OF02IQ5DI.17.25.C03.1.454.CMB.1.raw
  modified_base (279)..(279): a, c, t, g, unknown or other
  misc_feature (279)..(279): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatctcttcttggtggcagcagctacaagtgcccactcccaggtgcagctggtgcagtctggggctgaggtgaagaagcctggggcctcgagtgaaggtctcctgcaaggctctggattcacgtttacctcctatagtatcaactgggtncgccaggccgctggacaacgacctgagtggatggggatgggcgaaccctaacacgtggtgtcacagtgtccttcacccatcccgtccgggacagtaccttaccatcgacccacgaacctccctaccaataaaccacacgcctaacagtggagttaggaggacgcctagacatcagaccgacaccgggtcctctacttacgtgtaggcgagtacgtacccacggtcgtcccgggtgacgcccgttacggcgtacggccggtccctttggtaccttccggtacgggg

SEQ ID NO: 209016 - DNA, 548 bp, Homo sapiens
  misc_feature: GYAE6OF02INW3F.17.25.C03.1.454.CMB.1.raw
  modified_base (221)..(221): a, c, t, g, unknown or other
  misc_feature (221)..(221): n is a, c, g, or t
  modified_base (292)..(292): a, c, t, g, unknown or other
  misc_feature (292)..(292): n is a, c, g, or t
  modified_base (340)..(340): a, c, t, g, unknown or other
  misc_feature (340)..(340): n is a, c, g, or t
  modified_base (352)..(352): a, c, t, g, unknown or other
  misc_feature (352)..(352): n is a, c, g, or t
  modified_base (433)..(433): a, c, t, g, unknown or other
  misc_feature (433)..(433): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcngtgaaggtctcctgcaagggcttctggattcacgtttacctcctatagtatcaactgggtgcgccaggccncgtggacaacggacctggagtgggatggggatggggccgaaccctaanacgtgtgtcaanagtgtctcaccctatccgtaccggacagacttaccatcgacacgaactccacactaacacagccacatggagttagaggancctgacatcgtgaacgcaccggtccttctacttctgtacgtcgaagtacgtacccacggtctaccggtgacgtaccgtacggacgtcggcggtcctttacgacttcgtaccgggg

SEQ ID NO: 209017 - DNA, 744 bp, Homo sapiens
  misc_feature: GYAE6OF02HY8UP.17.25.C03.1.454.CMB.1.raw
  modified_base (276)..(276): a, c, t, g, unknown or other
  misc_feature (276)..(276): n is a, c, g, or t
tcagcgtagactagcacgaccggtgctcgatttagtagtgtagatttgggtttgggactcaacaaccacatctgtcctctagagaaaaccctgtgagcacagctccctcaccatgactggacctggagatcctcttctggtgcagcagctacaagtgcccactcccgaggtgcagctggtgcagtctgggctggaggtagaagacgccgtgggcctcgagtgaacggtctccgtgcgaggcttcgtgtacttcgtaccgttacctactatagttanaccgtaacgttgggtacgcgccacggtccgcgtaggaaccaacgtacctggaacggtggagttacgggggacgttacggggaaccctaaaccccgtaacggtacgtttcgggtacgtaccgacgtacggtttcgttccttacgaccttaccgtaccgtacccggttaccgggaaccggttacccttaaaccgtacgtccgtaaaccgtaaccgtaccccgtaccttaacccaaacgtaaaaccgactaccgtaaccctacgtaaggtacggtagttacggacggtaccgtaccgtacgaccgtagttaccgacggaaccgtaaccgtcccggtaccgttacgttaacgttaccgttcggtacgaccgtaaccggtaccgtacccgaccgggtacgttcccggtagccggtaacccggtaccgacggttcggtaccggttaccgttttaggaccccgttgggtaccggg

SEQ ID NO: 209018 - DNA, 661 bp, Homo sapiens
  misc_feature: GYAE6OF02IGT66.17.25.C03.1.454.CMB.1.raw
  modified_base (190)..(190): a, c, t, g, unknown or other
  misc_feature (190)..(190): n is a, c, g, or t
  modified_base (289)..(289): a, c, t, g, unknown or other
  misc_feature (289)..(289): n is a, c, g, or t
  modified_base (484)..(484): a, c, t, g, unknown or other
  misc_feature (484)..(484): n is a, c, g, or t
tcagcgtagactagcacgaccggtgctcgatttagtagtgtagatttgggtttggggacgtcaacaaccacatctgtcctctagagaaaaccctgtgagcacagctcctcaccatggactggacctggaggatcctcttcttggtggcagcagctacaagtgcccactcccaggtgcagctggtgcagtntgggctggaggtgaagaagccgtggggcctcaggtgaaggtctccgtgcaaggcttcgtggattcgacgtttacctccgttatacgtatcaacgtgggncgcaggccgctggaacaaccgactggagtggagtcgggagtgggaccgtaaaccctaacgacgttgggtgtaccgaacgagttcgtacttccaaccctacgttccgtaccgggactaacgaccttaccagtcgaccaacgactccctacgaaataaccactacgcctaagcgtggtacgttagaggactcccgtnaccattacgacgacgaccgtaccggtccgtacttaacgtacgtttgacggtacgaacgggtacccttacccggtacgtaccggttacccggggtacgaccggtacccgttaacgggggacccacgggtacccgggtttcccgttttaaacgcccgggttttaaccgtccccgggggg

SEQ ID NO: 209019 - DNA, 568 bp, Homo sapiens
  misc_feature: GYAE6OF02FTSXI.17.25.C03.1.454.CMB.1.raw
  modified_base (339)..(339): a, c, t, g, unknown or other
  misc_feature (339)..(339): n is a, c, g, or t
  modified_base (346)..(346): a, c, t, g, unknown or other
  misc_feature (346)..(346): n is a, c, g, or t
tcagcgtagactagcacgaccggtgctcgatttagtagtgtagatttggggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcgagtgaaggtctcctgcaagggcttctggattcacgtttacctcctatagtatcaacgtgggtgcgccaggccgctggacaacgaccgtgagtggagtgggatggggacgaaccctaancgtggtntcgacagtgtcttcaccctatcccgaccgggtacagtaccttaccatcgaccacgtaacctccctaccataacacacgcctacatggagttgagagctagactagtctagacgacacggtccgttctaacttcgtgtagtcgagtacgtcccgaggtacgtccggtggaccgccgtaccggacacgggtaccggtcccgtttggtacccgttggtaccgggg

SEQ ID NO: 209020 - DNA, 595 bp, Homo sapiens
  misc_feature: GYAE6OF02FJH76.17.25.C03.1.454.CMB.1.raw
  modified_base (316)..(316): a, c, t, g, unknown or other
  misc_feature (316)..(316): n is a, c, g, or t
  modified_base (341)..(341): a, c, t, g, unknown or other
  misc_feature (341)..(341): n is a, c, g, or t
  modified_base (345)..(345): a, c, t, g, unknown or other
  misc_feature (345)..(345): n is a, c, g, or t
  modified_base (431)..(431): a, c, t, g, unknown or other
  misc_feature (431)..(431): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctcctgcaggtcttcgtggattcacgtttacctcctatagtatcaactgggtgcgccaggccgcgtggacaacgcctgagtggangggatgggccaacctacacgtggtntcanagtgtcttccacccatcccgtccgggaactacgtaccttaccagtcgaccacgaacctcctaccaactaaaccacacgaccctaanagtaggtagttggaaggacgcctagactacgtctacgaccgacgaccggtccgttacgttaacttcgttgtcgacgtagtacccgtacccacggtaacgtccgggtacgaccgacccgtacgggcacgggtccggtaccgttttcgtaccgttccggtacgggg

SEQ ID NO: 209021 - DNA, 672 bp, Homo sapiens
  misc_feature: GYAE6OF02IYUA6.17.25.C03.1.454.CMB.1.raw
  modified_base (279)..(279): a, c, t, g, unknown or other
  misc_feature (279)..(279): n is a, c, g, or t
  modified_base (290)..(290): a, c, t, g, unknown or other
  misc_feature (290)..(290): n is a, c, g, or t
  modified_base (337)..(337): a, c, t, g, unknown or other
  misc_feature (337)..(337): n is a, c, g, or t
  modified_base (422)..(422): a, c, t, g, unknown or other
  misc_feature (422)..(422): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtncgccaggccgntggacaacgacctgagtggatgggatgggacaacctaacacgtggtncacgagtcgtcttacacccatccgaccgggacacgtaccttaccagtacgaccctaacgaacccttccctaccaaactaaaaccncctaacgacccttaacagtacgggtaacgtttggaacgggtacacccttagaacctacttccgtacggaaccgaacccgaccggggtaccctttacttaaagtttaccgtcggttacgggaacgtaccgtacccggtttccccgaaacggtaccggtttaccccgggtggaaacccggtcccgttaacggggcccgtaacgggcccggttaacccgtttttacggacccggtttccggtaaccggggggg

SEQ ID NO: 209022 - DNA, 606 bp, Homo sapiens
  misc_feature: GYAE6OF02ICP3C.17.25.C03.1.454.CMB.1.raw
  modified_base (316)..(316): a, c, t, g, unknown or other
  misc_feature (316)..(316): n is a, c, g, or t
  modified_base (322)..(322): a, c, t, g, unknown or other
  misc_feature (322)..(322): n is a, c, g, or t
  modified_base (343)..(343): a, c, t, g, unknown or other
  misc_feature (343)..(343): n is a, c, g, or t
  modified_base (363)..(363): a, c, t, g, unknown or other
  misc_feature (363)..(363): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctcctgtctgcctctggtggggtcagagtcacatcacttggaccggacaagtcgaacggtacgttaaaacctatttaaaagttggtaactcgaagcaacgtaaacctggaaaaccgccccaagccttctgtactcctcgtgtcncatccntctgacgagtcgctccatcgngtcagtcgctgtgcgttcgnggactagtatttacaactcgtaccaacctatcccacctacgttctacactaccgtagacgtagtttgacgtactacttcgttaactagttacaccgtaaatcggttaacttaccgtaccgttcccctacgttcttaccggttacggaccgggtaacgggtaacccgtaagttcggtaacaccgttaaccaaacgtcgttaggaccgtcgtacgacccgtaacctacgttcccgtagttacccg

SEQ ID NO: 209023 - DNA, 661 bp, Homo sapiens
  misc_feature: GYAE6OF02FTVZA.17.25.C03.1.454.CMB.1.raw
  modified_base (248)..(248): a, c, t, g, unknown or other
  misc_feature (248)..(248): n is a, c, g, or t
  modified_base (288)..(288): a, c, t, g, unknown or other
  misc_feature (288)..(288): n is a, c, g, or t
  modified_base (299)..(299): a, c, t, g, unknown or other
  misc_feature (299)..(299): n is a, c, g, or t
  modified_base (314)..(314): a, c, t, g, unknown or other
  misc_feature (314)..(314): n is a, c, g, or t
  modified_base (316)..(316): a, c, t, g, unknown or other
  misc_feature (316)..(316): n is a, c, g, or t
  modified_base (319)..(319): a, c, t, g, unknown or other
  misc_feature (319)..(319): n is a, c, g, or t
  modified_base (321)..(321): a, c, t, g, unknown or other
  misc_feature (321)..(321): n is a, c, g, or t
  modified_base (324)..(324): a, c, t, g, unknown or other
  misc_feature (324)..(324): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccgaggtgcagctggtcgcagtcgtgggctggaggtgaagacgccgtgggcctcgagtgagtctcgtgacgagtcttcgnggtacttcgacgtttaccctcgtatagtatcaacgtggtnccgcaggccgngtggacacgccgtgngnggngnggngtcggaccaaccctaagtcgtggtcgcacgagtcttctccacctacgtcccggtaccgggtacaacggtaccttaccgaagttcccggaacctaaccgtaacccttcccctaacccgtaaactaaaccctaccgaaccgtaccttaaaccgacggtacggttaacgtttaacgggagggaccgtacccgtagacctaacgttctacgggaaaccacggacccgttacgtacctttacgtaccttggacgtcgacgtaccgtacccacggtacgtccggtacaaccgtccgtaacggcgacgtccgggttcctttacggtccgttacgggtcccgggg

SEQ ID NO: 209024 - DNA, 697 bp, Homo sapiens
  misc_feature: GYAE6OF02GL4M7.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaaggtctcctgcaaggcttcgtggtattcacgtttaccctccttatagtatcaacgtgggtgcgccagggccgcgtggaccgaacgaccgtgaggtggagtggggagtcgggaccgaacccgtaacgacgtggtgtacacgtaggtcgtccttaccacccactcccgtaccgggaactacggtaccttaccgatacgaacccaaccgtaacctaccctacaaactaaaccacaacgtaccctaacagtagggtagttaggaacggtacgtaccctaggacctacgtcgtaacggaaccggtaaccgtacccgggtcccgttaactttaactttaacgtgggtaacgaccggtaaggtacccgttacccgtacgggtaaccggttcccgggacggtacccggtacccggttaaccggacggtaccggtccccggttaccgttttacggttacccgtttcgggtacccgggggg

SEQ ID NO: 209025 - DNA, 590 bp, Homo sapiens
  misc_feature: GYAE6OF02G98LO.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcagtgaaggtctcctgcaaggcttctggattcacgtttacctctatagtatcaactgggtgcgccaggccgctggacaacgacctgagtggagtgggatgggcgaaccctaacacgtggtgtcacagtcgtcttcacccactccgtcgggacacgtacttaccatacgaccacgaacctcctaccaactaaaccacacgtaccctaactacgtagggtacgttggaaggtacggcctacgaaccattcgtacggaccgaaccgacgggtcccgtacttacgttactgtacgcgtacgcgtacccacggtcgtccgggtcgacggtcccgtacggcgacggccggttccgtttcgtaccgttcggtccggggg

SEQ ID NO: 209026 - DNA, 646 bp, Homo sapiens
  misc_feature: GYAE6OF02IJV5Y.17.25.C03.1.454.CMB.1.raw
  modified_base (215)..(215): a, c, t, g, unknown or other
  misc_feature (215)..(215): n is a, c, g, or t
  modified_base (236)..(236): a, c, t, g, unknown or other
  misc_feature (236)..(236): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagctgggcctnagtgaagtctcctgcaggctntgattctacgttacctcctatagtatcaacgtggtcgcgccgacggccgcgtcggaccaaccgaccgtggagtgggtagtggggacgtcgggaccgaacccgttttttaacgacgtggtcgtacgacgagtcgtcgttaccacccactaccgtccggacgtacgtaacctacctactcgaccgacgtaacctaccctaccaactaacacgacgacctacacgtaggtacgttagacggacgtcctacgacgtatcgtagaccgtacgaccggtaccgtacgttacgttacgtcgtacgaccgtacggtaccgtacccgtaccggtaccgttaccgggtacggtaccgtacccggtaccggtaccggtacggtacccggttcccgtttacgtacccggttcggtaccgggg

SEQ ID NO: 209027 - DNA, 804 bp, Homo sapiens
  misc_feature: GYAE6OF02GRI54.17.25.C03.1.454.CMB.1.raw
  modified_base (281)..(281): a, c, t, g, unknown or other
  misc_feature (281)..(281): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgagatgaagaagccgtggggcctcagtgaaggtctcctgcaaggcttctggattcacgtttacctctatagtatcaacgtgggtcncgcacggccgcgtggaacaacgacctgagtggagtgggacgtgggaccgtaaccctaacgacgtggtcgtacacgtaggtcgtacctttccaacccgtacgtcccgtacccggggtaactacggtaacctttaaccacgttaccggaaacccgtaacccggtaaaccccttccccgtaaaccctaaaacgttaaaaaacccaccgtaaaccgtacccccgttaaaaccgacgggttaaggggttaacggttttaacgggaaacggggtaaccggtcccgttaacggaaacccgtaacgtttacccggtaacggaaaccccggtaaccggtaaacccgggtccccggtttaacgttaaaccgtttaaccggttggttaacgggaccggtaacgggtaccgttaacccccggaacggtaacccggtttacccggggtaggtaacccggtcccggttaaccggggacccggtaaccgggttacccgggtttaccccggtttttaggtacccgttttccccgggggg

SEQ ID NO: 209028 - DNA, 672 bp, Homo sapiens
  misc_feature: GYAE6OF02HYKPS.17.25.C03.1.454.CMB.1.raw
  modified_base (618)..(618): a, c, t, g, unknown or other
  misc_feature (618)..(618): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgaggtgaaggtctccgtgcaagggtcttcgtggtattcaccgtttactcctatagtatcaacgtgggtcgcgccgtaggccgtcgtaggaaccaaccggtacctgacggtggaacgtggggtatcggggacctaaaccctaacgcgtcggtgtacacgtagttacgtcttaccacccgtagtcccgtaccgggaactagtaccttacacgtacgaacccaacgtacctcccgtactaaataaaccgactaccgtaccaacgtcgtagggaacgttggaacgggactcccgttaggaacctacgttacgacggtaaccgacggtacccggtccggttacttaagttccgtaggacgacggtaacggtaccgtacccgtaggtaaccggtccgggtanaccggtaccgacgtcggccgtacggttcccgtttagacccgttgggtacccggg

SEQ ID NO: 209029 - DNA, 700 bp, Homo sapiens
  misc_feature: GYAE6OF02I3T70.17.25.C03.1.454.CMB.1.raw
tcagcgtagactagcacgaccggtgctcgatttagtagtgtagatttgggtttggggactcaacaaccacatctgtcctctagaagaaaaccctgtgagcacagctcctcaccatggactggacctggaggactccttctttcgttggtggcagcagctacaagtgcccactcccaggtgcagctggtgcagtcgtgggctgaggtgaagagccgtgggcctcgagtagaggtcctcctgacgtaaggtcttgtgtacttctaccgtttacctctaagtagtactacgaacgttgggtgccgaccgacggccgtcgtacggaacctaaccgtccgtggaggtggaagtcgggaacggtcgggaacccgtaaacccgtaacgtacggtaggttctacgtaacgtacgttacgttccttaccgacctacgtcccggtacggactacgtaccgttacacgttacgaccgaacgtaacctacctacctaactaaaccgtaccgaaccgtacctactacgtacggtacgttaggaggtacctcgtacgtactacgttacgtacggaaccgaccgtaccggtccttacgttacgttcgtggttacgacgtacgtaccgtacccgtacggtaccgtaccggtacgaacccggtacgtaccgacggtacggtcccggttaccgtttacgtaccggttcggtaccgggg

SEQ ID NO: 209030 - DNA, 656 bp, Homo sapiens
  misc_feature: GYAE6OF02JOH49.17.25.C03.1.454.CMB.1.raw
  modified_base (192)..(192): a, c, t, g, unknown or other
  misc_feature (192)..(192): n is a, c, g, or t
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
  modified_base (252)..(252): a, c, t, g, unknown or other
  misc_feature (252)..(252): n is a, c, g, or t
tcagcgtagactagcacgaccggtgctcgatttagtagtgtagatttgggtttggggacgtcaacaaccacatctgtcctctagagaaaaccctgtgagcacagctcctcaccatggactggacctggaggatcctcttcttggtggcagcagctacaagtgcccactcccaggtgcagctggtgcagtcgnggggctggnggtgaagaagccgtggggcctnaggtgaacggtctccgtgcaaggcttcgngtactctacgtttacctcctattagtatctaacgtggtcgcgcctaggccgcgtggacaaccggccgtagacgtggagtgggtagtcggggacgtaacccgtaactacgttggtcgtcagtacgtcgttccttaccacccacgtaccctcgggaaccacgtaaccttacctacgtacgaccgaccgactaccctactaacctaaaccacgtaacacctactacgtacggtaggttaggacggtacgtaccgtacgaccagttcgtacgaaccgtaccgaccggtccgtacttaccgttactggtcgacggagaccgtacccacggtacggttcggtacgaacgttccggacgtaccggtaccggaccgggttccctttacggtacgtttcccgggtaaccgggg

SEQ ID NO: 209031 - DNA, 552 bp, Homo sapiens
  misc_feature: GYAE6OF02GHQ0R.17.25.C03.1.454.CMB.1.raw
  modified_base (328)..(328): a, c, t, g, unknown or other
  misc_feature (328)..(328): n is a, c, g, or t
  modified_base (432)..(432): a, c, t, g, unknown or other
  misc_feature (432)..(432): n is a, c, g, or t
  modified_base (439)..(439): a, c, t, g, unknown or other
  misc_feature (439)..(439): n is a, c, g, or t
  modified_base (442)..(442): a, c, t, g, unknown or other
  misc_feature (442)..(442): n is a, c, g, or t
  modified_base (450)..(450): a, c, t, g, unknown or other
  misc_feature (450)..(450): n is a, c, g, or t
  modified_base (458)..(458): a, c, t, g, unknown or other
  misc_feature (458)..(458): n is a, c, g, or t
  modified_base (541)..(541): a, c, t, g, unknown or other
  misc_feature (541)..(541): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtacccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgcctgagtggatgggatgggcaaccctanactggtgtcacagtgtcttcaccctatcccgtccgggacagtacttaccatcgaccacgaacctcctccaaataaaccacacgccctacactgggattgaggcncctgacntcngaacgacnccggcctnttattcgtgtcgacgagacgtcccagtacgtccgggagacgtcccgtacggcctacggccggttcctttaggacctttccggnggggtacccgg

SEQ ID NO: 209032 - DNA, 627 bp, Homo sapiens
  misc_feature: GYAE6OF02JEIAN.17.25.C03.1.454.CMB.1.raw
  modified_base (242)..(242): a, c, t, g, unknown or other
  misc_feature (242)..(242): n is a, c, g, or t
  modified_base (260)..(260): a, c, t, g, unknown or other
  misc_feature (260)..(260): n is a, c, g, or t
  modified_base (472)..(472): a, c, t, g, unknown or other
  misc_feature (472)..(472): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtcgcagctggtgcagtcgtgggctgaggtgaagaagcctggggcctcgagtgaagtctcctgcaggctntggtattcacgtttaccnctatagtatcaacgtggtgccgccaggccgtctggaccaacggacctggagtcggatgggagtcgggactaaccctaagtacgtggtcgtccacgtagttacgtcttaccaccctagtcccgtaccgggacacgtaccttaccagtcgaaccacgaacctccctacaaataaacacaacgcccttagacgtaggtagttacggacgggtacncccgtagtaccattaccgtacgtaaccgacgtaccggtccgttacttacgttaccgtgacgtaacgagtaccgtacccgagtaccggttccggtagaccgtaccgtaaccggcgacggttcccgttaccttttcggacccgtttcggtaccgggg

SEQ ID NO: 209033 - DNA, 734 bp, Homo sapiens
  misc_feature: GYAE6OF02H19HW.17.25.C03.1.454.CMB.1.raw
  modified_base (289)..(289): a, c, t, g, unknown or other
  misc_feature (289)..(289): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacgaagtgcccactcccaggtgcagctggtgcagtcgtggggctgaggtgaagagccgtggggcctcaggtgaacggtcgcctgacaggcttcgtggacttcacgtttacctctatagtactcaacgttgggtcncgcgtacgccgtcgtggaaccaaccggacctggagttcggagtaggggtatacggggaccgtaaaccccgtaacaccggttggggtttacacgaaccgtaggttacgttctttaccgacccctaacgttcccgggcccgggaaataccgtaaccgttacccagttacccggaaccgtaacgacccttccctaaccgtaaactaaacaacctcgaccgtaacctaggtacggtaacggttggaacgggtataccgtgtaactaccgtcgtaacggtaacccgacggtacccgggttaacctccgttttaacgttaaccgtcgtacggtaaccgacggtaccgtacccgtaacgggtaccgttacccggtcgggtaacctccccggttacgggaccgtaccgggtccggtttaccccgtttaggtaccgttttaccgggaccggggg

SEQ ID NO: 209034 - DNA, 636 bp, Homo sapiens
  misc_feature: GYAE6OF02GEF67.17.25.C03.1.454.CMB.1.raw
  modified_base (280)..(280): a, c, t, g, unknown or other
  misc_feature (280)..(280): n is a, c, g, or t
  modified_base (430)..(430): a, c, t, g, unknown or other
  misc_feature (430)..(430): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcgaaggcttctggattcacgtttacctctatagtatcaactgggtncgccaggccgctggacaacgacctgagtggatgggatcgggacgaaaccctaagacctgggtcgtcacgtagtgtccttccacccatcccgtccgggaacagtaaccttaccgactcgaacccacgtaaccctcctaccaagtaaaaccnctacgtacctactatgggtaattacgggaaggacgtcctagaacctagtctacggtaaccgacgtacccgggcccgttactaactttccgtggtccggaaccgttaggaccgtccccgaacggtaacgttcccggggttcgaacggttacccggtaccggcgtaaccggtcccgggttcctttacgaccggtttccggtacggggg

SEQ ID NO: 209035 - DNA, 582 bp, Homo sapiens
  misc_feature: GYAE6OF02H74RW.17.25.C03.1.454.CMB.1.raw
  modified_base (301)..(301): a, c, t, g, unknown or other
  misc_feature (301)..(301): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaacctatttaaattggtatcagcaagaaacctggaaaacgccccagacctcctgatctcgtggtncatccactctgcgaagtcggctccagtcgaggttcagtggcaggtgatcgtagggacaggtatttacaattctacaccatccacctactctcgaccaacctggagtacgttgtacgctaacttctaactactcgtacgaactagtacgttaccgtaccgtttacccctgtaccttacgtttcggaccgtaacggggtaacctaagggtttcgaacgtaacgtaaccgaaacggtacgtaggtacgacgttacgaccgtaacctacgttcgtacgttacccg

SEQ ID NO: 209036 - DNA, 693 bp, Homo sapiens
  misc_feature: GYAE6OF02JDHPZ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtcgctagtcgtgggctgaggtgaagagcgtgggcctcgagtgaaggtctccgtagcgaggctcgtggtacttctaccgtttacctacctagtagtactacgaacgtggtgccgcgtacggccgtcgtaggaactaacgaccgtggaggtggtaagtgggaacgtcgggacccgtaaccctaacgtacgtgggtactacgtaacgcgttacggttccttaccacccgtaccgtaccggtaccggggaactaaaccggtacttaccgataccggaccaacgtacctccgtaaccaactaaacacgtactcctaaacgtacgtggaacgttggaacggcgtcgtaacgactacttacggacgtaaccgaccgacccgggttaccgtacgttaacgtttccgtgtaacgggtaccgtaacgtaccggtccccgaaacggtccggttaccggttcgaccgccccgtaaggtcccgacggttccgttacgtttccggttaccgtgggtaaccgggg

SEQ ID NO: 209037 - DNA, 902 bp, Homo sapiens
  misc_feature: GYAE6OF02I25UR.17.25.C03.1.454.CMB.1.raw
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccacctccgaggtcgacagcgtgggtcgactacgttcggtcggggctaggaggtaggaaaggaacgccggttggggtccctacgaggtaggtaacggtcctccgtgaacgaacggtcctttacgtaggtactttaccgtaaccggttttaccctacctaagtaacggttactaacctaacgggttcggggtacgaccggaccgtaacggggccctacggttacgggaaaccaaacccggtaccgttggaaggtacggtaacggtaggggtacgtacggggggaaccctaaaacccccgtaaacgtacggttgggtcgtaacccgaagtacggtttacgttaccttaacccgaaccctaacgtttccccggtaacccgggaactaacggttaaccctttaaaccgaggttaaccgaacccgtaacgtaacccttcccgtaacctaaaataaacccgaacgaaccgttaccctaaagtaggtaagggttacgttacggaacgggacccgttccgtaagaacctaacgttcggtaacgaaacccggtacgacccggggtacctttacgttaaatttaccggttgggtacggaaccgtaagggttacccctaacccggtaacgggttaacccgtttccgggggaactaacccggttacccggttaaacccgggtcgtaacccggggtttcccggtttaacccggttttaacggtacccccggttttacgggggacccgggggg

SEQ ID NO: 209038 - DNA, 601 bp, Homo sapiens
  misc_feature: GYAE6OF02HOEF5.17.25.C03.1.454.CMB.1.raw
  modified_base (234)..(234): a, c, t, g, unknown or other
  misc_feature (234)..(234): n is a, c, g, or t
  modified_base (242)..(242): a, c, t, g, unknown or other
  misc_feature (242)..(242): n is a, c, g, or t
  modified_base (256)..(256): a, c, t, g, unknown or other
  misc_feature (256)..(256): n is a, c, g, or t
  modified_base (266)..(266): a, c, t, g, unknown or other
  misc_feature (266)..(266): n is a, c, g, or t
  modified_base (351)..(351): a, c, t, g, unknown or other
  misc_feature (351)..(351): n is a, c, g, or t
  modified_base (447)..(447): a, c, t, g, unknown or other
  misc_feature (447)..(447): n is a, c, g, or t
  modified_base (461)..(461): a, c, t, g, unknown or other
  misc_feature (461)..(461): n is a, c, g, or t
  modified_base (477)..(477): a, c, t, g, unknown or other
  misc_feature (477)..(477): n is a, c, g, or t
  modified_base (486)..(486): a, c, t, g, unknown or other
  misc_feature (486)..(486): n is a, c, g, or t
  modified_base (548)..(548): a, c, t, g, unknown or other
  misc_feature (548)..(548): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctctttcgttggtggcagcagctacaagtgcccactcccaggtgcagctggtgcagtcgtggggctggaggtgaagagccgtgggcctcagtgaagtctcngcagcttngattcacgtttacncctatagtancaacgtggtagcgccgaaggcccgctacgggaaccaaaccggtacctggagtggagtggggaagtcggggaccaaaccccttaanaccggtggtacgtacacgtaaggttgtccttaccaacccgtatcccgtacgggaactacgtaacttaccatcgaacccacgtaacctccacctaanaaacacacacctanagtcgagttgaagacncctagaacntcagaacgacgacggtcgtacttagttacgtgtcgacgagacgtcccaagtcgtccgggtanaacggtcccgtaacggcagggtaccgttacggtttcgaccgttgggtacgggg

SEQ ID NO: 209039 - DNA, 886 bp, Homo sapiens
  misc_feature: GYAE6OF02IK4DK.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggcctcagtgaaggtcctcctgcaaggtcttcgtggattcacgttacctacctactagtatactacgtacggtggcgccgacgacggccgtacggtacgaaccgtaccgtaggtaggtacgggtaggtacgggtacggtacgggtaccgggtaaccccgtaaacccgtacgttacgggtcggttacgtaccgtaacggttacggttacccgttacccgtacccctaccggttaccccggtacccgggtaacccggtaaccgtaaccggttaaccctaacgtaccggtaacccaacccgggttaaaaccccttcccctaaccgtaaactaaaacccgtaaccgaaccgtaacccctaaccgtaaggtcggggttaacgggttaacgtcgggggaaccggtaacccttaccgtaaacgtaacttcccggggtactaaaccccgggacccggtaaacccggggttacccggtttaactttaaaccgttttacccggtagggtacccgggtaaccgggtacggttaaaccggttacccccgaacccgggtttacgtaaccccgggggttacggaaaaccccgggttccccgggtaccccggtaacgggtaacccggggttcccccggggttcgtttttaaccggggttaacccccgttccgggggtcccggggggg

SEQ ID NO: 209040 - DNA, 520 bp, Homo sapiens
  misc_feature: GYAE6OF02F68MR.17.25.C03.1.454.CMB.1.raw
  modified_base (278)..(278): a, c, t, g, unknown or other
  misc_feature (278)..(278): n is a, c, g, or t
  modified_base (289)..(289): a, c, t, g, unknown or other
  misc_feature (289)..(289): n is a, c, g, or t
  modified_base (329)..(329): a, c, t, g, unknown or other
  misc_feature (329)..(329): n is a, c, g, or t
  modified_base (415)..(415): a, c, t, g, unknown or other
  misc_feature (415)..(415): n is a, c, g, or t
  modified_base (435)..(435): a, c, t, g, unknown or other
  misc_feature (435)..(435): n is a, c, g, or t
  modified_base (466)..(466): a, c, t, g, unknown or other
  misc_feature (466)..(466): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctctatagtatcaactgggtncgccaggccgntggacacgacctgagtggatgggatcgggcgaaccctaanactggtgtacacgtagtcgtcttccaccctatcctccgggacacgtacttaccatcgaccacgactcctacaataacacagcctanatgagttgagacgcctgacntctagacgacacggctactatactgtgcgancgtcccagtctccggagacgcctaggcacggccggtcctttggacttgtccggg

SEQ ID NO: 209041 - DNA, 760 bp, Homo sapiens
  misc_feature: GYAE6OF02I25P9.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtctgggctggaggtgaagaagccgtggggcctcgagtgaaggtcctcctgccgacggtcttcgtggtattcgtaccgtttacctcctattagtatcgaacgtgggtcgcgccaggccgctgggaaccaacggacctggaggtggagtgggatcggggaccgtaaaccctaacgtacgtggtcgtaccacacggttgtccctttaccaacccctcgttccccggtaccggggaactacggtaacccttaaccgacgtcggaaccctaaccggtaaccctccctacctaaaacgtaaaccaccgaacgtaccctaacgtggtaggtaacggttacggaagggtaaccgtccgtagaaaccttacgtaccgtaacggaacccggacgtaaccccggggtcctttaaccgtttaacgtttacggtcggtacgggtaaccgtaccggtacccgttaccccggaaccgggtacgttccccggggtaagtaccccgggtaacccgtaccggggtaccgtaacccgggttcccgggttaccgttttaacccggtaccggtttccggggtaacccgggggg

SEQ ID NO: 209042 - DNA, 737 bp, Homo sapiens
  misc_feature: GYAE6OF02F4C0U.17.25.C03.1.454.CMB.1.raw
  modified_base (284)..(284): a, c, t, g, unknown or other
  misc_feature (284)..(284): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagcctgggggctcagtgaacggtctcctgcaaggtcttctggattcacgtttacctcctatagtatcaacgtgggtncgaccaggccgcgttggaccaaccggacctggacgtggacgtggggactggggaccgaaacccttaacgacgttcgggtcggttacaaccgtagtttcggtactttccaaaccccgtacgttccccgtacccgggggtaacaaccggttacctttaacccaacgtttaccggaaccctaaacccgggtaaaccttccccttaaccccgaaacttaaaaaccaccgtaacggacccttaaaccaaggttacgggtaacggtttagacggggtaactacccgttagaacctaacgtccgttaggaaaccgtaccgtaaccggggcccgtttataacggtttactcggttaggcccgtaacgacggttaccccaggtaacgtccccgggttaggacccggtacctacgggcaaccgggtccggttaccgtttaggtacccgtttcggtaacggggg

SEQ ID NO: 209043 - DNA, 599 bp, Homo sapiens
  misc_feature: GYAE6OF02F6WE9.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcaacggacgtttaaaaacctatttaaattggtatcagcagaaacctggaaaacgccccagacctcctgatctcgtggtgcactccactctgcgaagtggctcccatcgagttcaggtcgacaggtggatcgtagggactaagtacttttacaacttcctacacctactacaaccctacgtctacgacctaaacctggacggtattaggtcgacctaattccttaacttactacgtacaactaagtacgttacgtaccgttcccttaccgtacttaaccgttttcggaccgtaacgggtaaccgtaagttgaacgtaactaacaaaacggtaacttcggtagtcctacggacctactacttccttagttaccc

SEQ ID NO: 209044 - DNA, 621 bp, Homo sapiens
  misc_feature: GYAE6OF02GKT09.17.25.C03.1.454.CMB.1.raw
  modified_base (280)..(280): a, c, t, g, unknown or other
  misc_feature (280)..(280): n is a, c, g, or t
  modified_base (353)..(353): a, c, t, g, unknown or other
  misc_feature (353)..(353): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaagggcttctggattcacgtttacctcctatagtatcaactgggtncgccaggccgctggacaacgacctgagtggatggggatcggggacgaaacccctaacgactgggtgtccaacnggtagtccttcaccccatcccgtccgggacacgacttaccatcgaccacgaacctccctaccaataaacacacgacctacacgtggagtttaggaagggtacgccgtagaaccattaccgtgaaccggacgacccgggtcccgttacttaacgtttaccgtggttacgccggtaaggaccgttaccccgacgaacggttacccgggtaggaacgtcccgtacgggccgacggtcccgggttaccttttggtacccttcggtccggggg

SEQ ID NO: 209045 - DNA, 652 bp, Homo sapiens
  misc_feature: GYAE6OF02H1P7F.17.25.C03.1.454.CMB.1.raw
  modified_base (217)..(217): a, c, t, g, unknown or other
  misc_feature (217)..(217): n is a, c, g, or t
  modified_base (268)..(268): a, c, t, g, unknown or other
  misc_feature (268)..(268): n is a, c, g, or t
  modified_base (466)..(466): a, c, t, g, unknown or other
  misc_feature (466)..(466): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagcgtgggcctnagtgaaggtctccgtgacgaaggtcttcgtggtacttcgtacgttttaccnccgtaatagtactccgaaacgttgggtcgaccgcgacggccgtctgggaaccaacgacctggtagtggagttggggagtcggggaccctaaaccctaacgacgtcggtgtacccagtagttcgtcttaccaaccgacttcccggtacgggactagtaccttacacgtcgaccgaacgaccttccgaccaaataaaccngtaaccgtcctaacgagtaggacgttaggagactcgttagacacttacgcggtaaccgaccgaccgggtcccgttacttacgttaccgtgtacggtacgaacgtacccggtacccaacggtaaccgtcggttacgacgtcccgtaagcgtacggtaccggttcttacgttaccgttcggaccgggg

SEQ ID NO: 209046 - DNA, 778 bp, Homo sapiens
  misc_feature: GYAE6OF02G5F8A.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctggggcctcgagtgaaggtctcctgcaaggtcttcgtggtacttcgtacgtttacctcctatagtatactaacgtgggtcgcgccgaggccgcgtaggaccaacggtaccgtaggtacggtagggaacgtggggacgtcggggaccgtaaaccccgtaaacgaccgttgggtacgtacgaacgtacggttacgttaccttaccaaccccgtacgttcccggtaccgggtaacgaacgtaaccgttaccgtacgtaccgaaccctaccggtaaaccctttcccgtaaccaaactaaaacccgactaaccggtacccttaacgagttacgggtattacgggaacggtacgtaccgtaagtacctagtaccgttacgaaccggaccgtacccgggtaccgtttacttaacctttacggttcggttacgaacgggttacgtacccgggttacccgaacggttcggttaccccggggaagttaccccgggaacccggtttaccgggaccgttaacccggggttcccggttaaccccgtttttacgggtacccggtttcccggggtaacccggggg

SEQ ID NO: 209047 - DNA, 722 bp, Homo sapiens
  misc_feature: GYAE6OF02GT4RA.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattcacgtttacctcctatagtatcaacgtgggtgcgccaggccgctggacaacgacctgacgtggagtgggatggggaccgaaccctaacgactggtagtcgaacaggtgtccttacgacccctagttcccgtaccgggaactacgtaaccttaccaacgtcgaacccacgtaaaccttccctacctaacgtaaaaaccaccgtaacgtaccctaaacgtacgttcgggtaacgtttagggaacgggtaaccgtcccgttaagaacccgtaagttaccgtacggtaaacccggaacccgtaacccggggtccccgtttaacgtttaaccgttttaacgtcggttaccgggacgtaacggtacccgttaccccgaaccggtaaccggttacccggggtacggaccggttcccgtaaccgggccgaaccgggtccgggttacccgttttacgtacccggtttcggtacccgggggg

SEQ ID NO: 209048 - DNA, 536 bp, Homo sapiens
  misc_feature: GYAE6OF02FF6E4.17.25.C03.1.454.CMB.1.raw
  modified_base (376)..(376): a, c, t, g, unknown or other
  misc_feature (376)..(376): n is a, c, g, or t
tcagcgtagactagcacgaccggtgctcgatttagtagtgtagatttgggtttgggagtcagtctcagtcaggacacagcatggacatgagggtccccgctcagctcctgggctcctgctactctggctccgagctgccagatgtgacatccagatgacccagtctccatcctccctgtctgcctctgtgggggtcagagtcaccatcacttgccggacaagtcacggcgttaaaaacctatttaaattggtatcagcagaaacctggaaaacgccccagacctcctgactctctggtgcatccactctgcgaagtgcgtccatcgagtcagtgcagtggatcgtggacagtattcaatctcacatcaccactctnactaacctgaagtattgtcgacaacgttctaaccttactcgtacaaactagtaagttaccacgtttcccctagtccttaacgtttcggacccgaggggtaacccaagttcgagtaactacgaaaaccgtactgtaggtcctggaccacctatctgttacc

SEQ ID NO: 209049 - DNA, 583 bp, Homo sapiens
  misc_feature: GYAE6OF02H97DA.17.25.C03.1.454.CMB.1.raw
  modified_base (282)..(282): a, c, t, g, unknown or other
  misc_feature (282)..(282): n is a, c, g, or t
  modified_base (290)..(290): a, c, t, g, unknown or other
  misc_feature (290)..(290): n is a, c, g, or t
  modified_base (340)..(340): a, c, t, g, unknown or other
  misc_feature (340)..(340): n is a, c, g, or t
  modified_base (456)..(456): a, c, t, g, unknown or other
  misc_feature (456)..(456): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtgggcctcgagtgaaggtctcctgcaaggcttctggattcacgtttacctctatagtatcaactgggtgcnccaggccnctggacaacgcctggagtggatgggatcggggcaaaccctaagactgggngtcacgagtgtcttcacccatcccgtccgggacacgtacttacatcgaaccacgaacttcccaccaataaaccacagaccctacagtggaagttaggagacgtccgtagactactnacgaacgacgacggtaccgtacttattacgtgtgacgtagaccgtacccgacggtcgtaccggtgaaccgtacccgtaccggacgacggtcccgttaccgtttcgttaccggttcggtacccggggg

SEQ ID NO: 209050 - DNA, 718 bp, Homo sapiens
  misc_feature: GYAE6OF02HBY38.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtgggcctcgagtgaaggtctcctgcaaggcttcgtggattctaccgtttacctcctatagtactcaactgggtcgcgccaggccgcgtaggacaacgcctggaggtcggagtgggagtcggggaccgtaaacccgtaacgtacgtgggttcgactacgagttacgttccttaccaaccctattcccggtaccgggaactaaccggtaacctttaaccgacttacggaccctaacgtaaccccttccctaacctaaactaaaaccactaccgtaccttaacgtaagttcgggtaacgttacggaacgggtacggtaccctgaaaccgtactaccgttacggaaccgtacccgacgggtcccgttaactttaacgttacgtacggtacgtacggaacggttacccgtaccccgacggttacgttcccgggtacggtaccggtacccggtaccggaccgtacggggtaccgttacccggtttttacggtcccgtttagggtacccggggg

SEQ ID NO: 209051 - DNA, 592 bp, Homo sapiens
  misc_feature: GYAE6OF02FNIAK.17.25.C03.1.454.CMB.1.raw
tcagcgtagactagcacgaccggtgctcgatttagtagtgtagattttggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatcgggacgtaaccctaacgactggtgtcacgagtgtccttcgaccctatccgtaccggggacagtaccttaccatcgaacccacgaactccctaccaactaaaccaacacgaccctaacacgtagggtagttacgaggacgtcctgacacttcgtagaaccgacgacggccgttacttacttacgtgtacgacgtacgacgtacccgacgtacgtccggtacgacgtacccgtacggacgacggtccggtacctttcggtaccttcggtacgggg

SEQ ID NO: 209052 - DNA, 672 bp, Homo sapiens
  misc_feature: GYAE6OF02JY7JG.17.25.C03.1.454.CMB.1.raw
  modified_base (515)..(515): a, c, t, g, unknown or other
  misc_feature (515)..(515): n is a, c, g, or t
tcagcgtagactagcacgaccggtgctcgatttagtagtgtagatttgggtttggggacgtcaacaaccacatctgtcctctagagaaaccctagtgagcacagctcctcaccatggactggacctggaggatcctcttcttggtggcagcagctacaagtgccactcccaggtgcagctggtgcagtctggggctgaggtgaagaagcctggggcctcagtgaaggtctcctgcaaggcttcgtggattcacgtttacctcctatacgtatactaacgtgggtgcggccaggtcccgcgtggaacaacggaccttggagtggatcgggattcgggggacaacccgtaacgacctgggttacgtcaacgaggttcgtacctttccgaaccccgtacgttacccgtcccgggggaacacgggtaaccctttacccagtttacgaccaacggtaactcccgtacaacgtaaacacacgacctacacgtggacgttgacggacgcctagacgtatacnggtaccgaacgaccggtccgtaccgttaattcccgtagtacggacgtaacgtaccggtcccgtaacgacggttaccggttcgggaacccgtacccggttaccggaccgtaccggcccggttacccgttttacggacccgtttcgggtaacccggggg

SEQ ID NO: 209053 - DNA, 609 bp, Homo sapiens
  misc_feature: GYAE6OF02GRDA0.17.25.C03.1.454.CMB.1.raw
  modified_base (247)..(247): a, c, t, g, unknown or other
  misc_feature (247)..(247): n is a, c, g, or t
  modified_base (283)..(283): a, c, t, g, unknown or other
  misc_feature (283)..(283): n is a, c, g, or t
  modified_base (291)..(291): a, c, t, g, unknown or other
  misc_feature (291)..(291): n is a, c, g, or t
  modified_base (310)..(310): a, c, t, g, unknown or other
  misc_feature (310)..(310): n is a, c, g, or t
  modified_base (333)..(333): a, c, t, g, unknown or other
  misc_feature (333)..(333): n is a, c, g, or t
  modified_base (460)..(460): a, c, t, g, unknown or other
  misc_feature (460)..(460): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcgagtgaacggtctcctgcaaggtcttcgnggattcacgtttacctcctatagtatcacgtgggtncgccagcnctggacacgacctgagtgngtggatcggggaccaaccctaanacgtggtcgtcacgtagtgttccttacgaaccctagtcccgtaccgggactacggaccttacctatacgaccacgtaacctccctaccaataaacacacgtacctacagtcgggtattacggagacnccgtagaccattccgtacgaccggaccgtccgggtacccgtacgtttaacgttaccgtaggtcgacggtacgacgtacccgacgtacggtaccggtcgacgtacccgtacgggcacggccggttaccgtttcgtacgttcggtccgggg

SEQ ID NO: 209054 - DNA, 775 bp, Homo sapiens
  misc_feature: GYAE6OF02HBGJ4.17.25.C03.1.454.CMB.1.raw
tcagcgtagactagcacgaccggtgctcgatttagtagtgtagatttgggtttgggggactcaacaaccacatctgtcctctagagaaaaccctgtcgtagcacgagtctccctcaccatggtactggtacctggagggactcctcttcgttggtacggcagcacgctaacaagtgcccactcccaggttgcagtctggtgctagtcgtggggctggagggtgaaggagcgtgggcctcagtcggaaggtcctccgtgcaggcctcgtgattctacgtttacctcctatagtactacaacgtgggtcgccgccaggcccgcgtacgggaaccaacggacctaggacgtggaagtaggggacgtcggggaacctaaaacccgtaacgacgtacggtacgtactaccgtacgtcggtacctttacccaaccccgtacttacccggtaccggacgtaaccggtaccttaacccgacgttaccggtaaccccgaaccggtaaccctaccccgtaaccgaacgttaaaacccgacgtaccggtacccgttaaaccgacggttacgggttaacgggtttaggggaaccgggtacggtacccgttacgggaaccgtaccgttaccgtccggtaaccggacccgtacccgggtaccccgttacgtaaccgtttaccgtcggttaccggaccgtaccgtaccggtaccccgacggtccgtccgggtacgtaccggccgtaccggccgtacggccggttaccgttcgtacgttccggtaccgggg

SEQ ID NO: 209055 - DNA, 596 bp, Homo sapiens
  misc_feature: GYAE6OF02JF3BJ.17.25.C03.1.454.CMB.1.raw
  modified_base (359)..(359): a, c, t, g, unknown or other
  misc_feature (359)..(359): n is a, c, g, or t
  modified_base (434)..(434): a, c, t, g, unknown or other
  misc_feature (434)..(434): n is a, c, g, or t
  modified_base (463)..(463): a, c, t, g, unknown or other
  misc_feature (463)..(463): n is a, c, g, or t
  modified_base (496)..(496): a, c, t, g, unknown or other
  misc_feature (496)..(496): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctgggtgcagtctggggctgaggtgaagagcgtggggcctcagtgaaggtctcctgccaaggtcttcgtggacttcacgttttacctccgtaatagtactcaacgttgggtcgcgccaggtccgcgtaggacaacgacctggagtggatgggagtcgggccgaaaccgtactacggtggtntacacgtagtctccttacacccgtatcccgtacgggactagtacctacatcgaccacgtactccacaactaaacncagtccactagtggtagtgaggactccgngactctacgtcgaccgacgaccggtcgtacttnttacgtgcgactacggacctacccggacgtcggttaccggacggtaccggtccgttacgggctcggacccggtttcctttaggtccgttcgggtaccggg

SEQ ID NO: 209056 - DNA, 774 bp, Homo sapiens
  misc_feature: GYAE6OF02GSKQR.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggcctcagtgaaggtctcctgcaaggcttctggattcaccgtttacctcctatagtatcaacgtgggtcgcgccgaggccgcgtcgggaacaaccggacctggacgtggagtggggatcggggaccgtaaacccctaacgacgtgggtcgtactaagtacggttgttaccttaccaacccccgtagttcccccggtaccccggggaactaacggttaacccttaacccgacttaccggaaccctaacccggtaaaccccttccctaaccccctaaactaaaaacccaacccgaacgtaccccttaaaccgaacggttacgggtaggtttaccggaaacgggttaccgccccgttaggaccctaacgtttcccgtagggaaacccggtaacccggtacccggggttaccctttacgtttaaactttaccggtggttaccgaccggtaaggtacccggtaccccgtacgggtaaccgttacccgggtaggtacccgacccggttaaccgggccgaacgggtcccggtttaccgttttcggacccgttttcggtacccggggg

SEQ ID NO: 209057 - DNA, 688 bp, Homo sapiens
  misc_feature: GYAE6OF02FO1YN.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaaggcttctggattcacgtttacctctatagtatacaacgttgggtgccgccgaggcccgcgtcggaaccaaccggtacctggaggtgggagtggggagtcggggaccgaaaccctaacgacgttgggtacgtccaacgtaggttcgttccttaccaacccctacgtcccgtaccggggaactacgtaacccttaaccgacgtaccgaacccaaccgtaacgtcccctacctaaacgtaaaccaccgaacgtacccttaacagtagggtagttacgaagggcgtaccgtagaccagttcgacggaacgtacccgaccgggttccttacttaacgttactcgggtagacggaacggtaccgtcccgtaacggtattaccccggggttaggacccgtccggttaaccgggcgaacgggtcccggttcccttttgggtacccgtttcggaccggggg

SEQ ID NO: 209058 - DNA, 839 bp, Homo sapiens
  misc_feature: GYAE6OF02JG5O2.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatcgacccagtctccactcctccctgtctgccttctgggtggggtcaggacgtcacctatcacgttcggaccggaacaacggtccgaacggtaaccgtttaaaaaccttattttaaaagttggttaactcctaagaccgaaaacggtaaaacccgtaacgggaaaaccgtcccccgtaaagtacccccgttacctggtaacttccgttaccggttgggtacgacctaacttccccctaacgttccgtacgggtaacggtaacggtttccgggacccgttacccgtaacggttccgggtaaacgggtttccaacggggtttcggaccgttaacggtcgggttaaccgttcggggttacgggtaaactacgtttaaccgtttacctaaaccgtttcctaacccggaaccccttacgtacccctaaacccttacccgttaccgtccgtaacccgttaaaccggtggaaccgggtttacttagggtaccgtaaccttaactttacccttaacgtttacccgtaacggtaccgaaacgttacgttaaccgtttaccctacccggtttacccctccgttaccgtttacggtttaccggaaccggttaacggaaccgttaagtcgtaacgtacgtaacggtaacgtacgtggtacgtaccgacgtacctacgtacctttgtaccttacg

SEQ ID NO: 209059 - DNA, 566 bp, Homo sapiens
  misc_feature: GYAE6OF02GDEFK.17.25.C03.1.454.CMB.1.raw
  modified_base (280)..(280): a, c, t, g, unknown or other
  misc_feature (280)..(280): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggagtgggagtcggggacgaaaccctaacgaacgttggtgtacacaggtgtacttcgacccacgtccctccgggacagtaccttaccatcgaccacgaacctcctaccaataaacacacgacctacagtggagttggaggacgcctagacattcgtgaaccgaccacggtccgtacgtacttacgtggtcgcgtagaccgtcccacggtactccggtagacgccgtacggcacggccgtcctttgacgtttcgcgggg

SEQ ID NO: 209060 - DNA, 667 bp, Homo sapiens
  misc_feature: GYAE6OF02FN31W.17.25.C03.1.454.CMB.1.raw
  modified_base (244)..(244): a, c, t, g, unknown or other
  misc_feature (244)..(244): n is a, c, g, or t
  modified_base (278)..(278): a, c, t, g, unknown or other
  misc_feature (278)..(278): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgccccactcccaggtgcagctggtgcagtctggggctgaggtgaagaagccgtgggcctcagtgaaggtctcctgcaggcttcnggtattcacgttcctcctatagtatcaactggtncgccaggccgctcggacacgtactgagtggagtgggactgggaccaaccctaacacgttggtgtaccacgtagtgtccttaccacccacgtcccgtaccgggaacacgtaccttaccactacgaccctacgtaacctcccgtaccaactaaacaccacgtacctaacgtacgtaggtaaggttcggaagggtaccgacccgttagaacttaaccgtacgtacgaacccggaaccggttccgggaacccgtttcttaaacgttcgtcgggtacgacgtaaccgtacccggtacccgaaggtcccgtccgggtacccgtaacgggccccgttaacgggccgaccggggtccgtttacccgtttacggtacccggtttccgggtaccggggg

SEQ ID NO: 209061 - DNA, 715 bp, Homo sapiens
  misc_feature: GYAE6OF02GXJ4U.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggtcttctggattcacgtttacctcctatagtatcaactgggtgcgccaggccgctggacaacgacctgagtggagtgggagtcgggacgaaaccccgtaacgaccgtggtcgtaccacgtaaggttgttaccttccaacccctacgttcccgtacccggggaactaacggtaacctttacccaagttaccggaacccaaccggtaaacccttaccccgttaaccccaaacgtttaaaaacccaacccgtaaacgtaccccttaaacgtaacgttacgggtaacggttttacgggaacgggtacggacccttaggaacctaacgttccgttacggaaaccggtacccgtaaccgggtccgtttacctaacgtttaccgtggtacgtccggaagtaccggtaccccaacggtacgttcccggtaggaccgtcccgtacggcacgggtccgttccgtttacggtaccttcggtaccgggg

SEQ ID NO: 209062 - DNA, 761 bp, Homo sapiens
  misc_feature: GYAE6OF02IG6XK.17.25.C03.1.454.CMB.1.raw
  modified_base (177)..(177): a, c, t, g, unknown or other
  misc_feature (177)..(177): n is a, c, g, or t
  modified_base (222)..(222): a, c, t, g, unknown or other
  misc_feature (222)..(222): n is a, c, g, or t
  modified_base (700)..(700): a, c, t, g, unknown or other
  misc_feature (700)..(700): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttggtggcagcagctacaagtcgcccactcccaggtncagctggtgcagtcgtgggctggaggtgaagaagccgtgggcctnagtgaaggtctccgtgacgaggtcttcgtggtattccgtaaccgtttacctcctagtagtatcaacgtgggtcgcgccgacggccgcgtacggaaccgaacggtaccgtggacggtggagtggggtacgtacggggaccgtaaaccccgtaacgtaccggtgggttcgtacgacgtacggttcggttaccttacccgtaaccccgtacgtacccgtaccggggaacctaacggtaacccttaccgtaacgtaccgaaccctaacgaacccttcccgtaacctaaactaaaaccgacccgtaaacgtacccgttaaagtacggttacgggtaacggttacggaacgggtaacgtacccgtagaaacctacgttacgtaaccggtaaccgacccggtaacccggtccgttaaccgtttacgttacgtacggtcgaacggtaaccgaccgttaccccgtacgggtaaccgttccgggtaanacccgggtaccctacgggacgtacggcccggtttaccttacgtaccgttccgggaccgggg

SEQ ID NO: 209063 - DNA, 655 bp, Homo sapiens
  misc_feature: GYAE6OF02HSPPY.17.25.C03.1.454.CMB.1.raw
  modified_base (433)..(433): a, c, t, g, unknown or other
  misc_feature (433)..(433): n is a, c, g, or t
  modified_base (571)..(571): a, c, t, g, unknown or other
  misc_feature (571)..(571): n is a, c, g, or t
  modified_base (603)..(603): a, c, t, g, unknown or other
  misc_feature (603)..(603): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtgggcctcagtgaagtctctgcgaggtcttcgtggattcacgtttacctcctatagtatacaacgttggggtcgaccgccgacggtcccgcgtaggacctaaaccgttaccgtggtaggtcgggtaggtcggggtaggtcggggaaccggtaaaacctaacgtaccgttaggtcgtacacgtagttcgtcttacccgaccctacgtcccggttacccgganacgtaacctacacgtcgaacccacgaaccctccctaaccgaactaaaccgaccagtaaccctacgaacgtggtacggttacggagtaccgcgtaacgacactcgtacgaaccgacgccgttaccgtacttattacggngtcgacgcgtaccgttcccaaggcgttccggngtaccgacccgtacgggcacgggtccgttcctttaggccgttaggtccgggg

SEQ ID NO: 209064 - DNA, 578 bp, Homo sapiens
  misc_feature: GYAE6OF02HTKN5.17.25.C03.1.454.CMB.1.raw
  modified_base (279)..(279): a, c, t, g, unknown or other
  misc_feature (279)..(279): n is a, c, g, or t
  modified_base (288)..(288): a, c, t, g, unknown or other
  misc_feature (288)..(288): n is a, c, g, or t
  modified_base (330)..(330): a, c, t, g, unknown or other
  misc_feature (330)..(330): n is a, c, g, or t
  modified_base (452)..(452): a, c, t, g, unknown or other
  misc_feature (452)..(452): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactggtncgcaggccnctggacaacgactgagtggatgggatgggacgtaaccctaanacgtggtgtacacgagtgtcttcaccctatcccgtaccgggacacgtaacctttaccgaatcgaaccctacgaacctccctaccaataaaccacacgcctaacagtggtaagttgaaggacncctgacattctggaaccgaccgaccggtccgtacttattaccgtgtcgacgagacgttcccgaaggtcgtaccggtgacgtaccgtacgggccaaggcccggtacctttggacctttcggtcgggg

SEQ ID NO: 209065 - DNA, 594 bp, Homo sapiens
  misc_feature: GYAE6OF02HA9SI.17.25.C03.1.454.CMB.1.raw
  modified_base (465)..(465): a, c, t, g, unknown or other
  misc_feature (465)..(465): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagccgtgggcctcagtgaaggtctccgtgcaaggcttgtggattcacgtttacctctatagtatcaacgtgggtgcgccaggcccgcgtggaccaacgaccgtggagtggagtggggatcggggaccaaacccgtaacacgttggtgtaccgacgtagtgttccttccacccctacgtcccgtacgggacacgaccttacatacgaccacgtaacctccgtaccaataaaccacacgacctacagtggtagttggagtacncctagactatcgagaccgacgaccggtcctattacttacgtgtacgcgagtaccgtacccgacggtcgtccggagacgtcccgtacgggcacgggtccggttaccgtttcggtaccgttccggtcgggg

SEQ ID NO: 209066 - DNA, 758 bp, Homo sapiens
  misc_feature: GYAE6OF02FWQM6.17.25.C03.1.454.CMB.1.raw
  modified_base (220)..(220): a, c, t, g, unknown or other
  misc_feature (220)..(220): n is a, c, g, or t
  modified_base (481)..(481): a, c, t, g, unknown or other
  misc_feature (481)..(481): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgaagtctgggctgaggtgaagaagccgtggggcctcngtgaaggtctcctgcaaggcttctggattctacgtttacctcctatagtatcaacttgggtgcgccaggccgcgtggaacaacgcctggacgtggagtgggagtcgggaccgtaaacccgtaacgacgttgggtagtacctacgtacgttcgttcctttaccgaacccctacgttccccgtacccggggactaacggtaccctttaaccgacgttccggaaaccctacgtaaacccttcccgtacccaaattaaaaccccncaacgtacccttactaagtacgggtaagttacggaacggtacgacccgttaggaacctacgtttaccgaacgaacgtaaacccggtacccgggtcccttaaacgttaccgtttaaaccgtcggttacggaaccggaacgggttacccgttccccggaaaagtccgggtttaacccggggtacgaaccggttacccccgttaaccggggctaacccggggttcccggttcccgtttttaaacggcccggttttccgggggaccggtaacccccggggg

SEQ ID NO: 209067 - DNA, 718 bp, Homo sapiens
  misc_feature: GYAE6OF02H3K62.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggactcctcttcgttggtggcagcagctacaagtgcccactcccaggtgcagcctggtgcgagtcgtaggggctggaggtagaagaagccgtgggcctcgaggtgaaggttctcgtgacgaaggtcttcgtggtattctaccgttttacctcctagtagttactaccgaacggttgggtacgccgtaccggacgggtcccgcgttagggaaccaacggtacctggtaagtggagttgggaacgtcggggaacctaaacccgttaacgacggttcggtacgtaccacgtagtcgttctacccacccgtatcccggtacggaactacgtaccttaccagtaccgaccgtaaccgtaccgtccctaacgtaactaaaccgacgtacgaccgtaacgtacggtacggtacggttaggacgtacgtaccgtacgacacttcgtaccgaaccgtaccgtaccggtaccgttacgttacgttacgtagaccggtaccgacgtaccgtccccgtaaggtccggttaccggtacgtaaccgtacccgaccggtcgaccggttccgttaccggttacgttacccggtacggtacccgggg

SEQ ID NO: 209068 - DNA, 686 bp, Homo sapiens
  misc_feature: GYAE6OF02FY5DD.17.25.C03.1.454.CMB.1.raw
  modified_base (204)..(204): a, c, t, g, unknown or other
  misc_feature (204)..(204): n is a, c, g, or t
tcagcgtagactagcacgaccggtgctcgatttagtagtgtagatttgggtttgggggagtcagtctcagtcaggacacagcatggacatgagggtcccgctcagctcctggggctcctgctactctggctccggagctgccagatgtgacatccagatgacccagtcctccatcctccctgtctgcctctggtgggggtcagngtcacatcacgttgccggacaagtccacggtacgttaaaacctaatttaattggtatcagcaagaaaccgtagaaaacgccccagaccttccgtgactctcgtggtcacgtactcctactcgtggacgtaaggtcggtaccgtccctaagtccggtacggttcgtaggtcggacgtaggtggtatacggtaggaactagttacgtttacaacgttcctacgaaccgtactacctaaccctacttcccgtacgtaaccctaaccgtacggtaacgtacgtttacgtcggttaactacgttacttaaccttacgttacgtaacgaaacgtacggttaacgttaccgtacccgtttcccgtaccgtactttaaccggttttaccggaaccggtaacgggtaaccttaaggtacgtacgtacgtaaaccgtaaccggaacgtttggtaacgtccgttacgacctaccgttattcccgttcgtaccc

SEQ ID NO: 209069 - DNA, 712 bp, Homo sapiens
  misc_feature: GYAE6OF02I2R2C.17.25.C03.1.454.CMB.1.raw
  modified_base (511)..(511): a, c, t, g, unknown or other
  misc_feature (511)..(511): n is a, c, g, or t
  modified_base (644)..(644): a, c, t, g, unknown or other
  misc_feature (644)..(644): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttggtggcagcagctacaagtcgcccactcccaggtcgcagcgtggtgcagtcgtgggctgaggtgaagagccgtgggcctcagtgaaggtctccgtgacgaagtcttcgtggacttcgtacgtttacctcctatagtactactaacgtgggtcgacgtccgacgggccgcgtacggaacctaacgacctaggaacggtgggtagtcggggtaagtcggggaaccgtaaccccgtaacgtacggtcggtactacgtacgacgttcggttcctaccaccgtacgtcccggtacggtaactacgtaccttaccgacgtacgaaccctaaccgtaacctccctaacgtaactaaacccacgtacgacccgttanagtaccggtgttaacgaacggctaccgtagtaaccacgtttcgaaccggacgtaccgacccggttccgttaacttaacgttgtccgtaaaccgggctaaccggtacctcccgggtaactccggttaaccgggngttaaccggaccgttaccggacgtccgggtaccgtttccggtttaacgtaccggttgggtacccgggg

SEQ ID NO: 209070 - DNA, 784 bp, Homo sapiens
  misc_feature: GYAE6OF02JXQHH.17.25.C03.1.454.CMB.1.raw
  modified_base (569)..(569): a, c, t, g, unknown or other
  misc_feature (569)..(569): n is a, c, g, or t
  modified_base (577)..(577): a, c, t, g, unknown or other
  misc_feature (577)..(577): n is a, c, g, or t
tcagcgtagactagcacgaccggtgctcgatttagtagtgtagatttgggtttggggtacgtcaacaaccacatctgtcctctagagaaaaccctagtgagcacagctcctccaccatggactggacctggaggatcctcttcttggtggcagcagctacaagtgcccacctcccaggtgcagctggtgcagtcgtgggcgtggaggtaggaacggaacgccgtcgggggccttaccgagggtaggtaacgggttccgtcccgttggaccgtaaacgggtccttagtcgggtaacttttccgaccgttttaacccttaccgttaacgttaggttaactaccgtaaaccgttggggttacggccgccgacggcccggtccgtcggaaccaacggacccgtggaggtagggtagttagggagtcgggggaacgtaaaccccgtaagaccggtggttacggacctacgtaggtgttccgttaccaacccgcgtaccgtacccggggaactacgtaaccttacccgagttaccgaccgaaccgtacctaccctaccaaactaaaccaccgtanaaccctanaacgtacgggtagtacggtaaacggtgtcccgtaaacgctacggttaccacgggaccgaccggtaacccggtccgttaaccttaacgggtttactacggttcgaacgggtaccaggtaccccgaacgtaccgggttccggtaggacccggtaccgttaaccggaccggtacggtcccgggttcgtttaacgccgtttaccgggcggg

SEQ ID NO: 209071 - DNA, 807 bp, Homo sapiens
  misc_feature: GYAE6OF02JRP7E.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgagaagccgtgggcctcagtgaaggtctcctgcaaggcttcgtggattctacgtttacctcctaatagtatcaacttgggtacgccgcacgggccgacgtggaaccaacgacctggacggtggaagttcggggattacgggggaccaaacccgttaacgtaaccgtgggtacgtactaacgtacggttcgttaccgtttccaaccccgtacgttcccgttacccgggggactaaccggtaccttaaccgtaagtccggaaccctaaccggtaacccttaccctaaccgtaaacctaaaaccaaccgtaccggtaaccctaacgtaacgttacggggtaaggttacggtaacgggaacgggttacccttacgtaaacgttaacttacccggttacggaaccgtaacccggtacccgggtccccttaccgggtttaactttaaccggttaggtaccgtaccgggttaacggtaccgttaccccggtaccggtaaccggtttacccgggtacggtaacccgggtacccggtaacccggggtaaccggtaccggttcccgggtaacccggtttttcggtaaaccccggttttccggtaaccccggggggg

SEQ ID NO: 209072 - DNA, 609 bp, Homo sapiens
  misc_feature: GYAE6OF02G0KUK.17.25.C03.1.454.CMB.1.raw
  modified_base (427)..(427): a, c, t, g, unknown or other
  misc_feature (427)..(427): n is a, c, g, or t
  modified_base (519)..(519): a, c, t, g, unknown or other
  misc_feature (519)..(519): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctgggcctcagtgaaggtctcctgcaaggcttcgtggattcacgtttacctcctatagtatcaactgggtgccgccgaggccgctggacaacgacctgagtggatgggatgggaccaacctaacgacgtggtgtcacgagtgtccttaccaccctacgtcccgtccgggaacacgtaccttaccgatcgaacccacgtaacctccctaccaactaaaccncacgtacctaacgagtagggtagttaggacggactcccgtagtacctacgttcgtacggaccgtaccgaccggtccgttactactttaccgngtacgacgtacgtaccgtacccgagtccgtcggtacgaccgtaccgtacgacgcggtacccgttccgtttaggaccgtttcggaccgggg

SEQ ID NO: 209073 - DNA, 644 bp, Homo sapiens
  misc_feature: GYAE6OF02J1DA2.17.25.C03.1.454.CMB.1.raw
  modified_base (245)..(245): a, c, t, g, unknown or other
  misc_feature (245)..(245): n is a, c, g, or t
  modified_base (261)..(261): a, c, t, g, unknown or other
  misc_feature (261)..(261): n is a, c, g, or t
  modified_base (280)..(280): a, c, t, g, unknown or other
  misc_feature (280)..(280): n is a, c, g, or t
  modified_base (319)..(319): a, c, t, g, unknown or other
  misc_feature (319)..(319): n is a, c, g, or t
  modified_base (374)..(374): a, c, t, g, unknown or other
  misc_feature (374)..(374): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagccgtgggcctcgagtgaaggtctctgcgaagcttcgngtattcacgtttaccnctatagtatcacgtgggtnccgcaggccgcgtggacaacgctgaggtggagtggggancggggaccaacccgtaactacgtcggtagtcactaggttcgtccttcaccccgtntcccgtaccgggacacggtaacttaccgagtaccgaacccgaacgtaacctacccgtacctaaacgtaaaccaacgaccgacctaacgtacgtacgggtacgttcggaacggtacgcctagacctgttacgtacggaaccgacgtaccggtaccgttacttaacgttactggtacgtcggacgtaccgtaacccgtcgtaaccgtccggtagacccgtaccgtaccggacgtaccggcggttccggtttacgtcgttacgggtaccgggg

SEQ ID NO: 209074 - DNA, 741 bp, Homo sapiens
  misc_feature: GYAE6OF02GL5U3.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcgagtgaaggtctcctgcaaggcttctggtattcacgtttacctctatagtatcaacgtgggtgcgaccgaggccgcgtggacaacgaccgtggagtggagtggggagtcggggaccgaaacccgtaacgtacgtgggtcgtacaacgtaggttcgtccttaccgaacccctacgttccccgtaccggggaacctacggtaacccttaacctacgtacgaaccccgtaaccggtaacccttccccgtaacctaaactaaaacccgaaccaaccgtacccctaacgtaacgttagggtaacggtttagggaacgggtacggtacccgtacgtaaccgtaaccgttaccgtacggaaccgtaccgacccggggtacccgttacgttaactttaccggtcggttacgacggtaacggtacccgttaccccgaacggtacggttacccgggtaggaacccggtcccgtaacgggccgtaacggtcccggttacccgtttcggttacccgttcgggtacccggggg

SEQ ID NO: 209075 - DNA, 634 bp, Homo sapiens
  misc_feature: GYAE6OF02FKR04.17.25.C03.1.454.CMB.1.raw
  modified_base (222)..(222): a, c, t, g, unknown or other
  misc_feature (222)..(222): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcccgtggggcctnagtgacggtctcctgcaaggccttcgtggattcacgtttacctctattagtatctaacgtgggtgccgccgaggcccgcgtcggaaccaacgacctggaacgtggagtggggatcggggaccaaccctaacgactggtgtcacgtagttcgtccttcacccatcccggtcggacacgtacctacctatacgacccgaccgtaacctccctaccgaactaaaaccaccgtagtacccctaagacgtacgggtacgtttggagggacgacctacgactacgtcgtacgaccgaccgaccgttaccgtccttattaccgtgtacgtcgaggaccgttacccgaggtaccgtccgggtcgaccgtcccgtaacgggccgacggtcccggtcgttttcggacgttccggtaccgggg

SEQ ID NO: 209076 - DNA, 688 bp, Homo sapiens
  misc_feature: GYAE6OF02HJ9VB.17.25.C03.1.454.CMB.1.raw
  modified_base (289)..(289): a, c, t, g, unknown or other
  misc_feature (289)..(289): n is a, c, g, or t
  modified_base (312)..(312): a, c, t, g, unknown or other
  misc_feature (312)..(312): n is a, c, g, or t
  modified_base (326)..(326): a, c, t, g, unknown or other
  misc_feature (326)..(326): n is a, c, g, or t
  modified_base (475)..(475): a, c, t, g, unknown or other
  misc_feature (475)..(475): n is a, c, g, or t
  modified_base (645)..(645): a, c, t, g, unknown or other
  misc_feature (645)..(645): n is a, c, g, or t
tcagcgtagactagcacgaccggtgctcgatttagtagtgtagatttgggtttgggggactcaacaaccacatctgtcctctagagaaaaccctgtgagcacacgctcctcaccatggacgtggacctgggaggactccctcgtttcgttcgggtgggccaggcgagctaacaagtgccccactcccaggtgcagctggtcgcagtcgtggggctggaggtgaagagccgtggggcctcgagtgaaggtcctccgtgcaaggtccttctggacttcgaccggtttaccnccgttaatagtatcgaagtgggntccgcagggcccgngtcggaccaacggcctggagtgagtggggattgggaccgtaacccgtagaccggtggtacgacacgtagtcgttcctaccgacccgtaacgtccggtacccgggactacgtaaccgttaccatccgaacccaacgtactaccccgtaanaaaccaaaccgacgtaacgacccgttaacgaggttacgggagtttacggaacgggtctacccgttagggtaaccctgttaccgacgggaacccggtacgtacccggggtacctttacccttaggttaccgtggtacggaccgtacgaccggtcctaacggtcgtaccggngacgtccgaaggcgacggtccgtccttcgtagtccggtacggg

SEQ ID NO: 209077 - DNA, 640 bp, Homo sapiens
  misc_feature: GYAE6OF02I26OF.17.25.C03.1.454.CMB.1.raw
  modified_base (245)..(245): a, c, t, g, unknown or other
  misc_feature (245)..(245): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcagtgaaggtctcctgcaaggcttnggtattcacgtttacctctatagtatacaacgtgggacgccgccgacggccgcgtggaccaaccggacctaggaggtaggagtggggatcggggaccgaaccctaacgacgttggtacgtaccacgtaggtcgtccttaccacccgtacgtcccgtaccgggactacgtacttaccgactcgaaccaccgtaacctccctaccaactaaaccaccacgacctaactagtcggtacggttagaggactccgtacgactactcgtacgacgtaccgacggacccgttatacgttacgtcgtacgcgacgtccgtaccgacggtccggttaccggtggacgcccggtacggacgtacggtccggttaccgtttacggtaccggttccgggtaccgggg

SEQ ID NO: 209078 - DNA, 639 bp, Homo sapiens
  misc_feature: GYAE6OF02F4FCI.17.25.C03.1.454.CMB.1.raw
  modified_base (372)..(372): a, c, t, g, unknown or other
  misc_feature (372)..(372): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcctggggcctcagtgaaggtctacctgcgaaggtcttcgtggattcacgtttacctcctatagtactcaacgtgggtgcgccaggccgctggaacaacgcctggagtggatggggatggggacaacccgtaacacgtggtcgtcgacagtgtattccacccntcccgtcggacagtacctaccatcgaccacgacctcctacaactaaacacacgtaccctacagtggtagttacggaggaccgtcctacggaactacgtccgttagaccggtacccgtaccggcccggtttaccttaagtttaaccgtggttccgacgtacggtacgtaccccggtacggtaacggtcccgggttaaggccggtacccgttaacgggacttacggtccccggttacccgttttaggtaccccttttccggtccggggg

SEQ ID NO: 209079 - DNA, 739 bp, Homo sapiens
  misc_feature: GYAE6OF02HOKCR.17.25.C03.1.454.CMB.1.raw
  modified_base (245)..(245): a, c, t, g, unknown or other
  misc_feature (245)..(245): n is a, c, g, or t
  modified_base (313)..(313): a, c, t, g, unknown or other
  misc_feature (313)..(313): n is a, c, g, or t
tcagcgtagactagcacgaccggtgctcgatttagtagtgtagatttgggtttggggacgtcaacaaccacatctgtcctctagagaaaccctgtgagcacagctcctcaccatggactggacctggaggatcctcttcttggtggcagcagctacaagtgcccactcccaggtgcagcgtggtgcagtcgtgggctggaggtgaagagccgtgggctcgagtgaggtctcctgacaggcttcgnggtacttctaacgtttacctcttatagtatacgaacgttggcgcgcaggccgctaggaccaacgctgngtaggagtgggagtcggaaccgaacctacaggtggtcgacacgtagttcgtccttaccactctcccggtacgggaacacgtaccttaccgattacggaaccctacgaaccctccctaacctaacgtaaaacccacgtaacgtacccgtaacgtacggtacggttaacgggttaggtaacgggaccgtaaccggtggtaaccgtacgtttaccgtacgggaacccggaacccgtacccgggggtaccctttaccgttaaggtttacccgttaggtaacccgggtaccggaaccggttacccggttaacccggttaccgggacccggtttacccgggtacgtaccccggttacccgtaacgggtacccggtaccggggtttacccgtaccgggtttttacggtacccggttacgggttacccgggggg

SEQ ID NO: 209080 - DNA, 760 bp, Homo sapiens
  misc_feature: GYAE6OF02JXEAS.17.25.C03.1.454.CMB.1.raw
  modified_base (307)..(307): a, c, t, g, unknown or other
  misc_feature (307)..(307): n is a, c, g, or t
tcagcgtagactagcacgaccggtgctcgatttagtagtgtagatttgggtttggggtacgtcaacaaccacatctgtcctctagagaaaaccctagtgagcacagctcctcaccatggactggacctggaggatcctcttcttggtggcagcagctacaagtgcccactcccaggtgcagctggtgcagtctgggctgaggtgaagaagcgtggggcctcgaggtgaaggtctccgtgcgaaggcttctggtattcgtacgtttacctcctattacgtatcaagttcgggtgcgaccgaggcccgntcggacaaccgaccgtggacgtgggagtggggacgtggggaccgtaaacccgtaacgaccgtgggttactccgaacgaaggttcgttacctttcccgacccgtaacgtcccgtacccggggaactaacggaaccctttaccacgttccgaacccgtaaaccgtaaacccttccccgtaaccgtaaaactaaaacccgaccgtaaccggtaaccccttaaaccaagggtttacgggtaaccgtttacgggaaacgggtacgcccgtttaaagacctaaccttacggacgaacccggtacgacccggggttccttaacgttaaccttcggttaacgcgggtaccggaaacgtccgttccccggaaacggcggtttaacccggtggacccgtaaccggtccggtaaccggacggtccgggttaacccttttggggtacccgttcgggtaccggggg

SEQ ID NO: 209081 - DNA, 647 bp, Homo sapiens
  misc_feature: GYAE6OF02HJ1HZ.17.25.C03.1.454.CMB.1.raw
  modified_base (276)..(276): a, c, t, g, unknown or other
  misc_feature (276)..(276): n is a, c, g, or t
  modified_base (459)..(459): a, c, t, g, unknown or other
  misc_feature (459)..(459): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagccgtggggcctcagtgaaggtctcctgcaggcttctggattcacgtttacctctatgtatcaacgtgggngcgccgaggccgcgtggacaccgacgtagaggtgagtgggagtcgggaccgtaaacccgtaacgacgtggtcgtaccaacgtagttcgtccttaccacccgactcccggtaccgggacacgtaccttaccagttacaaccgaccgtaaccctcccaacaaactaaaccacaacgtaccctaanacgtacgggtagttacggacggacgtacccgtagacacgttcgtacgaccgtaccgacccggttccgttacgttaacgtttcccgtagtacggacgacggtacctacccgacggtacggtccgggtagaacccgtccggtacggcgtaccggaccggttaccgtacgttaccggttcggaaccggggg

SEQ ID NO: 209082 - DNA, 622 bp, Homo sapiens
  misc_feature: GYAE6OF02HI6XS.17.25.C03.1.454.CMB.1.raw
tcagcgtagactagcacgaccggtgctcgatttagtagtgtagatttgggtttgggactcaacaaccaacatctgtcctctagagaaaccctgtgagcacagctcctcaccatggactggacctggaggtatcctcttcttggtggcagcagctacaagtgcccactcccaggtgcagctggtgcagtctgggctgaggtgaagaagcctggggcctcagtgaggtctcctgcaaggcttctggattcacgtttacctcctatagtatcaactgggtagcgccacggccgctgggtaccaacggacctggagtgggatggggatggggaccgaaacccgtaaacacgtgggtgtacacgagtgtacttcgacccactccgtaccgggacacgtacttaccgatacgaccacgaactcctcaataaacacacgcctaacgatacgggattaggaggtacgccgtagacatctaggaccgacgaccggccttacttaacttactaggtcgaccggtaggaccgttaccccgaacggtacgttcccgggtacgacggtacccccggttagggacccgtagggacccggtttcccgttttacgggtacctttcgggtaccgggggg

SEQ ID NO: 209083 - DNA, 776 bp, Homo sapiens
  misc_feature: GYAE6OF02FPISB.17.25.C03.1.454.CMB.1.raw
  modified_base (638)..(638): a, c, t, g, unknown or other
  misc_feature (638)..(638): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaaggaagccgtggggcctcgagtgaaggtctccgtgcaaggtcttcgtggtacttccgtaccgttttacctctaatagtactactaacgtggggtcgccggcccgggccgcgtacggaaccaaccgacctggagtggagtgggagtcgggaccgaaccctaacgacgtggtacgtacagtagttgtccttaccgaccctacgtcccggtaccgggaactaacggtaccttaaccgtacgtacgaacccgtaaccgtaaccttcccctaacctaaactaaaaccaccgaccgtaacccttaagtaacggttacggggtaacgtttacgggaacgggtaaccgtacccgttacgaaccgttacgtaccgttaacgggaaaccggtaacccggtacccgggttacccgtttaacgtttaacgtttttaacccggggnggttacggaaccggtaccgtaacccggttacccgtaacggtaccgggttaccggacggtacccgtaccggtaccggaccggtaccgggttacccggtttaccggtttaccggtaccggtttccgggaccgggtaccgg

SEQ ID NO: 209084 - DNA, 569 bp, Homo sapiens
  misc_feature: GYAE6OF02GDSKI.17.25.C03.1.454.CMB.1.raw
  modified_base (242)..(242): a, c, t, g, unknown or other
  misc_feature (242)..(242): n is a, c, g, or t
  modified_base (291)..(291): a, c, t, g, unknown or other
  misc_feature (291)..(291): n is a, c, g, or t
  modified_base (412)..(412): a, c, t, g, unknown or other
  misc_feature (412)..(412): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggagtatcctcttcttggtggcagcagctacaagtgcccactcccaggtgcagctggtgcagtctggggctgaggtgaagaagcctggggcctcagtgaaggtctctgcaaggcttntggattctacgttacctcctatagtatcaacgtgggtgcgccaggccgntggacaacgaccgtgacgtggatggggatcggggcgaaccctaacacgtggtgtcacagtgtccttcacccacgtcctccgggacacgtactacactcgaccacgactcctacaactaacncaacgcctaacgatggagttggaacggacgacctgacgatcgtaggaccgtacgccggtcctacttagttaaccgtggttacgctaggtacgtcccgacgtaccgtcggtacgacgtccgacggcgtacggccgttccttcgacgttcgtaccgggg

SEQ ID NO: 209085 - DNA, 663 bp, Homo sapiens
  misc_feature: GYAE6OF02I9Y6N.17.25.C03.1.454.CMB.1.raw
  modified_base (241)..(241): a, c, t, g, unknown or other
  misc_feature (241)..(241): n is a, c, g, or t
  modified_base (256)..(256): a, c, t, g, unknown or other
  misc_feature (256)..(256): n is a, c, g, or t
  modified_base (563)..(563): a, c, t, g, unknown or other
  misc_feature (563)..(563): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcgtggggcctcagtgagtctctgcaaggctcgngattcacgtttaccncctatagtatcaacgtggtgcgccacggccgctaggacaacgcctgagtggagtgggactggggaccaaacccgtaacgacgttagggtactactacgaggttcgtaccttacgacccctaagtcccggtaccggggaactaacggtaaccttacccgataccggtaacccaccgtaaaccttcccaaccgtaaactaaaccgtaaccaacgtacctaactaacggtacgtaggttacggaaggtacgtaccgtacgactacgtacgtacggaaccgtaccgaccggtccgttaactacgtttaacncgtcgtacgacgtacgtacccgaacggtccgtccgggtactacggtacccgttacggacgtaccgtccggttaccgtttcggtaccgttcggtaccgggg

SEQ ID NO: 209086 - DNA, 716 bp, Homo sapiens
  misc_feature: GYAE6OF02H0VP2.17.25.C03.1.454.CMB.1.raw
  modified_base (541)..(541): a, c, t, g, unknown or other
  misc_feature (541)..(541): n is a, c, g, or t
  modified_base (584)..(584): a, c, t, g, unknown or other
  misc_feature (584)..(584): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtggaacggtccctcgcgaggacgttcttcggtagttctacgtttaccttccttacttagtacttacacgttaggtggtcgccgtacgccggcgtcggtacgaacgaaccgtcgtaggtaggtagtggtaggtacgggtaccgggaaacccgtaaaccgtacgtcggtagtacgtacgacgtcgttcttaccacctacctccgttcccggaccgtacgtaaccgttacctaactcgtaaccgacctaaccgttaccctaccaacgtaaaaccaaccgtccaaccgtacaagttcgggtaggttacgacggagtcctnaacactcgtaggacaaccgtacggtacccttcgttaactttanaccggttggtacgaacggtacgtaccccgtaaccgcggtttaaccggccggtaggtaaccccgtacgggtccgaccggttacccggggttaccttttacccgggtagttccccgtacgggggttaacccggg

SEQ ID NO: 209087 - DNA, 682 bp, Homo sapiens
  misc_feature: GYAE6OF02HHTHL.17.25.C03.1.454.CMB.1.raw
  modified_base (246)..(246): a, c, t, g, unknown or other
  misc_feature (246)..(246): n is a, c, g, or t
  modified_base (295)..(295): a, c, t, g, unknown or other
  misc_feature (295)..(295): n is a, c, g, or t
  modified_base (380)..(380): a, c, t, g, unknown or other
  misc_feature (380)..(380): n is a, c, g, or t
  modified_base (624)..(624): a, c, t, g, unknown or other
  misc_feature (624)..(624): n is a, c, g, or t
tcagcgtagactagcacgaccggtgctcgatttagtagtgtagatttgggtttggggacgtcaacaaccacatctcgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggcctcgagtgaaggtctcctgcaggcttntggattcacgtttactcctaatgtatcaacgttgggtgccgccaggccncgtggaccaacgcccgtgacgtggcgtgggagtcgggaccgaaccctaacgacgtggtgtccacgtagtcgtccttccgaacccnctccgtaccggaactcgtaacctttaccgaatccgaccaaccggtaaaccctttcccgaccctaaattaaaccgacctaacgggtacccttaacaacggttaggtaaccggttggaaaccgggctacccgttagacctaacgtccgttacggaacccgtacgaaccggttcccttagttaaacgtttcccgtagggtaacgccgtaagggtacccttacccgtaagggtaactcccggggttanacccggacccttaacgggcttacgggccgttacctttcggtacgttaccggtcggggg

SEQ ID NO: 209088 - DNA, 718 bp, Homo sapiens
  misc_feature: GYAE6OF02I5URX.17.25.C03.1.454.CMB.1.raw
  modified_base (246)..(246): a, c, t, g, unknown or other
  misc_feature (246)..(246): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgccactcccaggtgcagctggtgcagtcgtgggctgaggtgaagagccgtgggcctcgagtgaaggtctcctgcgaaggcttcgnggtacttcacgtttacctccaattgtatcaacgtgggtcgcgtccgaggtccgcgtaggacctaaccgacctcggaggtcggtagtggggacgttcgggaccgaaaccctaacgacgtaggtcgtacgacgtagtggttacccttccgaacccgtacgtcccgtacgggactaacgtaacccttacgaacgttccgaaccccgtaaggttaaacccctccgtaaccctaaacttaaaacccacgaacgtacccgtaaacgacgttaacgggttacgttacgggaaagccgtacccgtagaaacgtacgtacgtacggaacccgtaccggaaccggtcccgttactttacggtaccttacggcggtaacgtaccggacgtccccggtaacgtaaccgggtaccggttcggaaccggttccgtaacccgcgtaaccgggtcctaacggttttcgaccggtttcggtacccgggg

SEQ ID NO: 209089 - DNA, 704 bp, Homo sapiens
  misc_feature: GYAE6OF02FLWE9.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctggggcctcagtgaaggtctcctgcaaggcttctggattcacgtttacctcctatagtatcaacgtgggtcgcgccgaggccgcgtcggacaacgacctgaggtggagtgggagtcgggaccgaaacccgtaacgtacgtggtacgtcgacgtaggttcgtcctttaccaccctacgtacccgtaccggggaactaacggtaccttaaccgtacgtacgaacccaacggtaacctccccgtaaccaaaacgtaaaaccaaccgtaacgtaccctaaacgagttacggggtaacgtttaggaacgggtaaccgtccgtagaaccgtacttccgtacgaacccggtaaccgacccgggttacccgttacctttaacgttaccgtcggtacgacggtacggtacctacccggacggtaaccggtccggtaggacccgtaccgtacgggaccgtacgggtacccggttccgttttacggaccggtttacgggtcccgggg

SEQ ID NO: 209090 - DNA, 619 bp, Homo sapiens
  misc_feature: GYAE6OF02FI5LE.17.25.C03.1.454.CMB.1.raw
  modified_base (262)..(262): a, c, t, g, unknown or other
  misc_feature (262)..(262): n is a, c, g, or t
  modified_base (347)..(347): a, c, t, g, unknown or other
  misc_feature (347)..(347): n is a, c, g, or t
  modified_base (440)..(440): a, c, t, g, unknown or other
  misc_feature (440)..(440): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttcgtggattcacgtttaccncctatagtatcaacgtgggtgcgccaggccgctggacaacgacctgagtggatggggatggggaccgaaccctaacgacgtggtntacactagtcgtccttccacccctatcccgtcgggacagtaccttaccatcgaccacgtaacctcccgtacaataaaccacacgtaccctaanagtagggtacgttaggaaggtacgtcctagaaccattccgtaggaaccgaccgacgggtcccgttacttaacgttacgtgtcgaccgtagtaccgtaccccgaggtacgtccgggtagaccggtaccgtaccgggcgtacggtcccggttaccgtttcggtaccgtttcggaccggggg

SEQ ID NO: 209091 - DNA, 574 bp, Homo sapiens
  misc_feature: GYAE6OF02ILMN7.17.25.C03.1.454.CMB.1.raw
  modified_base (221)..(221): a, c, t, g, unknown or other
  misc_feature (221)..(221): n is a, c, g, or t
  modified_base (333)..(333): a, c, t, g, unknown or other
  misc_feature (333)..(333): n is a, c, g, or t
  modified_base (419)..(419): a, c, t, g, unknown or other
  misc_feature (419)..(419): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctnagtgaaggtctcctgcaaggcttctggattcacgtttacctctatagtatcaacgtgggtgcgccaggccgcgtggacaacgacctggagtggatgggatgggcgaacctanacgtggtgtcacagtcgtcttacaccctatccgtcgggacagacttaccatcgaccacgaacctcctccaataaacacacgcctanacgtagagttgagacgcctgacatcgacgaacgacgtacgccgtctacgttaccgtggtcgacgtacggacgtcccgaacggtcgttcccggaggaccgacccgtaacgggcacggtcccggttccgttttacggacccgtttggtacccggggg

SEQ ID NO: 209092 - DNA, 634 bp, Homo sapiens
  misc_feature: GYAE6OF02GQ23C.17.25.C03.1.454.CMB.1.raw
  modified_base (452)..(452): a, c, t, g, unknown or other
  misc_feature (452)..(452): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgcaaggcttctggattcacgtttacctcctatagtatcaactgggtgcgccaggccgcgtcggacaacgacctgagtggagtgggatcggggaccaacccgtaacacgtggtgtcacgagtgtcttaccgacccatccgtccgggacacgtacttacagtacgaccaacgacctcctacaataaaacacacgacctacgatagggagttgagggtacnccgtagactattcgtaggaacccgacgaccgggtacccgttactttaacgtttaaccgtggttacgaccggtaacgtaccgtaccccgaaggtaaccgttcccgggtagaaccggtccccgttaacgggaccgtacgggtcccggttacccgttttggtaccccggtttggtaacccggggg

SEQ ID NO: 209093 - DNA, 603 bp, Homo sapiens
  misc_feature: GYAE6OF02G77D2.17.25.C03.1.454.CMB.1.raw
  modified_base (281)..(281): a, c, t, g, unknown or other
  misc_feature (281)..(281): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaacgtgggtncgccaggccgctggaccaacgacctggagtggagtgggagtgggaccgaaccctaacgacgtggtgtacacaggttgtccttacacccatcccgtacggacagtaccttaccatcgacccacgtaacctcctaccaataaaccacacgcctaacagtggagttgacggagcctagacactcgacgaaccgaccgacgggtccttacttaactttacgcggttacgacgaacgaccgttacccaacggtacgtcccgggttagaccggtacccgtacgggaccgacggtccggttaccttttcggactttccgggtacggggg

SEQ ID NO: 209094 - DNA, 601 bp, Homo sapiens
  misc_feature: GYAE6OF02JJ0ZC.17.25.C03.1.454.CMB.1.raw
  modified_base (345)..(345): a, c, t, g, unknown or other
  misc_feature (345)..(345): n is a, c, g, or t
  modified_base (430)..(430): a, c, t, g, unknown or other
  misc_feature (430)..(430): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcagtgaaggtctcctgcaaggcttctggattcacgtttacctcctatagttatcaacgtgggtcgcgccgagggccgcgtaggacaaccgacctggagtggatggggatcggggaccgaaccctaanacgtggtcgtcacgtagtgtacttcacccatcccgtaccggacacgtaccttacagtcgaccacgacctcctaccaactaaaccncacgcctaacagtgggagttgagacgcctagacacgttcacgaccgacgtacggccggttacttaacgttctcggttcgacggtacgtacgtacccgacggtacggtcccggtaggccgtaccgtaccgggacgacggtcccggttcctttggaccgtttcggaccggggg

SEQ ID NO: 209095 - DNA, 657 bp, Homo sapiens
  misc_feature: GYAE6OF02J1VET.17.25.C03.1.454.CMB.1.raw
  modified_base (184)..(184): a, c, t, g, unknown or other
  misc_feature (184)..(184): n is a, c, g, or t
  modified_base (195)..(195): a, c, t, g, unknown or other
  misc_feature (195)..(195): n is a, c, g, or t
  modified_base (238)..(238): a, c, t, g, unknown or other
  misc_feature (238)..(238): n is a, c, g, or t
  modified_base (278)..(278): a, c, t, g, unknown or other
  misc_feature (278)..(278): n is a, c, g, or t
  modified_base (485)..(485): a, c, t, g, unknown or other
  misc_feature (485)..(485): n is a, c, g, or t
  modified_base (540)..(540): a, c, t, g, unknown or other
  misc_feature (540)..(540): n is a, c, g, or t
  modified_base (630)..(630): a, c, t, g, unknown or other
  misc_feature (630)..(630): n is a, c, g, or t
tcagcgtagactagcacgaccggtgctcgatttagtagtgtagatttgggtttggggacgtcaacaaccacatctgtcctctagagaaaaccctgtgagcacagctcctcaccatggactggacctggaggatcctcttcttggtggcagcagctacagtgcccactcccaggtgcagctggtncagtctgggcngaggtgaagagcctgggcctcagtgaggtctcctgcaggtctntggattcacgtttacctctatagtataccgactggggtcncgcccgaggcccggctacggtaccaaccggtacctggaacggtggagtgggacgcggggtaccgaaccctaacgtacgtggtactaccgaggttacgtggttaccttacccggaaccccagtttcccgtaccggggtaacaaccggttacctttacccaagttacgaaccctaacggtacccttacccgtaacaaacgttaaacccnccgtaacgtacccttaaaccgagttcgggaacggtttacgaacgggacttacccngtaacctacgttcgacgacggtaaccaccggtcttcttaaacgtgtcgagcctacggatcccctaggacgtccgtgaacgcccgtaggcncggtccgtatttcgaccgttcgtcggg

SEQ ID NO: 209096 - DNA, 813 bp, Homo sapiens
  misc_feature: GYAE6OF02I0N6Y.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtcgcagcgtgggtgcagttccggtggggctggtaggtaggaagaacggccgttggggcctcgaggtaggaaggttctccgtgacgaagggtccttcgtagggtacttccgttaaccgttttaccctaccgttattaaggttactacgtaacgtggggttcgcccggtaaccgcggggtacccgtcgtacggaacccgtaaccggtacccgttagggaacggttgggaacggttgggggtacggtaccggggaaacccgtaaccccgtaaacgtaccggtgggtaacctcgacgtacggttccgttcttacccgaacccgttcgtcccggtaacggactacgtaaccttacccgagtaccgaaccgaccgtaacctaccgacctaaacgtaaccacgacgtacctagtacgtagggtagtcggaacgggctaccgtacgtacagttacgtcgtaaccgtacgtacccggttacgttaccgttaacgtttaccgttaggtaaccgtacggtaaccggtacgtaacccccggtacggtaaccgggttaacccgtgggtaaaccccgtaccgtacccggggtaaccgtacccgggttccggtttacccgtttaaccgggttaccggtttcgggaccccggggg

SEQ ID NO: 209097 - DNA, 777 bp, Homo sapiens
  misc_feature: GYAE6OF02G2K6N.17.25.C03.1.454.CMB.1.raw
  modified_base (291)..(291): a, c, t, g, unknown or other
  misc_feature (291)..(291): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaaggcttctggattcacgttttacctcctatagtatcaacgtgggtgcgccaggccncgtggacacgacctgagtggagtgggatcggggaccgaaacccctaacgaccgttggtcgtaccacgtagtcgttccttaccaacccctacgttcccgtacccggggaacctacggtaccctttaacccgagttaccgaaccccgtaacggtaaaccccttccccgtacccgtaaaacttaaaacccgaaccgtaaaccggtaccccttaaaaccgacggtttaacggggtaacggttttaacgggaacggggttaaccggtcccttaacgggaaaccctacgttacccggttagggaaaccccggtaaccgtaacccgggggtccccggtttaactttaaacgtttacccggttggtaccgggtaccgaacggtaccgttacccccgaacggtccgttcccgggtaaggacccggttcccgtaaccggggcctaacgggtcccggttacccttttcgggtaaccgtttcccgggtaaccgggggg

SEQ ID NO: 209098 - DNA, 561 bp, Homo sapiens
  misc_feature: GYAE6OF02F5TLP.17.25.C03.1.454.CMB.1.raw
  modified_base (303)..(303): a, c, t, g, unknown or other
  misc_feature (303)..(303): n is a, c, g, or t
  modified_base (343)..(343): a, c, t, g, unknown or other
  misc_feature (343)..(343): n is a, c, g, or t
  modified_base (352)..(352): a, c, t, g, unknown or other
  misc_feature (352)..(352): n is a, c, g, or t
  modified_base (369)..(369): a, c, t, g, unknown or other
  misc_feature (369)..(369): n is a, c, g, or t
  modified_base (382)..(382): a, c, t, g, unknown or other
  misc_feature (382)..(382): n is a, c, g, or t
  modified_base (422)..(422): a, c, t, g, unknown or other
  misc_feature (422)..(422): n is a, c, g, or t
  modified_base (434)..(434): a, c, t, g, unknown or other
  misc_feature (434)..(434): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcgagtgaaggtctccgtgcgaaggtcttctggtattcaccgtttaccctcctataagtactcaactgggtgcgccaggcccgntcggaccaacgcctgagtggatgggatgggccaaccctanacgtggtcncgacagtgtctcacccntccgtccgggacncgtaccttacagtcgaaccgacgaacctccacaataaacncacgtacctacngtggagttgagtacgcctagacagttcagacgacaccggctgtacttacgtgtacacgtagactcccgagtacgtccgggtagaccgaccgtacggcacggtcggtaccgtttgaccgttggcgggg

SEQ ID NO: 209099 - DNA, 639 bp, Homo sapiens
  misc_feature: GYAE6OF02F583E.17.25.C03.1.454.CMB.1.raw
  modified_base (284)..(284): a, c, t, g, unknown or other
  misc_feature (284)..(284): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctggaggtgaagaagccgtggggtctcagtgaaggtctccgtgcaaggcttctggattcaccgtttacctcctatagtatcaacgtgggtncgccaggcccgcgtcggacaacgacctggaggtggatggggatggggaccgaacccctaacacgtgggtctacacgagttcgttccttccaacccctattcccgtaccgggaacacggtaccttaacccagtcgaacccaacgtaaccctcctaccaaataaaacccacaacgtacctaacagtgggagttgaacgggtactccgtaggacctgttccgtaggaaccgaccgtaccgggccctttatacgtttactggtacggtacgagtacgttaccccgacggtacgtcccggtagaccggtacctaaccgggcacggtcccggttccgtttcgaccgttcgggtaccggggg

SEQ ID NO: 209100 - DNA, 764 bp, Homo sapiens
  misc_feature: GYAE6OF02IQN2O.17.25.C03.1.454.CMB.1.raw
  modified_base (309)..(309): a, c, t, g, unknown or other
  misc_feature (309)..(309): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagagccgtggggcctgagtgaaggtctcctgacgaaggtcttcgtggtacttcgtaccgtttacctcctattagtactacgaacgtgggtcgcgccaggtcccgngtacggaacaacgcctagaggtggagtgggacgtacgggaccgaaaccctaacgtacggtggtacgtcgaacgtagtcgttccttaccgaacccgttacgtccccggtaccgggtaactacggtaaccctttaaccgacgtaccggaaccctaacccgtaacccgttaccctaacctaaaccgtaaacccacgaaccgtacccctaaagtacgttacggtaacgggttaacggacggtaaccgtcctaacggaacctacgttacccgtaaggaacccggtaacccgtaccggggttacccttacgtttaaacgttaccgggtacgtaccgggaacgtaacggtaccccgtaccccggtaacggtaccgggtaccggttacggaacccgggacccgttacgggaccgtacgggtacccggttacccgttacggtttaccggtccgggtacccgggg

SEQ ID NO: 209101 - DNA, 667 bp, Homo sapiens
  misc_feature: GYAE6OF02FUNBV.17.25.C03.1.454.CMB.1.raw
  modified_base (245)..(245): a, c, t, g, unknown or other
  misc_feature (245)..(245): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcaggtgaaggtctcctgcaaggcttntggattcacgtttacctctatagtatcaacgtgggtgcgcctaggcccgctgggaccaacggacctggagtggagtggggatcggggaccgaaaccctacgaacgttgggtcgtacaacgtaggtcgttccttaccaccccgtattcccgtacccggggacaacggtaccttaaccatcgaacccacgtaacctccctacctaaacgtaaacacgacgaccctaacgagtacggtaggttacggaacggtacgtacccgtagaacctagttcctaggaccgtaaccgaccgggtcccgttacgttaacgtttcgtacgtcggacgtacggtaccgtacccgaacggtcgtcccggtaggtaaccggcccggttacggacgtacggtcccggttccgtttggtacccgtttcgggtaccgggg

SEQ ID NO: 209102 - DNA, 533 bp, Homo sapiens
  misc_feature: GYAE6OF02F2J8S.17.25.C03.1.454.CMB.1.raw
  modified_base (260)..(260): a, c, t, g, unknown or other
  misc_feature (260)..(260): n is a, c, g, or t
  modified_base (279)..(279): a, c, t, g, unknown or other
  misc_feature (279)..(279): n is a, c, g, or t
  modified_base (314)..(314): a, c, t, g, unknown or other
  misc_feature (314)..(314): n is a, c, g, or t
  modified_base (342)..(342): a, c, t, g, unknown or other
  misc_feature (342)..(342): n is a, c, g, or t
  modified_base (396)..(396): a, c, t, g, unknown or other
  misc_feature (396)..(396): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
  modified_base (417)..(417): a, c, t, g, unknown or other
  misc_feature (417)..(417): n is a, c, g, or t
  modified_base (423)..(423): a, c, t, g, unknown or other
  misc_feature (423)..(423): n is a, c, g, or t
  modified_base (441)..(441): a, c, t, g, unknown or other
  misc_feature (441)..(441): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttaccnctatagtatcaactgggtncgcaggccgctggacaacgcctgagtggatgggangggcgaaccctagactggtgtcacagtntcttcacccatccgtcggacagacttaccatcgaccacgactcctacataaacncancctanatggattgaggcnctgacngtctagacacgacgcctntattactgtgacgtagaccgtcccagtactccgggtagtacgtaccgtacggctacgggtcccggtccttttacggaccttcggtaccgggg

SEQ ID NO: 209103 - DNA, 703 bp, Homo sapiens
  misc_feature: GYAE6OF02GUZYR.17.25.C03.1.454.CMB.1.raw
tcagcgtagactagcacgaccggtgctcgatttagtagtgtagatttgggtttttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagcctggggcctcgagtgaaggtcctccgtgcgaaggtcttcgtggattctacgtttacctctaatagtatcaacgtgggtgcgccgaggcccgcgtcggacaaccgacctggaggtcggagtgggagtcgggaccgaaacccgtaacgacgtggtcgtacacgtagttcgtcttaccgaccctacgtcccgtaccgggacacgtaaccttaccgacgtcgaacccgtacgtaaccctcccgtaacctaactaaaaccacaacgtaccctaacgaacgtcgggtaacgttaggacggaacggtcccgtagtaacctacgttctacggaaccgtaaccgtacccgggtaccgttactttaaccgtttaaccggtcggttacgaaccgggtacgtacccgtccccgaaccgggttaccggttacccgggtaagacccgtacccggtacggacctacgggtcccggttcttttacggaccggttccgtaccggggg

SEQ ID NO: 209104 - DNA, 728 bp, Homo sapiens
  misc_feature: GYAE6OF02H72S5.17.25.C03.1.454.CMB.1.raw
  modified_base (323)..(323): a, c, t, g, unknown or other
  misc_feature (323)..(323): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtagaagagccgtgggcctcgagtgaaggtctcctgcaaggtcttcgtggtatttcacgtttacctccttatagtactcaacgttgggtcgcgccgtacggccgcgtaggaccaacgtaccnggagtggagtggggatcggggaccaaacccgtaacgacgttggtcgtacacgtagtcgtccttccaccctagtcccgtccgggaactagtaccttaccgataccgaacccaacgtacctcccgtaacctaaataaacccacacgtaccctaaccgtagtacgggtaacgttggaaggtacgtaccttagacctaacttccgtaacggaacccggacccgaaccggggttcccgttacgtttaaacgtttaccgttcggtaccgggtaccgtaccggtaacccgtacccccgtaacggtcccggttacccgggtacggtaacccggttaacccgtaccgggtacccgacgggtccccggtttacccggttttaccggtaccccggtttccggggtaaccccggggg

SEQ ID NO: 209105 - DNA, 743 bp, Homo sapiens
  misc_feature: GYAE6OF02JB0KT.17.25.C03.1.454.CMB.1.raw
  modified_base (250)..(250): a, c, t, g, unknown or other
  misc_feature (250)..(250): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctggaggtgaagaagcctggggcctcgagtgaacggtcctccgtgcaaggtcttcgnggtacttcgtaccggttttacctcctaattagtactccgtaaacgttcggggtgccggacccacgggtcccgcgtacgggtaaccaaaccggtcccttagggacggtcgggtagtacggggaagttccgggggaccgtaaaccccgttaacgaccggttagggttacgtaccaaccgtaggtttcgtccttaccaaccccgtattcccggtaccggggacctaacggtacccttaccgaagttccgaaccctaaccgtaaccctcccgtaacctaaacctaaacgacctacggtaccctacgaggttacgggacgttacgaagcgtacctagaacctagtaccgttaaggacccgacgtacccggttccgtactttacgttagtcggtacgacggtaccgtaaccgtccgtaacgtcggttaccggtagtacccgtacccgttcggaccgtcggtacccggttcgtttacggtaccgttccgggtaccggggg

SEQ ID NO: 209106 - DNA, 619 bp, Homo sapiens
  misc_feature: GYAE6OF02JVO86.17.25.C03.1.454.CMB.1.raw
  modified_base (252)..(252): a, c, t, g, unknown or other
  misc_feature (252)..(252): n is a, c, g, or t
  modified_base (270)..(270): a, c, t, g, unknown or other
  misc_feature (270)..(270): n is a, c, g, or t
  modified_base (359)..(359): a, c, t, g, unknown or other
  misc_feature (359)..(359): n is a, c, g, or t
  modified_base (369)..(369): a, c, t, g, unknown or other
  misc_feature (369)..(369): n is a, c, g, or t
  modified_base (454)..(454): a, c, t, g, unknown or other
  misc_feature (454)..(454): n is a, c, g, or t
tcagcgtagactagcacgaccggtgctcgatttagtagtgtagatttgggtttggggacgtcaacaaccacatctgtcctctagagaaaaccctgtgagcacagctcctcaccatggactggacctggaggatcctcttcgttggtggcagcagctacaagtgcccactcccaggtcgcagtctggtgcagtcgtggggctaggaggtgaagaagccgtggggcctcagtgaaggtctccgtgcaggcttcnggattcgacgttttaccnctatagtatccgacgttgggcaccgccgacggccgcgttagggaacctaaccgcctggagtggactggggactcggggacaacccttanacgttggtcncacagttgtaccgttcacccgtgtcccgtaccgggatacggtaccttacgatccgaccacgaccctccgtaccaactaaccgacncgtaacctacgacgtaggagttacggagtacgtccgtataccgatcgtacgacgaccgaaccggtccgtaccttagttacgtggtacgacgtcgacgttccacggtacgtccgtagaccgccgtagccgtcgaccggttcccgtttaggtaccgttggaccgggg

SEQ ID NO: 209107 - DNA, 939 bp, Homo sapiens
  misc_feature: GYAE6OF02HXL0G.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacagtgcccactcccaggtgcagctggtgcagtcgtggggctggaggtgaagagcgtgggcctcaggtgaggtctccgtgacaggtcttcgtaggtacttctaaccgttttcctacttagtagttatcgaacgttggggtcgccggccgtacgggccggtcgtacgggaaccaaaccggtacctggtaacggtggaggttggggagtacggggaccctaaaccccgtaaacgtccggttgggttacgtaccgtacgtaacgttcgggttcctttacccgaccccgttaccgttaccccggtaccccgggggtaataaccggtttaaccccgtttaacccgacggtttaacccgggaaaccccccgtaaacggttaaaccccctttaccccgttaaacccgttaaaaaccctaaaaacccgaccgttaaacccggtaacccccttaacgtaaacgggtttcgggtaaacccgggtttaggggaaacccggggtaccgttaccccgggttaggaaaccctttaccgggttaccgttaaaacccgggggtaccggaaacccggtaccggggtaaccccgttttaacgggttttacccgtttaaaaccggtttcggttaacgggaccgggtaccgggtaaaaccggttcccccgggttaacccggaaaccgggttaaccggggtttcccgggtacggtaacccgggttaccccgggaacgggggccccgttaaaccggttccccggggtttttaccgtttacccgggaacccggttttaccccgggggg

SEQ ID NO: 209108 - DNA, 977 bp, Homo sapiens
  misc_feature: GYAE6OF02HVF5S.17.25.C03.1.454.CMB.1.raw
tcagcgtagactagcacgaccggtgctcgatttagtagtgtagatttgggtttggggactcaacaaccacatctgtcctctagagaaaaaccctgtgagcacagctcctcaccatggactggacctggaggatcctcttcttggtggcagcagctacaagtgcccactcccaggtgcagctggtgcagtctggggctggaggtgaaagaagccgtggggcctcgaggtgaaggtactccgtgacgaaggctttctggtaatttccgtaaccgtttttaaccctacccttaagtaaggttaactacctaaaaccgttggggttacggaccggtacccgaaacgggccccggtcgtaacggggtaaccgaaaaccggtaaccccgttacgggaaggttacgggaaggttacgggggaagttacgggggaacccgtaaaaccccgttaaaacgaaccggttgggtacggtacctaacgtaaggtcggttacctttacccaaacccccgtaagttcccccggtacccggggtaaacctaaacggttaaacccgtttaacccgtaacgttacggaaacccctaaacccggtaaacctttaccccgtaccccgtaaaaactttaaaacccgaaacgaaaccggttaaccccgtaaaccgtaacggttacgggtaaaggtttacgggaaacggggtacgtcccggttaaacggtaccaagttccgtaaacggaacccggtaaccgtaacccggggttaccccgttaacgtttaaacgttttaaccgtacggttacgggtaacccgtaagggtaacccgttacccccgggtaaacccggtaacggtttaacccccgggggtaaggtaaacccgggttacccccggttaaaaccggggaccccggttaaccgggggtacccggggttttaaccccgtttttaacccgggtaccccggtttttcccggggttaacccccgggggggg

SEQ ID NO: 209109 - DNA, 683 bp, Homo sapiens
  misc_feature: GYAE6OF02FK6TC.17.25.C03.1.454.CMB.1.raw
  modified_base (353)..(353): a, c, t, g, unknown or other
  misc_feature (353)..(353): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgttacctctatagtatcaacgtgggtgcgccaggcccgcgtcggacaacgaccgtgagtggatgggatggggacctaacccgtaactacgtggtgtcacgngttcgtccttaccgaccctacgtcccgtaccgggactaacgaccttaaccgactacgaacccaacgtaaccctccctaccaaacgttaaaacccacgaacgtaccccttaacgaagttacgggtaacggtttacggaaacggggtaccgtaccctagggtaaccctagtttacccgtagggaaaccccgttacgacccgggttacccgttaacgtttaacgttaccgtggttcgaccgtagtaccgtaccccgaggtaccgttccgggtaagaccgtcccgtaacgggctacgggtccgttacccgtttcgaccgtttcgggtaccgggg

SEQ ID NO: 209110 - DNA, 679 bp, Homo sapiens
  misc_feature: GYAE6OF02HJZYV.17.25.C03.1.454.CMB.1.raw
  modified_base (245)..(245): a, c, t, g, unknown or other
  misc_feature (245)..(245): n is a, c, g, or t
  modified_base (273)..(273): a, c, t, g, unknown or other
  misc_feature (273)..(273): n is a, c, g, or t
  modified_base (515)..(515): a, c, t, g, unknown or other
  misc_feature (515)..(515): n is a, c, g, or t
  modified_base (586)..(586): a, c, t, g, unknown or other
  misc_feature (586)..(586): n is a, c, g, or t
  modified_base (643)..(643): a, c, t, g, unknown or other
  misc_feature (643)..(643): n is a, c, g, or t
tcagcgtagactagcacgaccggtgctcgatttagtagtgtagatttgggtttggggtacgtcgaacaaccacatctgtcctctagagaaaccctgtgagcacagctcctcaccatggactggacctgggaggactcctcttcttggtggcagcagctacaagtgcccatcccaggtcgcgagcgtggtgcagtctgggggctggaggtgaagtaacgcgtggggcctacagtgaaggtctccgngcagggcttcgtggacttcacgtttccnctatagtatcaacgttgggtgcgtaccgacggccgtcgtacggaaccgaacggtacccgtaggtaggtacggtacggtagggggagtacggggaccggaaaccccgttaaacgaacgtcgggttgtacccgaagtaacggtccgttacttcgaaccctcacgtccccgtacgggaacagggttccttaacgagttcgaaccgtacgaaaccttctacctactaaaccaactacgacctaacngtaacgtaggttacgagtacgcgtagactaacgtcgtagaccgacgtaccggaccttcgtaacgtttaccngggttacaccggtagaccgtccgaaccggtacgtaccggtggaccgtccgtaccggngaaccggttcccggtcgtttccggtacttcccgggg

SEQ ID NO: 209111 - DNA, 696 bp, Homo sapiens
  misc_feature: GYAE6OF02GQ5CC.17.25.C03.1.454.CMB.1.raw
  modified_base (320)..(320): a, c, t, g, unknown or other
  misc_feature (320)..(320): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatcgaccctagtcctccactccctccctgtctcgtcctcgtgggtgggggtcagacgtaccaccatcctacgttcgaccggaacaacggtccgaaccggtaaccgtttaaaaccttaattttaaagttggtactacagtacaacgtaaaccgtacgggaaaaccnccccgaagaccctccgtagtactcgtcgtggtcacactccactcgtggacgtagtcggccctcctagtcgtacggtctaggtggactagggtagcgtacggtggactagtttacttacacttcctaccactaccaccctaacctactccgtacgacctacggtagtagttacgttacgcgtaactacgttacctaacttacgtacgtaaccaaggtacgttaacctttacccgtacccgttccccgtagtacccgtttacggttaccgggaaccggtaacgggtaacttacggtagaacgtaaacgtaaccgtaaacggttcggtacgttcggtacctaacggtaccctaacgtttaccgttcgttcgtttaaccg

SEQ ID NO: 209112 - DNA, 786 bp, Homo sapiens
  misc_feature: GYAE6OF02F78F5.17.25.C03.1.454.CMB.1.raw
tcagcgtagactagcacgaccggtgctcgatttagtagtgtagatttgggtttgggggacgtcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgagaagctggggctcagtgaggtctctgcaaggcttcgtaggactttacctacgtttaccctaccttagtaagttacttacaacgttcgggtcggccgtcccggacgggcccgcgttacggaacaaacccggaccttcggaacggttgggaggtaggggacggttacgggggacccggtaaaaccccttaacgaaacggttcggggttaacgttccgtaaaacggtaggttccggttacctttaccgaccccgtaacgttcccgtaacccggggtacgaaacccggttaaccttaaaccggtaacttaccggaaccccgtaaccggtaaacccttcccgtaacccctaactaaaaacccgtaccgaacggtaaccctaactacggttaagggtacgttcggtaaacgggacgtacccgttaacgactaacggtccttacgggaaccgttaccgaacggttacccggttaacttaacgttcgtagccggttacgacgtaaccctcccggacgtaccgggtacgtccgacgtacccggtacgacggacgttccgggttcctttacgggtaccttccggtcggggg

SEQ ID NO: 209113 - DNA, 633 bp, Homo sapiens
  misc_feature: GYAE6OF02JPL6V.17.25.C03.1.454.CMB.1.raw
  modified_base (298)..(298): a, c, t, g, unknown or other
  misc_feature (298)..(298): n is a, c, g, or t
  modified_base (348)..(348): a, c, t, g, unknown or other
  misc_feature (348)..(348): n is a, c, g, or t
  modified_base (475)..(475): a, c, t, g, unknown or other
  misc_feature (475)..(475): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgaggtagaacggtcctccgtgacgtaaggcttcgtggtacttctacgtttacctctatagtatcgtacgtgggtcnccgtcgaggtccgcgtaggacacgtaccgtggacggtagaggtgggacgngggaccgaaccctagaccgtggtcgtacacgtagtctctaccacctacgtcccggtacggactacgtacctacagtacgacctacgactcctacaataacacactctatagtggtagtgacggtacnccgtgacgtacgtacgtaccggaaccgcgtaccggtacgttccttaacgttacgcggtacggacgtcggtacccgtccggtaacgtacgggtccggttagaccggtccggtaaccggtcgacggtccggttaccgttcggtaccgttgggtaccgggg

SEQ ID NO: 209114 - DNA, 568 bp, Homo sapiens
  misc_feature: GYAE6OF02HI0XB.17.25.C03.1.454.CMB.1.raw
  modified_base (306)..(306): a, c, t, g, unknown or other
  misc_feature (306)..(306): n is a, c, g, or t
  modified_base (561)..(561): a, c, t, g, unknown or other
  misc_feature (561)..(561): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtcctgcctctgtggggtcagagtcacctatcacttgccggacagtccacggtcgttaaaacctatttaaatggtaatcagcaagaacctaggaaaacgcccctagacctcctgactctctggtcnctactccactctgcgaagtcggccgtccatcggagttcagtgcagtggatcgtggaccagctttacaagttctacaccgtatccactctctagcctaaccgtgacggtattggcactaacgtctactactgtacaaacgtagacgttaactaccgttccccgtacgcttaccgtttagcccggtaagggttacctaagttcgaagaccttaacgaaaccgacgttacgtcggcttacgccttaaccagttccgtnttacccg

SEQ ID NO: 209115 - DNA, 709 bp, Homo sapiens
  misc_feature: GYAE6OF02IOHMF.17.25.C03.1.454.CMB.1.raw
  modified_base (303)..(303): a, c, t, g, unknown or other
  misc_feature (303)..(303): n is a, c, g, or t
  modified_base (371)..(371): a, c, t, g, unknown or other
  misc_feature (371)..(371): n is a, c, g, or t
  modified_base (377)..(377): a, c, t, g, unknown or other
  misc_feature (377)..(377): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaaagaagccgtggggcctcgagtgaaggtctccgtgactaaaggcttacgtaggtactttcgtaacgttttaacctcctaatagtactcaaacgtgggtnccgccaagggcccgataggaacaaccggacctggaaggtggatggggatggggacaaacccgtaaacngtggtnacatagtgtcttcaccctaagtccgtacgggactaggaaccttacatcggaaccaacgaaaccgttcccaacctaataaaaaccaccaacgtaccctaagacgttaggtaacgttaggaacgggactacctaggtaacaacttcgttacggaacccgaaacgtaccgggacccgtttataaacgtttacgtaggttaccgaacgggtaacgacccgggtttaacccgacgggtaaacgttacccgggtaggtaacccgttcccggaaaaccggtcgaaccggggtcccggtttaccccgttttaggtacccgtttaccgggtacccgggggg

SEQ ID NO: 209116 - DNA, 684 bp, Homo sapiens
  misc_feature: GYAE6OF02IOAEP.17.25.C03.1.454.CMB.1.raw
  modified_base (188)..(188): a, c, t, g, unknown or other
  misc_feature (188)..(188): n is a, c, g, or t
  modified_base (238)..(238): a, c, t, g, unknown or other
  misc_feature (238)..(238): n is a, c, g, or t
  modified_base (316)..(316): a, c, t, g, unknown or other
  misc_feature (316)..(316): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccgaggtgcagcgtggtgcngtcgtgggctggaggtagaagaacgccgtgggcctgagtgaaggtctcgngacgaggtcttcgtggtacttaccgtacgtttacctctagtagtactacgtaacgtgggtcgccgaccgacggcccgngtcgaaccaacgctaggaggtagaggttgggaagtcggggaacctaaaccgtaacgtcgtggttacgaccacgtaggttcgtacttaccaacccgtacgttccggtacggactacgtaaccttaccagtacgaaccctaacgtaacctccctaaactaaacaaacccacgaacttacccgtaaagaggttacggaagtttacggaggtaccgtacctacgactacgttcgacgaaccgtacaacgttccgtaccgttatacttacgtggttacgacggtacgtaccgtacccggtagtacggttaccggtagacccggtactaaccgggcgtaccggtccggttaccctttaggtacccttaccgggg

SEQ ID NO: 209117 - DNA, 742 bp, Homo sapiens
  misc_feature: GYAE6OF02HBHJI.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctgaggtgaagaagccgtggggcctcaggtgaaggtcctccgtgcgaaggtcttctggacttcgtaccgtttacctcctatagtatacaacgtgggtgcgcgacggccgcgtacggaaccaacgaccgtggacgtggagtgggagtagggaccgaaaccccgtaacgaacgtcgggtacgtcctaacgagttcggtccttaccaaccccgtacgtacccgtaccgggtaacgacgtaccgttaccgacgtacgaaccctaaccggaaccttcccgtaaccaactaaaaccacgtacctacctaactaacgtgggtaacgttggaacgggtacgaccgtacgaactacgtcgtacggtaaccgtacggtacccgggacccggtttaacttaacgtttaacggttacggtcggtaacggtaccggtacggtacccccaacgggtacggttacccggggtacgtaacccggtacccggtaacggggtacccgtacgggttcccgggttacccgtttttacggtacccggtttaccggtaaccccgggggg

SEQ ID NO: 209118 - DNA, 594 bp, Homo sapiens
  misc_feature: GYAE6OF02HEJO6.17.25.C03.1.454.CMB.1.raw
  modified_base (282)..(282): a, c, t, g, unknown or other
  misc_feature (282)..(282): n is a, c, g, or t
  modified_base (334)..(334): a, c, t, g, unknown or other
  misc_feature (334)..(334): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactccccaggtgcagctggtgcagtctggggctgaggtgaagaagcctggggcctcagtgaaggtctcctgcaaggcttctggattcacgtttacctcctatagtatcaacgtgggtncgccaggccgctggacaacgacctgagtggatgggatgggacgaaccctaanacgtggtcgtcactagtgtccttcacccctatcccgtccggggactacgtacctttaccgagttacgaaccctaacgtaacctccctaccaataaaaccaccagccctaacagtcggagttcgaggtcgcctgaactgtctggaccgacgacgggtccgtacttaattacgtgtgaccgtagaccgtacccacggtacgtcccggtgacggtcccgtacggctacgggcccgttccgttttaggaccgtttggaccgggg

SEQ ID NO: 209119 - DNA, 792 bp, Homo sapiens
  misc_feature: GYAE6OF02JNAN7.17.25.C03.1.454.CMB.1.raw
  modified_base (242)..(242): a, c, t, g, unknown or other
  misc_feature (242)..(242): n is a, c, g, or t
  modified_base (289)..(289): a, c, t, g, unknown or other
  misc_feature (289)..(289): n is a, c, g, or t
tcagcgtagactagcacgaccggtgctcgatttagtagtgtagatttgggtttggggacgtcaacaaccacatctgtcctctagagaaaaccctagtgagcacagctcctcaccatggactggacctggaggatcctcttcttggtggcagcagctacaagtgcccactcccaggtgccagctggtgcagtcgtggggctggaggtgaagaacgccgtggggccctcgagtggaagtcctcngacgaggtcttcgtgtacttcctaccgttaccttcctagtagttacncgtacgtggtgccgtccgacggccgtcgtaggaccaaccggacgtggacgtaggtcggtagggacggtcgggacccgtaaacccgtacgaccggttggtacgtcgaacgtaggttcgttccgttaccgtacccctaacgttcccggcccgggaacgacgtaacccttaacgacgtaccgaacccaaccggttaaccctacccgtaacctaaactaaacccgaacctaacggaccccttaaagtacgggacgggtttaacggttagggaaccggtacgtaaccgtaccgtactaaccttacggtaccggaacccgtaacccggaaccgggtttcccgttaacgtttacctttaaaccgggtgttaaccgtacgggaaccgttacccgaacccccggttagggtaacccgtttaccgggaccggtaacggtacccccggtaacgtcccgggtaacgtcccgggttttaccctttacggttaccccggttacggggtacccggggg

SEQ ID NO: 209120 - DNA, 760 bp, Homo sapiens
  misc_feature: GYAE6OF02GFPWI.17.25.C03.1.454.CMB.1.raw
tcagcgtagactagcacgaccggtgctcgatttagtagtgtagatttgggtttgggagtcagtctcagtcaggacacagcatggacatgagggtccccgctcagctccgtggggctcctgctactctggcctccgagctgccagatgtgacatccagatcgacccagtcctaccactccctccctgtctcgcctcgtggtgggggtacagtacgtccaccatcacttcgaccggaactaagtacgaaccggtaaccgttaaaaccttaagttttaaagttaggttactacagacaacgaaacgtaacggaaaacgacccgacgacctacctacgtactctcgtggtcgtctactcctactctcgacgtacgtcgtccgtacctacgtacggtacggttcgtaggtcccccccccccccccggtagtaggtacggtacgtcggtacgggtaacgtaagtaacttactaactacctacctaacctactacctacctacctacctaccgtaaccgtaaccgtacggtaacggttacgttacgtacgtaacgtaacttaccgttaaccgtaccgttaccgtaaccgtaaaccgtaacggttaaccgttaaccgttacccgtttaccccgttaccgttaccgttaccgtttaccggtaccgggtaaccgggtaaccgtaacgttaacggtaacgtaaacgtaaccgtaaaccgtaacgttacgtacggtaccgtacgtaccgtaccgtacgttacgttacgttac

SEQ ID NO: 209121 - DNA, 649 bp, Homo sapiens
  misc_feature: GYAE6OF02HHR59.17.25.C03.1.454.CMB.1.raw
  modified_base (450)..(450): a, c, t, g, unknown or other
  misc_feature (450)..(450): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagacgtcaccatcacttgccggacaagtcacggacgttaaaacctatttaaattggtatcagcagaaacctggaaaacgccccagaccctcctgatctcgtggtgcactccactcgtgcgaaggtcggccgtcccagtcggaggttcaggtggcaggtcggatcggtagggaactagtaactttcgaattcctacgaaccctatcccgaacctacgttacctacggacctaaaccgtagggaagtattcggtntaactaacttaccttaaccttacgttacgtaaccaaacgtaacgttaacgtttaaccgccgtttacccctacgttaccgttacgttttccgggaccgtaacggggtaacctaagggttgaacgtaacgtaaccgtaaaacggtaacgttaggtaccggtaccgtcgaacccgtaccgtacgtttccgttacgttacccg

SEQ ID NO: 209122 - DNA, 719 bp, Homo sapiens
  misc_feature: GYAE6OF02GC79H.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcgagtgaaggtctctgcaaggcttctggattcacgtttacctctatagtatcaacgtgggtgcgtccgagggccgcgtacggaccaacgaccgtggaagtgggagtcggggagtcgggaccgaacccgtaacacgtggtacgtcgactaggttcgtcccgttacaaccccgtacgtcccgtaccggggaactaacggtacctttacccgtaacgtccgaaccgtaacccggtaaacccttaccccgtaaccctaaacttaaaaacccgaacccgtaaacgtaccccgttaaaccgtaacggttacggggtaacggtttaacggaacgggtaacgtacccgtagtaaccgtaacgttacgttacggaaccgtaccgacggtacccgttacttaacgttaccgtggtacgacgtacgaccgttaccgacggtaaccgtaccggtacgtacggtacccgttaccggccgtacggtcggtctttacgttaccgttcggtaccgggg

SEQ ID NO: 209123 - DNA, 709 bp, Homo sapiens
  misc_feature: GYAE6OF02JNCEB.17.25.C03.1.454.CMB.1.raw
  modified_base (244)..(244): a, c, t, g, unknown or other
  misc_feature (244)..(244): n is a, c, g, or t
  modified_base (289)..(289): a, c, t, g, unknown or other
  misc_feature (289)..(289): n is a, c, g, or t
  modified_base (301)..(301): a, c, t, g, unknown or other
  misc_feature (301)..(301): n is a, c, g, or t
  modified_base (543)..(543): a, c, t, g, unknown or other
  misc_feature (543)..(543): n is a, c, g, or t
  modified_base (550)..(550): a, c, t, g, unknown or other
  misc_feature (550)..(550): n is a, c, g, or t
  modified_base (555)..(555): a, c, t, g, unknown or other
  misc_feature (555)..(555): n is a, c, g, or t
tcagcgtagactagcacgaccggtgctcgatttagtagtgtagatttgggtttgggggtacgtcaacaaccacatctgtcctctagagaaaaccctacgtgagcacagctcctcaccaatggactggacctggaggatcctcttcttggtggcagcagctacaagtgcccactcccaggtgcagctggtgcagtcgtggggctggaggtgaaggaagccgtggggcctcgagtgaaggtctccngcaaggctctggattcacgtttacctctatagtatcaactgggtncgccgaggccgngtcggacctaacggacctggacggtggacggtggggaagttcggggaccgtaaaccccgttaaacgacgttcgggtacgtaccgaacgtaacggttggttacctttaccgaaccccgtacgttcccgtacccggggaaccaacggtaaccgtttacccaagttacggaacccgtaaccgtaaacctcccgttacccaaactaaacaccacgaccttaacgaagtcggagttacgaagggtcncccgtanaccgngtcctagaccggtacgaccgggtaccgttacgtacttaccggtggtcgacgggaacgtacctacccgtaacggaaccgtttcccggaaggtaccgtaccccgtacggaccgacgggtaccgttccggttttaaccgccggttacggtccggggg

SEQ ID NO: 209124 - DNA, 764 bp, Homo sapiens
  misc_feature: GYAE6OF02I7K7P.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttaccctctatagtactcaacgtgggtcgccgccgaggccgcgtacgggaacctaaccggacctagggaacggtgggaacgttcgggggaacgttcgggggaccgtaaacccctaaacgtaaccgttggggtacgttaccgaacgtagggttcgttaccctttaccgaacccctaacgttccccggtacccgggggaacctaacggtaaccctttaacccgaacgttaccggaaccccgtaaccggtaaacccttccccctaacctaaacgttaaaaccgaccaacggtacccttaacgaaccgttacgggtacgttacggaaggtaccgtccctacggtaacctacgttaccgtaggtaacccgaccggtaaccggggtcccttacgttaacgtttaaccgttcggtacggtaccgtacggtaccgtcccgaacggtacgttcccgggtagtaccgacccgtaccggacgtcggtaccggttacctttcggtaccgttcggtaccgggg

SEQ ID NO: 209125 - DNA, 857 bp, Homo sapiens
  misc_feature: GYAE6OF02JFLT8.17.25.C03.1.454.CMB.1.raw
  modified_base (257)..(257): a, c, t, g, unknown or other
  misc_feature (257)..(257): n is a, c, g, or t
  modified_base (337)..(337): a, c, t, g, unknown or other
  misc_feature (337)..(337): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcgagtcgtggggctggaggtgaagagccgtggggcctcgaggtgaacggtctccgtgcctaagggtctttcgngggtacttcgtaaccggttttaccctccttattaacgtacttaccaaaccgttggggtcaccggtccgaacgggtcccgngttacgggaaccgtaaaccgggtacccttagggacggttgggaacgttggggaacgttcgggggaacccgtaaaaccccgttaaacgaccggttgggtacgtaccgaacgtaacggttcgttccgttaccgaaccccgtaacgttccccggtacccgggggtaactaccgtaaccgtttaccgaacgtaccggaaacccgtacccgtaaacccgtttccctaacccgtaaaacgtttaaaaccccacgtaaaccggtacccttaacctaaggttaccggggtaacgtttacgggaaccgggtaacgttaccccgtagggtaaccctaaacggttccgtaaccgggaaacgtaccccgggtaacggtccccggttaactttaacgttcccggtagtaccgggactaacgggttaccccgtaacccgaaccgggttactaccggggttacgtaaccgggtcccttaacgggacctacggggtccgttccccggtttacgtaccggtttcggtacccgggggg

SEQ ID NO: 209126 - DNA, 552 bp, Homo sapiens
  misc_feature: GYAE6OF02F1WN3.17.25.C03.1.454.CMB.1.raw
  modified_base (283)..(283): a, c, t, g, unknown or other
  misc_feature (283)..(283): n is a, c, g, or t
  modified_base (337)..(337): a, c, t, g, unknown or other
  misc_feature (337)..(337): n is a, c, g, or t
  modified_base (343)..(343): a, c, t, g, unknown or other
  misc_feature (343)..(343): n is a, c, g, or t
  modified_base (348)..(348): a, c, t, g, unknown or other
  misc_feature (348)..(348): n is a, c, g, or t
  modified_base (411)..(411): a, c, t, g, unknown or other
  misc_feature (411)..(411): n is a, c, g, or t
  modified_base (447)..(447): a, c, t, g, unknown or other
  misc_feature (447)..(447): n is a, c, g, or t
  modified_base (511)..(511): a, c, t, g, unknown or other
  misc_feature (511)..(511): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggggcctcagtgaaggtctcctgcaaggcttctggattcacgttttacctcctatagtatccaactgggtncgccaggccgctggacaacgacctgagtggatgggatggggcgaaaccctaacnctggtntcacngtgtcttcacccatccgtcgggacaggacttacgatcgaccacgaacctcctacaactaaacnctacgcctaacatggagtttggacgagccttagacngtctgaccgacaccggtctccttaattaccgtgtgcgtaagcgtacccaggtaactccgggtancgaccttaggcacgtcggtcctttaggaccttggaccgggg

SEQ ID NO: 209127 - DNA, 867 bp, Homo sapiens
  misc_feature: GYAE6OF02HYBAA.17.25.C03.1.454.CMB.1.raw
tcagcgtagactagcacgaccggtgctcgatttagtagtgtagatttggttttggggactcaacaaccacatctgtcctctagagaaaaccctgtgagcacagctcctcaccatggactggacctggaggatcctctttcttggtggcagcagctacaagtgcccactcccaggtgcagctggtgcagtcgtggggctgaggtgaagagcctggggcctcagtgaaggtctcctgcaaggcttcgtggattcgaccgtttacctcctaatagtatacgaacgttgggtcgcgccgtagggccgccgtacggaaccaaaccggaccgttggaacggttggaacgttggggggaactacgggggaacccgtaaaccccgttaaacgtaccggtcgggttacgtaccgtaccgtaagggttcgttaccttaccgaaccccgtacgttaccccggtaccgggggaacttaaccggtaaccctttacccgaagtttacccgaaaccccgtaaccggtaaacccttacccgttaaacccctaaaacgttaaaaaccccgccgtaaaccggtacccctttaaacggaaccggttttaagggtaaacggtttacgggaaacccgggttacggtaccccgtttaagaaacccgttacgtttaaccgtaccgggaaaacccgtaaccccgggtaacccggggttacccggttaaacccttttaacgtttacccgggtaggtaacccgggtccgtaaacgggttaacccgcccccgttaaccggtaaggttccccgggttaaggacccgttacccggttaccgggacgtacgggtcccggtttaacccttttaggaccccgttttgggaacccggggg

SEQ ID NO: 209128 - DNA, 771 bp, Homo sapiens
  misc_feature: GYAE6OF02HCCHE.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagccgtggggcctcgagtgaaggtctcctgacaaggcttcgtggacttcacgtttacctcctatacgtatcaacgttgggtgcgccgaggccgcgtgggaccaacgtacccgtggaggtggagtggggagtcggggaccgtaaacccctaaacgacgttcgggtcgtaccgacgacggttcgttccttaccaacccgtacgttcccgtaccggggaccaaggtaaccctttaccgagtttaccgaacccgaaccgtaaacccttcctaaccccgaaataaaaacccgacccgtaagtaccccttaacgaacgttcggggaaggtttcggacgggaaccgtccttacgaaaccgctttaccgtagggaacccgtacccggaacccgggtccggtttaaccttaacgttttaccggttggttaacggacggtaaccggtacccggttaccccgaaacgggtccgtttacccggggttaaccggaacccggttacccggttaaccgggacctacgggggttccccggttacggtttttaccgggtaccgttttccggggacccgggggg

SEQ ID NO: 209129 - DNA, 827 bp, Homo sapiens
  misc_feature: GYAE6OF02HU1PU.17.25.C03.1.454.CMB.1.raw
  modified_base (136)..(136): a, c, t, g, unknown or other
  misc_feature (136)..(136): n is a, c, g, or t
  modified_base (619)..(619): a, c, t, g, unknown or other
  misc_feature (619)..(619): n is a, c, g, or t
  modified_base (695)..(695): a, c, t, g, unknown or other
  misc_feature (695)..(695): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctnttcttggtggcagcagctacaagtcgcccactcccaggtgcagcgtggtgcagtcgtgggctggaggtgaagagcgtgggcctcgagtgaaggtctactgactaggtcttcgtcggattctaccgtttacctactaatagtactccgaacgttgggtcgaccggaccgtacgggcccgtacgtacgggaaacctaaccggtaccgtaggtacggtagggaacgttcgggggaacggtacggggaaccccgtaaaccctaacgtacggttcgggttactaccggaaaccgttggttacgtttaccgttcccgaaacccttaccggttacccggtacccggggtaaacctaaacgttaaaccccttaaccgtaacgtaaccgtaacccgtaaacccgttaaacccttcccctaaacgaaaaacttaaaacccacgaaccgtaaccctacgaaaggttacgggtaacgttacgggaacgggtaccncccgttaagtaacctacgtttcgtaaccggaacgtaacgtccggtacgggtaccgttttaacttaacgttaccggngttaaccggccggtaaacggacccgttaccccggaaacggttccggtaccgggtaaacgtaccggttacccccgggtaaggaccggtaacccgggtcccggttttacccgtttaggtaccccgtttcggggg

SEQ ID NO: 209130 - DNA, 569 bp, Homo sapiens
  misc_feature: GYAE6OF02GV1OJ.17.25.C03.1.454.CMB.1.raw
  modified_base (426)..(426): a, c, t, g, unknown or other
  misc_feature (426)..(426): n is a, c, g, or t
  modified_base (433)..(433): a, c, t, g, unknown or other
  misc_feature (433)..(433): n is a, c, g, or t
  modified_base (446)..(446): a, c, t, g, unknown or other
  misc_feature (446)..(446): n is a, c, g, or t
  modified_base (456)..(456): a, c, t, g, unknown or other
  misc_feature (456)..(456): n is a, c, g, or t
  modified_base (520)..(520): a, c, t, g, unknown or other
  misc_feature (520)..(520): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggcctcgagtgaaggtctcctgcaaggcttcgtggattcctacgtttacctcctatagtatacaacgtgggtgcgccaggccgctggacaacgacctgaggtggagtgggatcgggaccaaccgtaacacgtggtgtacacgtagttgtcttccgaccctatcccgtacgggacagtaccttaccatacgaccacgaactcctacaataacncacgcanagtggattgagcnctagacatcngaaccgtacgccgtccgtacttaattcgacgtgaccgagtccgtacccgtacggcttcccgganaccggaccctaggcacgggtccgttctttacggccttcgggtaccgggg

SEQ ID NO: 209131 - DNA, 707 bp, Homo sapiens
  misc_feature: GYAE6OF02GUWEG.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagcctggggcctcagtgaggtctcctgcaaggcttcgtggattctacgtttacctctatagtatcaacgttggtgcgccaggccgcgtcggacaacgaccgtgaggtcggagtgggagtacgggaccgtaaacccgtaacgacgtggtacgtaccgacgtagttacgttccttaccgacccgtacgtcccggtaccggacaacgtaccttaaccgactacgaacccgaaccgtaacctcccttaaccaaactaaaaccacgaacgtaccctaacgtacgttacgggtaaggttacggaacggtacgtacccgtaagaaccgtacttccgttaacggaacccgtaaccgacccgggtacccgttaaccgtttaaccgtttaccggtacgtcggtacggaccgtaccgtcccgtaacggtccgtaccggtacggaccgttaacccggtacggaccgtacggtcccggttaccgttttacggaccgtttccgggtaccgggg

SEQ ID NO: 209132 - DNA, 641 bp, Homo sapiens
  misc_feature: GYAE6OF02IHCFI.17.25.C03.1.454.CMB.1.raw
  modified_base (413)..(413): a, c, t, g, unknown or other
  misc_feature (413)..(413): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaaggaagccgtggggcctcaggtgaaggtcctcctgcaaggcttctggattctacgtttacctcctatagtactacgaacgtgggtgccgccgaggccgcgtagggacaaccggcctgaggtggagtgggagtgggacgaaccctaagacgtggtcgtacactagtgtaccttccaccctactcccgtaccgggactacgtaccttaccngtaccgaacctaccgtaccctacctacccaacgtaaaccacaacgtacctaactacgtacggtaggttacgagggtacgcgtacgactatctacgaacgacgaccggtccgttacgtactttacgtcggtacgcggtacgtacgtacccgtacggtacgtcccggtacggacgtacccgtacggaccggacggtccggttacccgtttcggaccgttcggtaccgggg

SEQ ID NO: 209133 - DNA, 798 bp, Homo sapiens
  misc_feature: GYAE6OF02JR1CZ.17.25.C03.1.454.CMB.1.raw
  modified_base (237)..(237): a, c, t, g, unknown or other
  misc_feature (237)..(237): n is a, c, g, or t
  modified_base (272)..(272): a, c, t, g, unknown or other
  misc_feature (272)..(272): n is a, c, g, or t
  modified_base (299)..(299): a, c, t, g, unknown or other
  misc_feature (299)..(299): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgccccactcccgaggtgcagctggtcgcagtcgtgggctgaggtgaagacgcgtggggcctcgagtgaaggtctccngcaagggtcttcgtggtcttacacggttttacccnccgttatagtactctaacgtggggtcncggaccgacggcccgtcgtacggacaaccggacccgttggaaggttggtaaggtcggggaagttcggggaccccgtaaaaccctacgtaccgtggggttcacaaaccgtggtttcgtacctttaccgaccctagtccccggtacggggacctaacggtaacctttacccgaagtcgacccctaaccggtaccctttacctaacccgaaacttaaaaccgaccgtaacgtaccctaaacgaaccggttagggtaaccgtttacgggaaaccgggttacgtaccccggttaagaccctaccttaaggttacccggaaacggtacccgaaaccgggtttccccgtaacgtttaaacgtttacgtcgggttaacggaccgaagggttaaccccgccctccgggttaaacccggttccgggttaggaacccgacccggttaaccgggtaccgacgggtcccggttttaccctttagggaccgtttttcccggggaacccggggg

SEQ ID NO: 209134 - DNA, 559 bp, Homo sapiens
  misc_feature: GYAE6OF02G5QY9.17.25.C03.1.454.CMB.1.raw
  modified_base (255)..(255): a, c, t, g, unknown or other
  misc_feature (255)..(255): n is a, c, g, or t
  modified_base (278)..(278): a, c, t, g, unknown or other
  misc_feature (278)..(278): n is a, c, g, or t
  modified_base (289)..(289): a, c, t, g, unknown or other
  misc_feature (289)..(289): n is a, c, g, or t
  modified_base (335)..(335): a, c, t, g, unknown or other
  misc_feature (335)..(335): n is a, c, g, or t
  modified_base (340)..(340): a, c, t, g, unknown or other
  misc_feature (340)..(340): n is a, c, g, or t
  modified_base (352)..(352): a, c, t, g, unknown or other
  misc_feature (352)..(352): n is a, c, g, or t
  modified_base (369)..(369): a, c, t, g, unknown or other
  misc_feature (369)..(369): n is a, c, g, or t
  modified_base (395)..(395): a, c, t, g, unknown or other
  misc_feature (395)..(395): n is a, c, g, or t
  modified_base (414)..(414): a, c, t, g, unknown or other
  misc_feature (414)..(414): n is a, c, g, or t
  modified_base (426)..(426): a, c, t, g, unknown or other
  misc_feature (426)..(426): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggatcctcttctggtggcagcagctacagtgcccactcccaggtgcagctggtgcagtctgggctgagtgagagctggggcctcagtgaggtctcctgcaaggtcttcgtggattcacgtttaccnccttatagtactcaacgtgggtncgccaggccgntggacacgacctgacgtgatgggatgggaccaacctagacgttggntcacngtgtcttcaccntccgcggacagctaccntacgaccacgactccacataacgacngcctagatgattggagacnccgttagacctntacgagtacgagtaccggtccttacttagttaacgtggtacgacggtacgaccgttccgaacggcgttccggtaggaccgaccgtttaccggccgtacggccggttacctttcggtaccgtcgggtaccgggg

SEQ ID NO: 209135 - DNA, 760 bp, Homo sapiens
  misc_feature: GYAE6OF02IRS3W.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttggtggcagcagctacagtcgcccactcccaggtgcagctggtcgcagtcgtggggctggaggtagaacgacgccgtggggcctagaggtaggtacggtcctcgtgacgtaacggtcttcgtagtattccgtaccgtttaccttcgtatacgttactacgtacggtggtcgaccgccgaggcccgacgtacggaacctaaccggacgtaggtacggtaggaggtcggggtacgtacggggaaccctaaacccgtacgtacggtcggtacgtaccgtacggtagtttccgtaccttacccgaacctcggtacccggtacggactacgtaacctacgtacgacgtaaccctaaccgtacctacccgtaactaaacgtaactaaccgacgtacctaacggtagtacggtaacggttcggacggtaccttaccgactacgtacgttacgaccggtacctacccggtaccgttaccgtagtttaaccgttcgtccggacgtaccgacgtacccgtaccggtaccggtaccggtacggttacggacccggttaccggtaccggtacccgggttactccccgggttttacggtacccggttaccgggttcccgggtaacccggggg

SEQ ID NO: 209136 - DNA, 990 bp, Homo sapiens
  misc_feature: GYAE6OF02HJNDO.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagtaacgccgtgggcctcgagtgaaggtctcctgacgaggtcttcgtggattccgtaccgtttacctctaacgtagtactacgtaacgttgggtcgcgccgtacggcccgtacgtacggaaccgaaaccggtacccgttaggtacggtacggggtaacgttacggggggtaacgtacgggggtaaccccgtaaaacccccttaaaccggtaaccggttcggggttaccgttaacccgtaaaccggtacgggttttaccggtttaaccctttacccggaaacccccgttaaccgttaccccggggtttaaccccgggggaaccctaaacggtttaaacccgtttaaccctaacgggtttaacccgggaaaccccctaaacccgggttaaacccctttacccccggttaaacccctaaaacgtttaaaaaaccccgtaaacccgtaacccggttaacccgttaaaccccgtaaagggtttaccggggtaaaacggttttacgggaaaacggggttacccggtaaccccggtttaacgaacccgtttaaccggttccggttaaacccgggtaaacccggttacccggtaaacccggggttcccgtttaaaccggtttaacgtttaaacccggtttcgggacggtttaacccgggaacggttaacccggttaccccgtacgggtaacgttcccggggtaacggtacccggtaacccggtaacgggttaccgtaccggggtacccggttacccggttttaacggttacccgtttacggggtacccggggg

SEQ ID NO: 209137 - DNA, 604 bp, Homo sapiens
  misc_feature: GYAE6OF02F68ZD.17.25.C03.1.454.CMB.1.raw
  modified_base (280)..(280): a, c, t, g, unknown or other
  misc_feature (280)..(280): n is a, c, g, or t
  modified_base (291)..(291): a, c, t, g, unknown or other
  misc_feature (291)..(291): n is a, c, g, or t
  modified_base (433)..(433): a, c, t, g, unknown or other
  misc_feature (433)..(433): n is a, c, g, or t
  modified_base (449)..(449): a, c, t, g, unknown or other
  misc_feature (449)..(449): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgagaagccgtgggcctcagtgaaggtctcctgcgaaggcttctggtattcacgtttacctcctatagtatcaactgggtncgccaggccgngtggacaacgacctgagtggatgggagtgggaccaacctaactcgtagtcgtacacgtagttcgtctaccaccgtactccgtaccgggaacaggtaccttacactcgaaccacgaactccacaactaaacacacgacctacntaggagttagaggacncgtagaacatcgtacgacggaaccgacggtccgttattacgttaacgtgtacggacgaagtacccgtaccgaaccggtcgttaccgggtcgaaaccgttacccgtaaccgggcacgggttcccgtccggtttaagtacccgttccggtaacgggg

SEQ ID NO: 209138 - DNA, 627 bp, Homo sapiens
  misc_feature: GYAE6OF02IT4UL.17.25.C03.1.454.CMB.1.raw
  modified_base (248)..(248): a, c, t, g, unknown or other
  misc_feature (248)..(248): n is a, c, g, or t
  modified_base (288)..(288): a, c, t, g, unknown or other
  misc_feature (288)..(288): n is a, c, g, or t
  modified_base (290)..(290): a, c, t, g, unknown or other
  misc_feature (290)..(290): n is a, c, g, or t
  modified_base (302)..(302): a, c, t, g, unknown or other
  misc_feature (302)..(302): n is a, c, g, or t
  modified_base (347)..(347): a, c, t, g, unknown or other
  misc_feature (347)..(347): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctgggcctcagtgaaggtctcctgcgaaggcttctggnttcacgtttacctctatagtatcactgggtgcgcaggccncnggacacgctggngtggagtgggagtcgggacgaaccctaacgacgttggtgtacacncgttcgtccttacaccctacgtcccgtccgggaactacgtaccttaccacgtacgaaccaccgtaaccgttccctacctaaactaaaaccgactaaccgtccgtaacgaggtcggtaggtttaggacgggaacgtacgtcgtaacgtacgtctaggaccgaaccggtccggcccgttactcgtttaacgtcggttgacggtagaccgttaccgacggtaccggtccggtgaaccgcgtaccggctacgggtccgtacgtttcgtacgttccggtccgggg

SEQ ID NO: 209139 - DNA, 748 bp, Homo sapiens
  misc_feature: GYAE6OF02GL7UY.17.25.C03.1.454.CMB.1.raw
  modified_base (292)..(292): a, c, t, g, unknown or other
  misc_feature (292)..(292): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctgggtgcagtcgtggggctggagggtgaagaagccgtgggggcctcgagtgaaggtctccgtgcaaggtcttctggtattctacgtttacctctattagtatcaacgtgggtncgccaggccgcgtcggacaacgacctggacggtggagtggggagtcggggaccgaaaccccgtaacgtaccgtgggtacgtacgaacgtaggttcgttacctttacccgaacccctacgttcccggtacccggggtaacctaacggtaaccctttaaccgaaccgtttaaccggaaccccgtaaaccggtaaacccctttaccccgtaacctaaaccgtaaaaccctaaccgtaaccgtacccttaacgtaacggttacgggtaaggtttacgggaacgggttacgtaccgtacgtaaccgtagtaccgtacggaaccgtacgtaccgggtccttactttatacgtcggtagcgtacggtacgtacccgtaaggtccgttaccgggttacgacccggtccgtaaccgggcgtaccggtcccgggttactttacgggtacccgttcgggtaccgggg

SEQ ID NO: 209140 - DNA, 703 bp, Homo sapiens
  misc_feature: GYAE6OF02F81U1.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctctatagtatcaacgtgggtgcgccaggccgctggacaacgcctgaggtggatgggatcggggaccgaacccgtaacacgttgggtcgtacacgagttcgtccttaccgacccctagttcccgaccggggaacacggtacctttaaccacgttacgaaccctaaccgaacccttccctaaccgaacttaaaacccgacctaacgacccttaacagttacgggtaagtttcggaaacgggtacctacccgtacgaaccgtacttaccgtaccggtaacccggaccgacccgggtacccggttaacttaacgtttaacctggttaacggccgtaacggtaccgtccccgtaacgggtacgttccccgggtagtacccggtacccggttaaccgggaccgtacgggttcccggttaccgttttcggtacccgtttcggtaccgggggg

SEQ ID NO: 209141 - DNA, 802 bp, Homo sapiens
  misc_feature: GYAE6OF02I030R.17.25.C03.1.454.CMB.1.raw
  modified_base (716)..(716): a, c, t, g, unknown or other
  misc_feature (716)..(716): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggagatcctcttcttggtgcagcagctacaagtcgcccactcccgaggtcgcagcgtggtgcagtcgtgggctggaggtgaaacgacgccgtgggcctacgaggtagaacggttcctccgtagacgtaacggtctttcgtaggtacttacgtaaccgtttacctaccgtaagttaacgttacgtaccgtaacgttcggggtacgccggaccgaacgggtcccgtacgttacggaaccgtaaaccggtaccgttaggaacggttggtaacggttacggggtacgtaccggggaaacccgtaaaccccgttaacgaacggttcgggtcgaaccgtaacggttacgggtttccgtttccgttaacccgtaacccgtacgtttacccggaccgggtaacctaacgttaaccctttaaccgaacgtaacccggaaaccgttaaccgtaaaccctccgtaaccaaaacgttaaaccgaaccgtaccgtaccgttaagtaacgtacgggttaacgttacgggaaacgtaccgtacaacgtaacgtacggtaccgtacgaaccggtacgtacccgtcgttacttaagtccggtgtacgngtaacgccgtacgtaccgacggtccgtggaaccgtccgtaacggcgaacccggttcctacgttttaccggacgttccggtaccggg

SEQ ID NO: 209142 - DNA, 620 bp, Homo sapiens
  misc_feature: GYAE6OF02HHEJZ.17.25.C03.1.454.CMB.1.raw
  modified_base (464)..(464): a, c, t, g, unknown or other
  misc_feature (464)..(464): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattctaccgtttacctcctatagtatcaacgtgggtgcgccagggcccgctggaccgaacgacctggaggtggagtggggatcggggaccgaaccctaacgacgtggtgtacacgagttgtccttaccaccctactcccgtaccgggaactacgtaccttaaccgactacgaacctaacgaaccttcccgacctaactaaacaaccgacgaccctaanagtggaacgttaggacgcgtccgtacgactacgtctaggaccgtacgaccggtccgttactacgttacgtgtacgacgacgtcgtacccacggtacgtccggtacgacgtaccgacggcgtacggtccggtccgtttcggtaccgttcgtacgggg

SEQ ID NO: 209143 - DNA, 675 bp, Homo sapiens
  misc_feature: GYAE6OF02I8B5Y.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagccgtgggcctcagtgaggtctcctgcaggcttcgtggattcacgtttacctcctatagtatcaacgtgggtgcgccaggccgctcgggaaccaacggtacctggaggtggagtgggacgtcggggaccgaaaccctaacgacgttgggtcgtaccgaacgtgtacgttccttaccacccctacgtcccgtacccggggaacaacgtaccttaaccgactaccgacccaaccgtaaccctaccctaccaaactaaaccactaacgacccttaaacgagttacggtacgttacggacggtacgtaccgtgaacctacgttcgtacgaaccgacgtacccggtccgttacgttaactttaccgtggtacgacgtacgtaccgtaccccgtaggtaccggttccgggtacgtaccggtccgtaaccggtcgaacggtccggttccctttacggtaccggttcggtaccgggg

SEQ ID NO: 209144 - DNA, 818 bp, Homo sapiens
  misc_feature: GYAE6OF02H6XYX.17.25.C03.1.454.CMB.1.raw
tcagcgtagactagcacgaccggtgctcgatttagtagtgtagatttgggtttggggactcaacaaccacatctgtcctctagaagaaaaccctgtgagcacagctcctcaccatggactggaccgtggaggatcctcttcttggtggcagcagctacagtgcccactcccaggtgcagctggtgcagtcgtgggctggagtgaagagctgggctcgagtgaaggtctccgtgactaacggtcttctggtattctacgtttacctcttaatcgtactcgtaacgttcgggtagccgtacgacggccgtcctaggaaccgaaccgtaccgtggtaacggtcggtacggtggggacgtccggggaacccgtaaacccgtaacgacggttcggttacggtaccgtacgtaggttcttacgtttacccgaacccgtaacgttacccgtacccggggaactaaccgtaaccgtttaacccaagttaacccgtaacccggtaaccgtaaacccttcccccgtaaacgaaaccttaaaaacccaaccggtaccgtacccgttaaacccgtaggttaacgggtaccgttttcgggaaaccgggtacgtccccgttaaggaaacccgttactttcgggaaccggtaaaacctcccgggtaacccgggttcccggtttaacttttaacgtttaacggtaccgggttcggaaccggtaacggacccgtttacccgacgggtaaccgttcgggttaaaccggtacgtaccccggtaacggtctacggggtcccgtttaacccgtttggtacccggttggtaacccggggg

SEQ ID NO: 209145 - DNA, 540 bp, Homo sapiens
  misc_feature: GYAE6OF02FLVC3.17.25.C03.1.454.CMB.1.raw
  modified_base (281)..(281): a, c, t, g, unknown or other
  misc_feature (281)..(281): n is a, c, g, or t
  modified_base (426)..(426): a, c, t, g, unknown or other
  misc_feature (426)..(426): n is a, c, g, or t
  modified_base (433)..(433): a, c, t, g, unknown or other
  misc_feature (433)..(433): n is a, c, g, or t
tcagcgtagactagcacgaccggtgctcgatttagtagtgtagatttgggtttgggggacgtcaacaaccacatctgttcctctagagaaaaccctgtgagcacagctcctcaccatggactggacctggaggatcctcttcttggtggcagcagctacaagtgcccactcccaggtgcagctggtgcagtctgggctgaggtgaagagcctggggcctcagtgaaggtctcctgcaaggcttctggattcacgtttacctcctatagtatcaactgggtncgccaggccgctggacaacgacctgagtggatgggatggggcgaaccctaacactggtgtcacagtgtcttcacccatcctccgggacagacttaccatcgaccacgaactcctccaataaaacagacctacatgagttgaggancctgacntactgacgacacggccgtctattactgtcgcgtagtacgtcccacggacgtccggtgacgcccgtacggcgacggccggtcctttggaccttcgtcggggtacccgg

SEQ ID NO: 209146 - DNA, 762 bp, Homo sapiens
  misc_feature: GYAE6OF02FIQ91.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagacgccgtggggcctcgagtgaacggtctccgtgcaggtcttcgtggacttcacgtttacctctatagtatcaacgtgggtcgcggtcccgagcccggctcggaaccaacggtaccgtggaacggtggaagttcgggggacgttcggggaaccgtaaaccccctaaacgacgttacgggtcgttaccgacgtaggttcggttcctttaccacccctaacgtcccgtaccggggacacggtaccttaccgatcgaaccctaccgtaccctccctaacctaaactaaacccgacgtaccgtaccctaaccgagtacgggtaacggtttacggacggtaaccgtcccgttaggaaccctacgttacccgtagggaaaccccgtaaccggtaacccgggtccctttaacgttaaccgttaaccgtgggttccgaaccgggtaccggtaccgtaccccctaagggtaccgtcccggggttaagacccggtcccgttaaaccggggcctaacgggggtccccgttaccgttttacgggacccgtttccggggtaacccggggg

SEQ ID NO: 209147 - DNA, 519 bp, Homo sapiens
  misc_feature: GYAE6OF02GFQOE.17.25.C03.1.454.CMB.1.raw
  modified_base (261)..(261): a, c, t, g, unknown or other
  misc_feature (261)..(261): n is a, c, g, or t
  modified_base (408)..(408): a, c, t, g, unknown or other
  misc_feature (408)..(408): n is a, c, g, or t
  modified_base (418)..(418): a, c, t, g, unknown or other
  misc_feature (418)..(418): n is a, c, g, or t
  modified_base (432)..(432): a, c, t, g, unknown or other
  misc_feature (432)..(432): n is a, c, g, or t
  modified_base (436)..(436): a, c, t, g, unknown or other
  misc_feature (436)..(436): n is a, c, g, or t
  modified_base (439)..(439): a, c, t, g, unknown or other
  misc_feature (439)..(439): n is a, c, g, or t
  modified_base (445)..(445): a, c, t, g, unknown or other
  misc_feature (445)..(445): n is a, c, g, or t
  modified_base (456)..(456): a, c, t, g, unknown or other
  misc_feature (456)..(456): n is a, c, g, or t
  modified_base (459)..(459): a, c, t, g, unknown or other
  misc_feature (459)..(459): n is a, c, g, or t
  modified_base (463)..(463): a, c, t, g, unknown or other
  misc_feature (463)..(463): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttaccncctatagtatcaactgggtgcgccaggccgctggacaacgacctgagtggatggggatcggggacaacccgtaacactggtcgtcactagtgtcttcacccatcctccgggacagacttaccatgaccacgaactcctacataaacncagcctaacntggattgagatccngacntcngacacncggctctatcngtncganagtcccagactccggtgacgtcctacggcaggccgtcctttgacctttcggcgggg

SEQ ID NO: 209148 - DNA, 684 bp, Homo sapiens
  misc_feature: GYAE6OF02FICPE.17.25.C03.1.454.CMB.1.raw
  modified_base (331)..(331): a, c, t, g, unknown or other
  misc_feature (331)..(331): n is a, c, g, or t
  modified_base (345)..(345): a, c, t, g, unknown or other
  misc_feature (345)..(345): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctctcttggtggcagcagctacaagtgcccactcccaggtgcagctggtgcagtctggggctgaggtgaagagcctggggcctcagtgaggtctcctgcaaggcttctggattcacgtttacctcctatagtatcaacgtgggtgcgccaggccgctggacacgacctgagtggagtgggatgggaccaaccctaanacgtggtcgtcagngtgtccttccaccctatcccgtaccgggactaacgtaccttaaccagtacgacccaaccgtaacctcccgtaccaaactaaaccacctacgtacccttaacgacgttagggtaacggttaggacgggtaacgtccgtacgtaactacgttccgaggaaccgtaccgtaacccggggtcccgttaacctttaacgttaccgttacggtacgtccgggaacggtaccgttaccccgacgggttaaccggttccgggaacgtaccggtaccccgttaacggggcccttaacggggtccccgggttcccttttacgggtacccgtttcgggtacccggggggg

SEQ ID NO: 209149 - DNA, 646 bp, Homo sapiens
  misc_feature: GYAE6OF02GZ334.17.25.C03.1.454.CMB.1.raw
  modified_base (461)..(461): a, c, t, g, unknown or other
  misc_feature (461)..(461): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtgggcctcgagtgaggtctctgcaggcttcgtgtattcacgtttcctctatagtatcgaacgtgggtcgcgccgacggccgcgtcggaccaacggtaccgtaggaggtggagtgggagtcgggaccgtaaccctaacgacgtggtcgtcaacgtagttcgttccttaccacccacttccgtaccgggacaacgtaccttaccgataccgaacctacgaacctccctaccaactaaacacacgacctanacgtaggtagttgacggactccgtagaactcttacgtacgaccgaaccgtaccggcccgttacttaccgttacgtgtacgtacgagtaccgtcccgtaacggtaccgttccgggtaacggtaccgtacccggtacggaccgtcgggtccggttcctttacggtcccgtttaccgggtcccggggg

SEQ ID NO: 209150 - DNA, 671 bp, Homo sapiens
  misc_feature: GYAE6OF02FU6BS.17.25.C03.1.454.CMB.1.raw
  modified_base (256)..(256): a, c, t, g, unknown or other
  misc_feature (256)..(256): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctgggtgcagtctggggctggaggtgaagaagcctgggggcctcgagtgaaggtcctcctgcgaaggcttcgtggtnttcgacgtttacctcctatagtattcaacgtgggtcgcgccgaggcccgcgtggaccacgacctggaggtggagtgggagtggggaccgtaaccctaagaccgtggtacgtcacgtaggttcgttccttaccgaccctacgtcccgtaccgggacacgtaccttaaccgatacgacctaccgaacctccctacctaaataaaccaccaacgcctaacagtcgtaaggtggacggtacgccctaagacctagttacgtacggaacgaccgccggtaccggttactttaagttccgttcgtacggtaccggacgtaccgtaccccgtaacggtacgttcccgggtaacgtaccggacccgttaacgggccgtacgggtcccgggttaccctttcggtaccgtttccgggaccggggg

SEQ ID NO: 209151 - DNA, 833 bp, Homo sapiens
  misc_feature: GYAE6OF02HOG5L.17.25.C03.1.454.CMB.1.raw
  modified_base (317)..(317): a, c, t, g, unknown or other
  misc_feature (317)..(317): n is a, c, g, or t
tcagcgtagactagcacgaccggtgctcgatttagtagtgtagattgggtttggggtacgtcgaacaaccacatctgtcctctagagaaaaccctgtagagcacagctcctcaccatggactggacctggaggatccgtcttcttggtggcaggcagctacgaagtcgcccacgtcccaggtcgcagctggtgaccagtcgtggggctggaggtggaagaaggccgtaggggcctcagttggaagggtctcctggacgaagggtcttcgtggaattccgtacggtttacctcctataggtactccaagttggggtcncggctacggcctctcgggaaccacgtacctgacggtgggactaggggcttaggggaccggtaaaacccctataacggtgggttaacgaccgtaaccgaaggtttcgacctttaccgaaccccgttagtacccccgggtttccgggggaaaccctaggttaaacccccgttaccgtaaagttacccggaaacccccgtaacgggtaaaccccttaccccgttaacccggtaaaaccgttaaaaccaaaccctaacgggtaccctaaaccgtaacttacgggtaacggtttacggaaacgggggtactaccggtaacgaacgtaaccgtacgttaaccgggtaaacccaccgggtaaaccggacccggtttacttaaccgtttaaacccggtttcggaacggttccgaacggtacccggttacccgaacgggttcgtaaccgggttacggacccggtacgttaacccggactaccgggtaccggttccccggtttagtaccggttaccggtccggggg

SEQ ID NO: 209152 - DNA, 633 bp, Homo sapiens
  misc_feature: GYAE6OF02G6KS4.17.25.C03.1.454.CMB.1.raw
  modified_base (260)..(260): a, c, t, g, unknown or other
  misc_feature (260)..(260): n is a, c, g, or t
  modified_base (347)..(347): a, c, t, g, unknown or other
  misc_feature (347)..(347): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttaccncctatagtatctaacgtgggtgcgccagggcccgcgtggaccaaccgacctggaggtggagtggggagtcgggaccgaaacccgtanacgtgggtcgtacacaggttcgtccttaccaccctacttccgtaccggggacacggtaccttaccacgtacgacccgacgaacctccctacctaactaaaccaaccagtaccctaacagtaggtacgttacggaaggacgtcctagacctagtctaggaaccgaccgacgcccgttacttattaccgtgtacgacgaggtaccgtcccgacggtacgtccgggagtcccggaccgtacggtaccacgggtccggttccgtttacggtaccgttcggtacccggggg

SEQ ID NO: 209153 - DNA, 618 bp, Homo sapiens
  misc_feature: GYAE6OF02IQ50I.17.25.C03.1.454.CMB.1.raw
  modified_base (332)..(332): a, c, t, g, unknown or other
  misc_feature (332)..(332): n is a, c, g, or t
  modified_base (358)..(358): a, c, t, g, unknown or other
  misc_feature (358)..(358): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattctacgtttacctcctatagtatcctaacgtgggtgcgccaggccgctggacaacgcctgagtggagtgggatgggcaacctanacgtggctcacagtgtcttacacccntccgtacgggacagaccttacatcgaccacgacctcctacaactaaacacgacgtcctaacgacgtcggtaagttacggaacggtacgtaccgtagaactacttacgacgaacccggaccgtaccgggtacccgttcgttaacgtttacgacggttacgacgtacggtaccgtccccgaaggaccgttcccgggtaggaaccgtcccgtaaccggccgtaacggtcccgggtccttttacggaccgttcggtacccgggg

SEQ ID NO: 209154 - DNA, 665 bp, Homo sapiens
  misc_feature: GYAE6OF02I7TBP.17.25.C03.1.454.CMB.1.raw
  modified_base (322)..(322): a, c, t, g, unknown or other
  misc_feature (322)..(322): n is a, c, g, or t
  modified_base (358)..(358): a, c, t, g, unknown or other
  misc_feature (358)..(358): n is a, c, g, or t
  modified_base (517)..(517): a, c, t, g, unknown or other
  misc_feature (517)..(517): n is a, c, g, or t
tcagcgtagactagcacgaccggtgctcgatttagtagtgtagatttgggtttgggggagtcagtctcagtcaggacacagcatggacatggacgggtccccgctcagctccgtggggcctcctgctactctggctccgagctcgccagatgtgacatccagatcgacccagtctccactccctccctgtctgtcctcgtgggtcgggggtcaggtacgtacaccaatctacgttcggacccggaactaacgtaccgtacggtaccgtttaaaaaccttatttaaagtggtatcagaccgaagaaaccgtaagggaaaaccnccccaaggacccttcctagtactctcggtggtcacncctaccactcgtaggacgtaaggtcggtccctaccgagtcgtaggtcgaggtcgactacggtggtactgtacgggataagttattacgaacttccgaactacactccaccgtactacgtacacctacggtagagtagttagtacactacttactaactntacctaacaacgaagttaaccgttaccttaccgttacccgtacgttaccttaccgttacgggaccggtaacgggtaacttaacggtataacgtaagaaccgtaacggtaacgtgtacggtatacgacctacgttattcgttacgttcc

SEQ ID NO: 209155 - DNA, 708 bp, Homo sapiens
  misc_feature: GYAE6OF02G01IK.17.25.C03.1.454.CMB.1.raw
  modified_base (191)..(191): a, c, t, g, unknown or other
  misc_feature (191)..(191): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgngggctgaggtgaagaagccgtggggcctcagtgaaggtctcctgcaaggcttcgtggattctacgtttacctctatagtatcaacgtgggtgcgccaggccgctaggacaacgccgtgagtggatggggatgggaccgaaccctaacgacgtgggtcgtacgacgtagttcgttccttaccaacccctacgtcccgttaccggggaactaacggtactttaacccgacgttacgaacccctaaccggtaaaccttcccctacccgtaaaattaaaacccgaaccgtaaacgtacccttaaacgacggttacgggtaacgtttcggaaggggtaacctccgttaacggaaaccgtattcgtacggaacccggtaccgtaaccgggtcccttacgttaactttaccgtaggtccgacgtaacggccgtaacccgtacggtaaccggttccgggtacgtaccggacccgttaccgggacgacggtcccggttcgtttcggtacgttccggtaccgggggg

SEQ ID NO: 209156 - DNA, 649 bp, Homo sapiens
  misc_feature: GYAE6OF02GDRDF.17.25.C03.1.454.CMB.1.raw
  modified_base (282)..(282): a, c, t, g, unknown or other
  misc_feature (282)..(282): n is a, c, g, or t
  modified_base (294)..(294): a, c, t, g, unknown or other
  misc_feature (294)..(294): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattcacgtttacctctatagtactcaactgggtncgccaggcccgntcggaacacggacctgacgtggaatgggatcggggaccaaccctaacacgtggtgtaccacgagtcgttcttacaccctacgttcccgtaccggggaacacggtaaccttaccaacgtcggaaccctacgaacctcccttacccaaactaaaccaccacgtccctaacgagtagggtacggtttaggacggtacgccgtagactacgttcgtacgacggaccgaccggtccgttacttacgttacgtcgtaggcgaacgtaccgttacccgacggtaaccggttccgggtacgacggttacccgaaggtccgacgggtccggttaccgtttcgtaccggttccggtaccgggggg

SEQ ID NO: 209157 - DNA, 743 bp, Homo sapiens
  misc_feature: GYAE6OF02H4G5G.17.25.C03.1.454.CMB.1.raw
  modified_base (320)..(320): a, c, t, g, unknown or other
  misc_feature (320)..(320): n is a, c, g, or t
  modified_base (357)..(357): a, c, t, g, unknown or other
  misc_feature (357)..(357): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaacgaagcccgtggggcctcgagtgaacggtctacctggacaaggtcttcgtggtatttcaccgttttacctaccttaatacggttataccaacgttggggtcgacgcccagggccnccgtaggaccaaacgtcctaggaggtggaagtggganggggaccgaaacccttaacgacgtagggtcgtcacgtagtcgttcttaccgtaaccccattcccgtcggggaactagaaccctttaccaagtaccgaaccgaaccgtaactccccgtacaaactaaaccgtacgaacgaccctaacgtacgttacggtacggttaacggacgggtacgtacccgtagtaacgtaccgtttacgacggaacccgacgtaaccccgggtcccggttaactttacgttacgtacggtacggttaccggaacggtaccgttaccccgaaccggtacggttacccgggttacggtaaccggtcccggttaaccggaccgtaaccgggtcccggttaccggttttacgtaccggttccggttaacccggggg

SEQ ID NO: 209158 - DNA, 691 bp, Homo sapiens
  misc_feature: GYAE6OF02GG2TJ.17.25.C03.1.454.CMB.1.raw
  modified_base (286)..(286): a, c, t, g, unknown or other
  misc_feature (286)..(286): n is a, c, g, or t
  modified_base (320)..(320): a, c, t, g, unknown or other
  misc_feature (320)..(320): n is a, c, g, or t
  modified_base (341)..(341): a, c, t, g, unknown or other
  misc_feature (341)..(341): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtgggggcctcgagtgaaggtctcctgcaaggcttctggattcacgtttacctcctatagtatcaacgtgggtnccgccaggccgcgtggacaacgacctggagtggntgggatgggaccaaccctaancgtggtcgacagagtgtccttccacccattcccgaccgggacacggtaccttaaccgattacgaaccgaaccgtaaaccttcccctaccgaaataaaacccaccgaacgtaccccttaacacggttggaacggtttcggaagggacgtcccgtaggtaaccagttccgtaaggaacccgtaaccgacccgggggtacccctttacgttaaacgtttaccgttaggtcggtaccgggtaagacccggttacccgaaccggtacggttaccccgggttagaaccggttaccccggtacgggccgaacggggcccggtttaccgttttcggacccgtttcgggtacccggggg

SEQ ID NO: 209159 - DNA, 710 bp, Homo sapiens
  misc_feature: GYAE6OF02F5W8B.17.25.C03.1.454.CMB.1.raw
  modified_base (283)..(283): a, c, t, g, unknown or other
  misc_feature (283)..(283): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttcgtggattcacggtttacctcctatagtatcaactgggtancgccaggccgctggacaacgcctggagtggatggggatcggggacgaaaccctaacgacgtggtacgtcaacgtagtcgtccttacacccctatcccgtacccgggggactacggtaccttaccgatacgaaccctaacgaacctccctaccaaacttaaaaccaccgaacgtaccctaacgtacgtacgggtaacgtttacgggaacggtacgtcccgtaggtaaccgtacttaccggtacggtaaccggaccggaacccgggttcccgttaacgttaccgtttaaccgtcgggttaacgacggtaaccgggtcccgtaacccggtacggtacccggttacgggtaccggaaccggtacccgtaccgggaccgtaccgggtccccggttaccgttttacgggtacccggttagggtaccccggggg

SEQ ID NO: 209160 - DNA, 781 bp, Homo sapiens
  misc_feature: GYAE6OF02I0GKO.17.25.C03.1.454.CMB.1.raw
  modified_base (293)..(293): a, c, t, g, unknown or other
  misc_feature (293)..(293): n is a, c, g, or t
  modified_base (393)..(393): a, c, t, g, unknown or other
  misc_feature (393)..(393): n is a, c, g, or t
  modified_base (425)..(425): a, c, t, g, unknown or other
  misc_feature (425)..(425): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggattcctcttcgttgggtggcagcagctaacgaagtcgacccacctcccgaggtcgcagtccgtgggtcgcgtacgtcggtcgggcgttggagggtagaagaaacgcccggtggggtccctcgagtaggtaacggtcctcctgacgaacggtccttcgtacggnttaccgtaccgttttaccgtaccttagtaacgttactacgaacggttggtacgccgaccgacggtccgccgtacggaaccaccgtacgtggaggtggagngggagcgggacctaacccgtagacgtggtacnctaacgtcgttacgtccttaccgtaccgtacttacccgggacggtactaccggtaaccttaccagttacccggaaccctaaaccgtaacccttcccgaaacccgttaaactaaaccgacccgtacgtacctaaacgtacgttagggtaggttaaacggcggtaacgtccctaaggacctaagttccgaggaacccgtaccggacccggttcttaccttacgtttaacggcctttacgggacgtacggttcccgaacccgtacgggtcccggtttacggaccgtaccgggtaccccggaaggtacccgacgggtttcccggtaccgttttaccggtacgggttcccgggtcccgggg

SEQ ID NO: 209161 - DNA, 604 bp, Homo sapiens
  misc_feature: GYAE6OF02F6M6O.17.25.C03.1.454.CMB.1.raw
  modified_base (274)..(274): a, c, t, g, unknown or other
  misc_feature (274)..(274): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaacnccccagaccctcctagatctcgtggtgcaatccactcgtgcgaagtcggcctccatcgtagttcagtgcagtgatcgaggacagtactttacaattcctacacctactaccaccctactctacgacaaaccgtggtaaggtacttggtacgtactaacgttacttaaccgtacttcgtaaccaaacgtaacggttaacgttaaccgtaccgtttacccctacgtaccttacggttttcggaccgtaacggggtaacctaagttacgaacgtaactaacgtaaacgtaaccgttggtacgccgtacgacctacctacttccgtacgttacc

SEQ ID NO: 209162 - DNA, 607 bp, Homo sapiens
  misc_feature: GYAE6OF02HOV7S.17.25.C03.1.454.CMB.1.raw
  modified_base (281)..(281): a, c, t, g, unknown or other
  misc_feature (281)..(281): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcctggggcctcagtgaaggtctcctgcaggcttctggattcacgtttacctcctatagtatcaacgtgggtncgcccgaggccgcgtcggacaaccggactggagtggagtgggagtcgggtacgaacccgtaacacgtgggtcgtacacgtaggttcgttcttaccgacccactccgtaccggggactaacgtaccttaccatcgaacccacgtaacccttcctaccaactaaaccacacgacctacagtgagtgaggacgcctgacatcgacgacgaccgacgtccgttacttacgttacgtgcgacggactacgtacccgacggtcgtacccgggtgaccggtccgaccgggtacgacggtccggttccgtttccggttacgtcggtaccggggg

SEQ ID NO: 209163 - DNA, 646 bp, Homo sapiens
  misc_feature: GYAE6OF02IDBIK.17.25.C03.1.454.CMB.1.raw
  modified_base (315)..(315): a, c, t, g, unknown or other
  misc_feature (315)..(315): n is a, c, g, or t
  modified_base (320)..(320): a, c, t, g, unknown or other
  misc_feature (320)..(320): n is a, c, g, or t
  modified_base (542)..(542): a, c, t, g, unknown or other
  misc_feature (542)..(542): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagaagccgtggggcctcagtgaacggtctcctgcgaaggtcttcgtggtattcctacgttacctcctatagtatcgaacgtgggtcgcgcaggccgcgtggactaacgccngtagnggagtgggatgggacaaccgtaacgacgtggtactcgacagttctctacctaccgagtcccgtcggacagaccttaccagtacgaacccgacgtaacctacccgtaccaaacgtaaaccacgaaccgtcctaaacgacgttggaacgttaggacgggacgtaccgttagaactacgtacgtacggaacctaccgaccggtaccgttactacgtttaacccgnggtacgacgagtaccccgtacgtaccgacgggtcggtacgaccggtaccgtaccgggtctaacgggtcccgttacccgtttactccggttaccgggtaccgggg

SEQ ID NO: 209164 - DNA, 809 bp, Homo sapiens
  misc_feature: GYAE6OF02IZ43G.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtgcagcagctaacaagtcgcccactcccgaggtgcagctggtgcagtcgtgggctggagtgaagagccgtgggctcgagtgaggtcctcgtgacgaacggtcttcgtaggtactttaccgtaaccgttttacctacctaagttacgttaacgtacctaacggttcggggtcgaccggtccgaacgggtacccgtcgtacggaaccgaaaaccggtacccgtaggtacggttacgggaagttacggggtaacggtcggggtaacccgtaaaccccgtaacgacggttacgggtaccgtaccgaaacggttacggttcgttcccgttacccgaacccgtaacggttcccggtaaccggggtaacctaacggttaaacccgttaaccgaacgtaccgtaaacccgtaaccggtaaacccttccctaaaccgtaaactaaaaccgtaccgaacgtacccgttaacgaaggttacggtaacggtacggaacgtaccgtcgtaacgtataccgttcgaaacggaccgtaaaccgtccggtaccgttacttaacgtcgtacggcgtagtaccgtacccgaccgtacggtcggttaccggacgtacccggttacgacccggtcggttaccggtaccgtttacccgtttacggtaccgttcgggtaacccgggg

SEQ ID NO: 209165 - DNA, 868 bp, Homo sapiens
  misc_feature: GYAE6OF02J2ORR.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcacgctggtgcagtcgtgggctgaggtagaagagccgtggggcctcgagtgacggtctccgtgacgacggtcttcgtggtacttacctaccggtttaccctaccttagttaagtactacgtaaccggttggggtcgccggtaccgtacgggtcccgtcgtacgggaaccaaccggtacccgtaggtacggtagggtaacggtacgggggtacgtacggggaaccccggtaaaacccctaaacggtaccggttacgggttaccgtaccgtaaccggtaacggttcccggttaaccttaccccgaaccccgtaaccggttccccggtaaccggggtaacctaacggtaaccctttaaccggacttacccggtaacccgaaaccgttaccctaacccctaacgtaaaccctaaaaccggtaacctaaccgtaaccctaacggtaacggttacgggttaacggttacggaaaccgggttaccgaccgtaaacgtacctaaccgtaccgggtaacgttacccggaaccggttaccccgggtaaccggtttacccttaaacggttccgtacgttacgggaccggttaacggtaccgtcccgtaacggtaccggtccgggtaaacggtaccctcccggtaaacggcccggtacggtcccggttacccgttttaccggtaccggttacgggtacccggggg

SEQ ID NO: 209166 - DNA, 669 bp, Homo sapiens
  misc_feature: GYAE6OF02H7SCE.17.25.C03.1.454.CMB.1.raw
  modified_base (268)..(268): a, c, t, g, unknown or other
  misc_feature (268)..(268): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtgggctcgagtgaaggtctccgtgacaggcttcgtggtattcgaccgttttaccnccgttatagtatcaacgttggggtgccgccgaggcccgtcgtaggaccaacgacctgtacggtggaagtggggaatcggggaccaaaccctagtaccgtggtcgtacacgagtcgtctccacctatcccgtcggaatcgacttacagtacgacctaacgtacctaccgtacctaaacgtaaaaccacgaccgtaccctaacgtagtacggtagttaggaacgtaacgcccgttaagactaacttcgaacgaaccggaccgtaccgggccgtttactaatttaccggtagaccggttacgaacgtacccggtacccgacggtaacccgttcgggcgtaaaccggtccccgtagacccgtaacggtcccggtcccttttacggccggtttacgtacccggggg

SEQ ID NO: 209167 - DNA, 734 bp, Homo sapiens
  misc_feature: GYAE6OF02J2M2L.17.25.C03.1.454.CMB.1.raw
  modified_base (178)..(178): a, c, t, g, unknown or other
  misc_feature (178)..(178): n is a, c, g, or t
  modified_base (581)..(581): a, c, t, g, unknown or other
  misc_feature (581)..(581): n is a, c, g, or t
  modified_base (623)..(623): a, c, t, g, unknown or other
  misc_feature (623)..(623): n is a, c, g, or t
  modified_base (653)..(653): a, c, t, g, unknown or other
  misc_feature (653)..(653): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccgaggtcncagcgtggtgcagtcgtgggctgaggtgaagacgccgtgggcctcgagtgaggtctccgtgacgtaggtcttacgtggtacttccgtacgtttaccctcctattagtactaccaacggttggggtacgccgtccgacggtcccgcgtcggaaccaaaccggcctggtaggtcgggtaagtcgggggtacgttcgggggaacccgttaaaaccccgtaacgtaccggttagggttccgtaaccgtaccgtaacggtttccgggttacctttacccgaaccccgtacgtttaccccggtacccgggggtaaacacggtttaaacccctttaccggagttaccgaacccgtaaccggtaaccctccccgtaactaaacgtaaaacccacgtaccgaccttaaccgngtacgggtagttaggacgacgtcagtacactacgtacggacncccggtacgtccgttacttagttacgtggngaccgacgtcctaccgtacggtaacgtccggtagaccgtccgtacggcgtcggccggttaccttggtacctgggtaccggg

SEQ ID NO: 209168 - DNA, 639 bp, Homo sapiens
  misc_feature: GYAE6OF02F4HBP.17.25.C03.1.454.CMB.1.raw
  modified_base (245)..(245): a, c, t, g, unknown or other
  misc_feature (245)..(245): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctgggaggatcctcttcttggtggcagcagctacaagtgcccactcccaggtgcagctggtgcagtctggggctgaggtgaagagcctggggcctcgagtgaaggtctctgcaaggcttcnggattctacgtttacctactataagtactctaactgggtgcgccacggccgcgtggaccacgacctggacgtggactggggatgggaccgaacctacgacgtggtctcgactagtcgtccttacacccgtactccggtaccggactacgtacctaccacgtcgaccacgtaacctcctacaactaaaccacacgtaccctaacacgtggtaagttgaacggtcgcccgttagacctattccgtagaacccggtacgtacgggtacccgttactttacgtaacgttggtaccgacgggtaacgaccgtacccggaccgtaaccggtaccgggttggaaccgtcccgttacggctaaccgggtcgtacccgtttacgtccggttccggtaccgggg

SEQ ID NO: 209169 - DNA, 562 bp, Homo sapiens
  misc_feature: GYAE6OF02F33PC.17.25.C03.1.454.CMB.1.raw
  modified_base (242)..(242): a, c, t, g, unknown or other
  misc_feature (242)..(242): n is a, c, g, or t
  modified_base (279)..(279): a, c, t, g, unknown or other
  misc_feature (279)..(279): n is a, c, g, or t
  modified_base (290)..(290): a, c, t, g, unknown or other
  misc_feature (290)..(290): n is a, c, g, or t
  modified_base (441)..(441): a, c, t, g, unknown or other
  misc_feature (441)..(441): n is a, c, g, or t
  modified_base (486)..(486): a, c, t, g, unknown or other
  misc_feature (486)..(486): n is a, c, g, or t
  modified_base (514)..(514): a, c, t, g, unknown or other
  misc_feature (514)..(514): n is a, c, g, or t
tcagcgtagactagcacgaccggtgctcgatttagtagtgtagatttgggtttggggactcaacaaacacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaggtctctgcaaggcttcnggattcacgtttacctcctatagtatcaactggggtncgccaggccgntggacaacgcctgagtggatgggatggggccaaccctaagctgggtgtaccacaggttgtcttcacccatcccgtccgggacacgtaccttaccatcgaccacgaacctccaccaactaaacacacgtacctacatgggagttggaggacnccgtagacctatcgtagaccgacgaccggtccgtacttattacgngtcgacgagcgtcccgagtcgtccggtnacggtcccgtacggcgacggtccggtctttcgacccgttgggtcgggg

SEQ ID NO: 209170 - DNA, 759 bp, Homo sapiens
  misc_feature: GYAE6OF02J2Z33.17.25.C03.1.454.CMB.1.raw
  modified_base (246)..(246): a, c, t, g, unknown or other
  misc_feature (246)..(246): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcgttggtggcagcagctacagtcgcccactcccaggtcgcagcgtggtgcaggtcgtgggctggaggtagaaggacgccgtcgggcctcgaggtagacggtcctcgngtacgtacggtccttcgtgtacttaccgtacgtttaccacgtatacgttacacgtacggtggtcgccgacggtacgccgtcggacggaaccaaccggtacgtggtaggtacgggtagtacgggtacggttacggggaaccccgtaacccgaagttacggtcgggtaccgtactacgttacggtttccgttccttacccgaacccgtccgttacccggtaccggtaaccttaccgtacccgttaccaggtaccccaccgtaaacccgtccctaccctaacgtaaacgtaacccacgtaccgtacccttaaggacgttagggtaacggttcgacgggtaccctacggtcaccgtacgtactaccgggactaccgggtaccttcgtaactttacgtacggtcggtacgacgtaccggtaccgtaccggtacgtcgggtacccggtagtacccgtaccggtccgacccggttacgggtccccgtttaggtacccggttccggtaccgggtaccgggg

SEQ ID NO: 209171 - DNA, 743 bp, Homo sapiens
  misc_feature: GYAE6OF02JR7P0.17.25.C03.1.454.CMB.1.raw
  modified_base (181)..(181): a, c, t, g, unknown or other
  misc_feature (181)..(181): n is a, c, g, or t
  modified_base (312)..(312): a, c, t, g, unknown or other
  misc_feature (312)..(312): n is a, c, g, or t
  modified_base (724)..(724): a, c, t, g, unknown or other
  misc_feature (724)..(724): n is a, c, g, or t
tcagcgtagactagcacgaccggtgctcgatttagtagtgtagatttgggtttggggacgtcaacaaccacatctgtcctctagagaaaccctgtgagcacagctcctcaccatgactgacctggagatctcttctggcggcagcagctacgaagtcgcccactcccaggtgcagctggtncagtcgtgggctggagtgaagagcctggggacctcaggtgaacggtcctccgtgacgaggtcttcgtggtattcctacggtttaaccctcctaagtagtctaccaacgtggggtcaccgtcgaacggtccncgtaggtaccaaaccgccgttcgaagtgggactgggtagtccggggacctaacccgtaactcggtggtcgtacaacgtcgttacgttctaccggaccctacgttccgaccgggtaactacggtaccttaacccgtacgttaccgaaccgtaaccgtaaccgtacccgtaaccgtaaacaaaccgtacccgaacgtaccctaaggtaccgtaggggttaacgttagggtaacccggcggttacccgtaaggtaccgtaccgttacgttaccggaacccgtaaacccgcggtttaacccgtacgtttacgttaaccggttcgtaccggacgtacggtacccgttccggaagttccccgggtaggttaaccgacgttcccgggttagaccgtaccgggtccgttccggtttaacnccgtttacgggaacccggg

SEQ ID NO: 209172 - DNA, 748 bp, Homo sapiens
  misc_feature: GYAE6OF02H7CWM.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctctttcttggtggcagcagctacaagtgcccactcccaggtgcagctggtcgcagtcgtggggtctggaggtagaagaacgccgtggggacctcgaggtgaacggtctccgtgacgaaggtcttcgtggtacttcgtaaccgttttacctccttaatagttactaccgtaacgttggggtacgccgtaccgaacgggtcccgcggttacggaaccgaaaccggtaccgtaggacggttagggaacggtaggggtaggttacgggggaaccccgtaaaacccgttaacgaccggttcgggttacgtaaccgaacgtacgttcggttaccttacccgaacccgtacgtcccggtacgggtaacacgtacccgttaaccgaagtaccgaacccgaaagtacccttacccgacctaaaacgtaaaaccgacgtaccgtaccctaagaacggttaggtaaggttacggaggtaccgtacccgtaagaacctcgttacgtaccggaccgtacgaccgtaccgtacttaacgtcgtagcggtacgacgtacctaccggacgtacgtccggagaaccgtccgacgtacgcggttaccgtcttacggtaccgtggtaccgggg

SEQ ID NO: 209173 - DNA, 647 bp, Homo sapiens
  misc_feature: GYAE6OF02JJP9E.17.25.C03.1.454.CMB.1.raw
  modified_base (265)..(265): a, c, t, g, unknown or other
  misc_feature (265)..(265): n is a, c, g, or t
  modified_base (342)..(342): a, c, t, g, unknown or other
  misc_feature (342)..(342): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcgagtgaaggtctcctgcaaggtcttcgtggattcacgtttaccncctatagtatctaacgtgggtgcaccgaggccgctggacaacgacctgagtggagtgggagtcgggacaaccctaanacgtggtgacacgagtcgtctcaccctatcccgtaccggacacgtaccttaaccgatacggacccaacgtaacctcccgacctaaactaaaccacacctaccgtaactagtacggtaaggttgaacgggacgcccgttagacttagtccgtacgaaccggtaccgaaccgggtccgttaacttaacgttaactgggttacgacggtaacgtacgtacccgtaaggtaaccggtccggtacgtaacggtccccggttaaggccgtaacggtcccggtaccgttttcggaccgttcgggtaccgggg

SEQ ID NO: 209174 - DNA, 636 bp, Homo sapiens
  misc_feature: GYAE6OF02FSOTH.17.25.C03.1.454.CMB.1.raw
  modified_base (422)..(422): a, c, t, g, unknown or other
  misc_feature (422)..(422): n is a, c, g, or t
  modified_base (455)..(455): a, c, t, g, unknown or other
  misc_feature (455)..(455): n is a, c, g, or t
  modified_base (509)..(509): a, c, t, g, unknown or other
  misc_feature (509)..(509): n is a, c, g, or t
tcagcgtagactagcacgaccggtgctcgatttagtagtgtagatttgggtttggggactcaacaaccacatctgtccctctagagaaaaccctgtgagcacagctccctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtgcgccagccgctggacaacgacctgagtggagtgggatggggacgaacccctaacacgtggtgtccacagtgtcttccacccctatccctaccgggacagacttaccactacgaccaacgtaactcctaccaactaaaaccncaacgaccctacatgggtagttgaacgggtacnccctaggaactacgtcttacggaaccgacaccgggtacctacttaagttaccgnggttcgaccgtaggaccgttaccccaaggtaaccggttccgggaacggaccgtaccccggttaaccgggcctaaccgggtcccgggttacccttttacgggacccgttttccgggtaacccgggggg

SEQ ID NO: 209175 - DNA, 841 bp, Homo sapiens
  misc_feature: GYAE6OF02J0IUU.17.25.C03.1.454.CMB.1.raw
  modified_base (651)..(651): a, c, t, g, unknown or other
  misc_feature (651)..(651): n is a, c, g, or t
tcagcgtagactagcacgaccggtgctcgatttagtagtgtagatttgggtttggggtacgtcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtagaagaagccgtggggcctcaggtgtaacggtctccgtgacgaaggtcttgtaggtattccgtaaccgttttaaccgccgttaagtaaggttactaccgtaaacgttggggtacgtcggtacccgaacgggcccgtacgtacgggaacctaaaccggtacccgttaggacggttggtaacgtgggggtaacgtacggggtaacccgtaaaccctaacggtaacgtgggttaccgacccgtaagtaccggtttagttcccgtttaccgaaccccgtagttaccccggtacgggtaaacttaacggtaacctttaaaccgacgtttaacggaacccttaaaccggtaacctaccccgttacgtaaaccgttaaaacgacccgtaacgtaccctaaccgtaaggtacggttaaggttacgaggtacgtccgttaagacttacggtaacncggtaaccgacccgtaggttacccttaacgtaaacgtttccgtggttacgaccgggttaacgtaccgtacccgtaacggtaaccggttaccggaacggtaacccgttaaccggtttacccgggaacggttaacccggccgggttttacccgtttaacgggttaccccgggttggtaaaccccccgggggg

SEQ ID NO: 209176 - DNA, 738 bp, Homo sapiens
  misc_feature: GYAE6OF02JELVS.17.25.C03.1.454.CMB.1.raw
  modified_base (304)..(304): a, c, t, g, unknown or other
  misc_feature (304)..(304): n is a, c, g, or t
  modified_base (342)..(342): a, c, t, g, unknown or other
  misc_feature (342)..(342): n is a, c, g, or t
  modified_base (365)..(365): a, c, t, g, unknown or other
  misc_feature (365)..(365): n is a, c, g, or t
  modified_base (370)..(370): a, c, t, g, unknown or other
  misc_feature (370)..(370): n is a, c, g, or t
  modified_base (416)..(416): a, c, t, g, unknown or other
  misc_feature (416)..(416): n is a, c, g, or t
  modified_base (543)..(543): a, c, t, g, unknown or other
  misc_feature (543)..(543): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttggtggcagcagctacaagtgcccacctcccaggtgcacgctggtgcagtcgtggggctggaggtgaagaagccgtggggcctgagtgaacggtctccgtagccgtaaggtcttcgtcggtattccgtacgttttacctctatagtactacgaccgtggggtnccggccaggccgcgtcggaacacgaccgtggagtgganggggactggggaccaaccgtaancgtgngtaccagtaggtcttacttcgaccctacgtccgttacccggggaanacggtaaccttaacccgactacggaaccctaacggtaaccctacccgttacccaaacgtaaaacctacctaacggcccgtaaataacgtacggggtaggttacggacggtacgtaccctggaaaccngttaccgtagacccgggtaaccgccggggttaacccttcttaaacgttttccgcggttaacgggtaccggacgttacccgtacccgtaaccggtgggttaccccggtagggtaacccgacccgggtttaccggggaacccgtaaggggttccccggttaaccgtttaccggttaccggtcccggtaaccgggggg

SEQ ID NO: 209177 - DNA, 725 bp, Homo sapiens
  misc_feature: GYAE6OF02G7JA8.17.25.C03.1.454.CMB.1.raw
  modified_base (295)..(295): a, c, t, g, unknown or other
  misc_feature (295)..(295): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttggtggcagcagctacaagtgcccactcccaggtgcagctggtgcagtcgtgggctggaggtgaagagccgtgggcctgaggtgaaggtctcctgacgaaggtcttcgtggtacttctaccgtttacctccttaagtagtatcaacgtgggtcncgccaggtccgctggacaacgcctgagtggagtgggagtcgggacctaaaccctaacgacgtgggtcgtacacgtaggtttcgttcctttaccgaacccctacgtccccggtacggggaactacggtaacctttaacccgagttaccgaacccgtaaccgtaacccttaccctaaccgtaaactaaaaccacccgtacgtacccctagaacggttacggtaacgttagggacgggactccgtagaactacgtcgtacgaaccgacgtccgtaccggttaacttacgtttaaccgtgttacggaccgtaacggtacccgtaccccgtacgggtaacccgttccggggaacgtacccgggtacccgttaccgggaccgaaccgggttcccggtttacccggttttcgtaccggtttccgggtacccgggggg

SEQ ID NO: 209178 - DNA, 744 bp, Homo sapiens
  misc_feature: GYAE6OF02I4OPH.17.25.C03.1.454.CMB.1.raw
  modified_base (244)..(244): a, c, t, g, unknown or other
  misc_feature (244)..(244): n is a, c, g, or t
  modified_base (679)..(679): a, c, t, g, unknown or other
  misc_feature (679)..(679): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagctgggcctgagtgagtctccgtgacgaaggtcttcgngtattcgacgtttacctcgtatacgtatctaacgtgggtgccgcgacggccgtcgtaggaaccaacggacctggagtgggtacgtgggagtacggggccgtaaacctaagtaccgtggtctacgaacgtacgttcgttaccttaccgaaccctgtacccgtacgggtaacctaggtaacccgtttaacgacgtttacgaaccccgtaaacggtaacccttacccggtaacctaaactaaaaccgtaccgaacttacccgtaacgtaacggtccgggtaagggtttacgaaacgggtttaccgaccgtaacgtccaacgtttaacccgggaaggtaacccgtaaccgtaaccgggtaccggttaacttaaccgtttaggtacggttccgaacgggtaccgtacccgtaccgtaaccggtaacggttcccgggtaanccggttacccggttaaggaccggtacggttcccggtaccgtttacgaccggtttaccggacgggg

SEQ ID NO: 209179 - DNA, 594 bp, Homo sapiens
  misc_feature: GYAE6OF02G5FJ9.17.25.C03.1.454.CMB.1.raw
  modified_base (246)..(246): a, c, t, g, unknown or other
  misc_feature (246)..(246): n is a, c, g, or t
  modified_base (284)..(284): a, c, t, g, unknown or other
  misc_feature (284)..(284): n is a, c, g, or t
  modified_base (337)..(337): a, c, t, g, unknown or other
  misc_feature (337)..(337): n is a, c, g, or t
  modified_base (464)..(464): a, c, t, g, unknown or other
  misc_feature (464)..(464): n is a, c, g, or t
  modified_base (510)..(510): a, c, t, g, unknown or other
  misc_feature (510)..(510): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttcgnggattctacgtttacctccttatagtatcaactgggtncgcaggccgctggacacgacctggagtggatgggatcgggacgtaaaccctanacgtggtcgtcaacgtagtgtccttccgaaccctctcccgtccgggaacacgtaccttaccagtcgacctacgaaccttcccaccaaataaaccacacgaccctaacagtaggagttggacgggacncctagaactatcgtaggaaccgacgaccggccgttactattaccgngttacgacgacgactcccgacggtacgtccggtgaccgccgtaccggcacggtccggttcctttcggacgtttcccggacgggg

SEQ ID NO: 209180 - DNA, 580 bp, Homo sapiens
  misc_feature: GYAE6OF02FOHI4.17.25.C03.1.454.CMB.1.raw
  modified_base (281)..(281): a, c, t, g, unknown or other
  misc_feature (281)..(281): n is a, c, g, or t
  modified_base (342)..(342): a, c, t, g, unknown or other
  misc_feature (342)..(342): n is a, c, g, or t
  modified_base (440)..(440): a, c, t, g, unknown or other
  misc_feature (440)..(440): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggcaacctacactggtgtcacgngtgtcttcaccctatccgtccgggacagaccttacagtacgaccacgtaacctcctaccaactaaaccacacgccctaagagtggtaagttgaggacnccgtagactacgtcgtcgacgaccgaccgggtacctacttaacgttactggtacgcgacgtaccgtcccgaagtcgtccgggttagaccggtcccgtaggaccagggtcccggtcccgtttagaccgtttcggaccgggg

SEQ ID NO: 209181 - DNA, 652 bp, Homo sapiens
  misc_feature: GYAE6OF02IMGLD.17.25.C03.1.454.CMB.1.raw
  modified_base (293)..(293): a, c, t, g, unknown or other
  misc_feature (293)..(293): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagcctgggcctcagtgaaggtctcctgcgaaggcttcgtggattctaccgtttactcctatagtatcaactgggtgcgccgaggcccngtggaacaaccgacctgagtggagtgggagtgggacgaaccctaacacgttggtgtcacgtagtcgtaccttccaaccctacgtcccgtccggaactacgtaaccttacccattcgaaccctaacgaacctccctacccaaacgtaaaaccactacgacccttaacgagtcgggtaacgttggtaacgagtccgtagaacctacgttcacgggaaccaccggtacccggtcccgttacttaattccggtgtacgtaccgaaggtacccgtaccctacggtaacgttcccgggtaggaccgtacccggtaacggccgttaccggccggttacccgtttcgggacctttgggacccggggg

SEQ ID NO: 209182 - DNA, 565 bp, Homo sapiens
  misc_feature: GYAE6OF02GU5SQ.17.25.C03.1.454.CMB.1.raw
  modified_base (224)..(224): a, c, t, g, unknown or other
  misc_feature (224)..(224): n is a, c, g, or t
  modified_base (372)..(372): a, c, t, g, unknown or other
  misc_feature (372)..(372): n is a, c, g, or t
  modified_base (382)..(382): a, c, t, g, unknown or other
  misc_feature (382)..(382): n is a, c, g, or t
  modified_base (386)..(386): a, c, t, g, unknown or other
  misc_feature (386)..(386): n is a, c, g, or t
  modified_base (421)..(421): a, c, t, g, unknown or other
  misc_feature (421)..(421): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatccctccctgtctcgcctcgtggtgggggtcagagtcaccatcacttgccgganaagtcacggacgttaaaactatttaatggtatcagcagaaacctggaaaacgcccagacctctgatctctggtcgcactccactctgcgaagtggcctccatcggagttcagtcggcaggtgactgtacgggactagtattacatccncacatcaccnctcngaccaacgtgagtattcgagcaattctactactanaccaacgtagtaacgttacctaccgttcccctacgtaccttacgtttcggaccgtaacggggtaacctaaggttacgaacgtaactaaccgtaaaacgtaacgttcggtacggactcggacctaccgtacttccgtacttaccg

SEQ ID NO: 209183 - DNA, 673 bp, Homo sapiens
  misc_feature: GYAE6OF02GQUEI.17.25.C03.1.454.CMB.1.raw
  modified_base (338)..(338): a, c, t, g, unknown or other
  misc_feature (338)..(338): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaggtctcctgcaaggcttctggattcacgtttacctcctatagtatcaactgggtgcgccaggccgcgtggacaacgacctggagtggatgggatcggggaccgaaaccccgtaanaccgttgggtcgtaccgaccgtaggttcgttcctttacccgacccctacgtcccggtacccggggaacacggtaacctttacccaacgttacgaaccctaaccgtaacctcccctaccaaacttaaaacccactacgacccttaacacggtacgggtaaggtttacggaacgggtagcccttaggacacgttcgtacggacgaccggcggtcccttacttacgttacctggttcaccggttaacgacgtcccgaacgtaccgtcccgggtagaacccggtcccgtaaggcccgtaacggcccggttacgtttacggtaccgttcgggtaccgggg

SEQ ID NO: 209184 - DNA, 571 bp, Homo sapiens
  misc_feature: GYAE6OF02FLH5U.17.25.C03.1.454.CMB.1.raw
  modified_base (329)..(329): a, c, t, g, unknown or other
  misc_feature (329)..(329): n is a, c, g, or t
  modified_base (415)..(415): a, c, t, g, unknown or other
  misc_feature (415)..(415): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgttacctctatagtatcaactgggtgcgccaggccgctggacaacgacctgagtggatgggatgggcgaaccctaanacgtggtgtcacgagtgtcttccaccctatcccgtaccgggacacgacttaccatcgaccaacgacctcctaccaataaacacacncctacacgtggtagttgacggacgcctgactactcgtacggaacgaccgtaccggtccttaccttacgttacgtcgttagccgagtaccgcccacgtacgtccggtcgacgtcccgtaacggctacgggcccgtacgtttcgccgttggtccgggg

SEQ ID NO: 209185 - DNA, 784 bp, Homo sapiens
  misc_feature: GYAE6OF02J09I0.17.25.C03.1.454.CMB.1.raw
tcagcgtagactagcacgaccggtgctcgatttagtagtgtagatttgggtttggggacccaacaaccacatctgtcctctagagaaaaccctgtgagcacagctcctcaccatggactggacctggaggatcctcttcttgggtggcagcagctacaagtcgcccactcccgaggtgccagcgtggtgcaggttcgtggggtctggacggtagaaggaacgtccggtcgggcctagaggtaggtaacggtcctcgtgacgacggttcttcgtggtacttccgttaccgtttacctactagtagtatacgtacggtgggtcgccgcgtacggccgttcgacggaccacgcgtagaggtggtacgtgggacggtcggaacccgtaaccgtagtcggtacggtacgactacggtacgttcctcgtaaccctacctccgttacccgggaccgtaacgtacgttacccttaacgagtacccgtaaccgtaactaccctaacccgtactaaactaaaccgtacgaacctaccgtacgttagggtacggttcggtaaggtaaccggaccgttaacgattaccgtagtccggtaacggtaccggtaaccgttacccgggtacctttaagtttaccgttaacggtcggtaacggtaaccgggttaccgtaccccgtaccgtaacggttacccggggtaccggtaccggaaccggtaaccggtccggtacgggtcccggtttaacggttccgtttaaccggtaccggggtttcccggggaggtaaccccgggg

SEQ ID NO: 209186 - DNA, 579 bp, Homo sapiens
  misc_feature: GYAE6OF02HGTOC.17.25.C03.1.454.CMB.1.raw
  modified_base (291)..(291): a, c, t, g, unknown or other
  misc_feature (291)..(291): n is a, c, g, or t
  modified_base (310)..(310): a, c, t, g, unknown or other
  misc_feature (310)..(310): n is a, c, g, or t
  modified_base (326)..(326): a, c, t, g, unknown or other
  misc_feature (326)..(326): n is a, c, g, or t
  modified_base (358)..(358): a, c, t, g, unknown or other
  misc_feature (358)..(358): n is a, c, g, or t
  modified_base (426)..(426): a, c, t, g, unknown or other
  misc_feature (426)..(426): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatcgacccagtcctccactccctccctgtctcgcctcgtggtgggggtcaggacgtccaccatccacgttcgacccggacaacgtcgacggtacttaaaaccttatttaagtggtatcagcagaaactaggaaacnccccagacctccagactcntgcgcactccactcgngacgagtcgacgtccagtcgagttcaggtcgntaggtgtatcgaggacagttacttcaacttcaccacactcccacctatctacgaccaacgtgaacgtnttgactactaactctatacctgtacaaacgtgtacgttacaccgttacccgtgtaccgttcgttccggaacgtaccgggtaaccgtagttcgaacgtacctaacgaacgtacgtcggtagcttaccggacttacccgatttccgtagtttccc

SEQ ID NO: 209187 - DNA, 737 bp, Homo sapiens
  misc_feature: GYAE6OF02FKV5W.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcgacgtttacctctatagtatcaactggtgcgccaggccgcgtggacaacgcctgagtcggatggggatcgggacgaaccctaacgacgtggtgtccactagtgttcttccacccgtactcccgtaccggggactacggtaccttacccagttaccgaacccgtaaccggtaaacccttccccgtaacccaacgtaaaaaccctacccgtaaacggtacccctaacgaacgttacgggggtaaacgtttcggaaaggggtaccgtacccgttaggtaaccacgtttaccgtacggaaaccggtacccgtacccggggaccgtttaccgtttaacttaacggttcgttcgggaaccgtaacggttaccggtacccccgttaacggtaccggttacccggggtacggtaacccggtcccgttaaacccgggcgtaaccggggtcccgggttcccgttttaacgggttacccttaccggggtacccgggggg

SEQ ID NO: 209188 - DNA, 556 bp, Homo sapiens
  misc_feature: GYAE6OF02IRIPY.17.25.C03.1.454.CMB.1.raw
  modified_base (387)..(387): a, c, t, g, unknown or other
  misc_feature (387)..(387): n is a, c, g, or t
  modified_base (465)..(465): a, c, t, g, unknown or other
  misc_feature (465)..(465): n is a, c, g, or t
  modified_base (500)..(500): a, c, t, g, unknown or other
  misc_feature (500)..(500): n is a, c, g, or t
  modified_base (510)..(510): a, c, t, g, unknown or other
  misc_feature (510)..(510): n is a, c, g, or t
  modified_base (516)..(516): a, c, t, g, unknown or other
  misc_feature (516)..(516): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagcctgggcctcagtgaaggtctcctgcaaggcttctggattcacgtttacctcctatagtatcaacgtgggtagcgtccgaggccgcgtcggacaacgacctggaggtgggatgggagttcgggacgtaaccctaacgactggtgtcgaacgagttgtctccacctactccgtacggganacgaccttacactagaccacgtaacctccctacaactaaacacagcctacgagtcgtagttagaggacgtcctagacntcgtgaccgacgacggctactattcgtgtagcgancgtccacggntccggngacgtccgtcgacgacggccgtacttcgaccgttgcgggg

SEQ ID NO: 209189 - DNA, 771 bp, Homo sapiens
  misc_feature: GYAE6OF02HPDZD.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtcgcagctggtcgcagtcgtgggctggaggtgaagagccgtgggcctacaggtagaacggtctccgtgacgaacggtcttcgtggtacttcctaccgttttacctccttattagtactacgaacgtgggtcgccgaccgacgggcccgtacgtacggaaccgaaccggtaccgtcggtagtgggaagtggggtacggtacgggaccgtaaaccctaacgtaccggtgggtgtaccacggtacggttcgttacccttacaaccccgtacgtacccggtaccggggaacctacgtaacccttacctagtacccgaacccgtaccgtaacccttccctaacctaactaaaccaccgtaactacctaccgtagtacgggtacggttcggaacggtcgtaccgtacgtacgttacgtaccgtaacggaccgtaccgaccgggtccttacgtttaacgttaccgttggaaccgtacgggtacgtaccgttaccccggtacggtaacccggttccggtaacggtaccggtaccccgtaacgggtaccgtaccggttacccgggtttacccgttttaacggtacccggttacgggttacccggggg

SEQ ID NO: 209190 - DNA, 834 bp, Homo sapiens
  misc_feature: GYAE6OF02G2VHA.17.25.C03.1.454.CMB.1.raw
tcagcgtagactagcacgaccggtgctcgatttagtagtgtagatttgggtttggggacgtcaacaaccacatctgtcctctagagaaaaccctgtgagcacagctcctcaccatggactggacctggaggatcctcttcttggtggcagcagctacaagtcgcccactcccaggtgacagcgtggtgacagtcgtgggctggaggtagaagaagccgtggggcctcgagtagaacggtctccgtgacgaaggtccttcgtggtacttcgtaccgtttacctcctaagtagttatacctaacggtgggtcgccgccgagggtcccgtcgtaggaacccgaacggtacccgtgtaacggtggtaaggttaggggaagttcgggggaaacccgttaaaccccgtaaacgtacgttacgggttcctacgtaacgtacggttcgttacctttacccgaccctaacgtttcccggtaccggggaactaaacggtttccctaacgacgtaccgaaacccgtaaacccggtaacctacccctacctaaactaaacccgaaccgaaccgttacccgtaactaacggtaccggttaaggtacggtaacgggtaaccgtacccgtaacgtaaccgtaacgttaccgttacggaaccggttaaacccggacccgggttaccccgtaacgtttaaccgttaccgttacggttacgaccggtaacggacccggtttacccgaaccggtaacggttacccggggacggttaacccggaccggtaccggtacccggtacggtaccccggtttccggtttaccggttaccgggttttaccggtccggggg

SEQ ID NO: 209191 - DNA, 668 bp, Homo sapiens
  misc_feature: GYAE6OF02G1M1H.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttctggtggcagcagctacaagtgcccactcccaggtgcagctggtgcagtctggggctggaggtgaagacgccgtggggcctcagtgaacgggtcctccgtgcaaggtcttctggattcacgtttacctcctatagtactcaacgtgggtgcgccaggccgcgtcggacaacgacctgacgtggagtgggagtgggccgaaaccctagactgggtctccgaacgtgtacgtccttacgacccctagttcccgtaccgggacgacgtaacctttacccgaacgtcgaacccgtaaccgtaaaccttccctaacccgtaaacttaaaacccacaaccgtaccctaactacggttacgggtaaggtttacggaggtacgtcccgtagactatccgtacgaaccggtaccgtaccggtccggttacttaagttacctggtcgaccgtagtaccgtcccgaacggtcctaccgggtggaccggtccgtaccggacgtaccggtcggttaccgttttcgacgtttccggaccggggg

SEQ ID NO: 209192 - DNA, 603 bp, Homo sapiens
  misc_feature: GYAE6OF02IFEY9.17.25.C03.1.454.CMB.1.raw
  modified_base (275)..(275): a, c, t, g, unknown or other
  misc_feature (275)..(275): n is a, c, g, or t
  modified_base (281)..(281): a, c, t, g, unknown or other
  misc_feature (281)..(281): n is a, c, g, or t
  modified_base (565)..(565): a, c, t, g, unknown or other
  misc_feature (565)..(565): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggctctggattcacgtttacctcctatagtatctaacngggttncgccacggcgctggacaacgacctggagtggatgggagtgggacgaaccctaacgtacgttcggtctcaactagtgtccttaccaccctactcccgtaccgggactaacggtacctttaaccgattacgaacccaaccggtaaccctacccgtaaccctaactaaaacccaccgtaacgacccttaaactacgttagggtaacgttggaacgggtacgccttagactactcgcgacgacgaccggtacctctattctgtcgcgagacgtcccaggtctcggtanacgccgtaggctacgcgtccgttgaccgttgtacgggg

SEQ ID NO: 209193 - DNA, 608 bp, Homo sapiens
  misc_feature: GYAE6OF02ITCRI.17.25.C03.1.454.CMB.1.raw
  modified_base (311)..(311): a, c, t, g, unknown or other
  misc_feature (311)..(311): n is a, c, g, or t
  modified_base (380)..(380): a, c, t, g, unknown or other
  misc_feature (380)..(380): n is a, c, g, or t
  modified_base (462)..(462): a, c, t, g, unknown or other
  misc_feature (462)..(462): n is a, c, g, or t
  modified_base (522)..(522): a, c, t, g, unknown or other
  misc_feature (522)..(522): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactccaggtgcagctggtgcagtctggggctggaggtgaagaacgccgtgggggcctcagtaggaaggtcctcctgacaagggcttcgtggtacttcgtacgtttacctcctaatagtaactctaacgtgggtcgcgccagggtccncgtggacaacggacctggaggtggagtagggagtcggggacctaaccctaacgacgtgggtagtcacgngttcgtccttaccacctatccgccggacacgtactaccatacgacccaacaccctacctaccaactaaacgacacgacctanacgtaggagttggagagccgtacgatctacgtgaccgacgacggtacctgttaacttcgngtacgcgtaagctacccgacgtacgtccggtagaccgtccgtacggacgtacgggcccgttacgtttacgtaccgttaggccgggg

SEQ ID NO: 209194 - DNA, 805 bp, Homo sapiens
  misc_feature: GYAE6OF02IUW9K.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctgggggcctcagtgaaggtctcctgaccgaagggcttcgtggtactttcgtaccgtttaacctaccctaattaacggtactacgtaaccgttggggtcgtccgaccgaagggtcccggtaccgttaccgggaaccgaaacccgggtaccggtagggtaacgggttgggtaaaggttcgggggtaagtaacggggggacccgtaaaaacccccgtaaacgtaaccggttagggttccggttaccgaaaccgtacgtttacggtccttttaccccgaaccctaccgttacccgtacccgggggtaactaaccggtaacctttaaacccgaacttaccgaaccgtaacccgtaaacccttacctacccgtaaaactaaaccgaaccaaccgtacctaacgaagtacgggtacggttaggaacggacgtcctaacggactagtactacgtaaccgaccgtacccggtacgtaccgttaactttaccgtaggtaccgacggtacgtacgtacccgtaacggtccggtaccggtagaacggtaccccgttacgggcctaacgggtcccggttaccgtttaccgtaccgtttcgggaccgggg

SEQ ID NO: 209195 - DNA, 633 bp, Homo sapiens
  misc_feature: GYAE6OF02IG5Z8.17.25.C03.1.454.CMB.1.raw
  modified_base (248)..(248): a, c, t, g, unknown or other
  misc_feature (248)..(248): n is a, c, g, or t
  modified_base (465)..(465): a, c, t, g, unknown or other
  misc_feature (465)..(465): n is a, c, g, or t
  modified_base (580)..(580): a, c, t, g, unknown or other
  misc_feature (580)..(580): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctcctgcaaggcttcnggtattctacgtttacctcctatagtatcaacgtgggtgcgccgaggccgcgtggaccaacgacctggaggtggagtggggagtcggggaccgtaaaccctaacgacgtggtcgtacacgagtcgtccttccgaccctacgtccgtaccgggactacgtaccttaccatacgaccacgtaaccctcctaaccaactaaaaccactacgtaccctaanacgttagggtacgttacggaacggtacgccttacgacctatcgtagacccggacgaccggtccttacgtatttaccgtggtacgacgtaccgacgtacccgtaggcgtaccgggnaccggtaccgtacggcgtacgccggttaccgtttcgaccgttcggtaccgggg

SEQ ID NO: 209196 - DNA, 721 bp, Homo sapiens
  misc_feature: GYAE6OF02GMZZ8.17.25.C03.1.454.CMB.1.raw
  modified_base (279)..(279): a, c, t, g, unknown or other
  misc_feature (279)..(279): n is a, c, g, or t
  modified_base (455)..(455): a, c, t, g, unknown or other
  misc_feature (455)..(455): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctcagtgaaggtctcctgcaaggcttctggattcacgtttacctcctatagtatcaacgtgggtncgccaggccgcgtggacaacgcctggagtggagtgggagtcgggaccaacccgtaacacgtggtcgtacacgtgttcgtcttacccaccctacgtcccgtaccggggaactacggtaacctttaaccgactaccggaaccctaacgtaacccttcccgtaccgaaacttaaacccncgaaccgtaccctaacgtagtacgggtaagttacggacggtaacgtccgtaacgacctacgttaccgtacggaaccgtaccgtaaccgggtcccgttaccttaaggtttccgtaggttccggaccggtaacggttacccgttaccccgaacgggttaaccgtcccggggttaacgacccggttaacccggtttacccggggtaaccggttcccggggtttcccttttacgggtacccggtttccgggtacgggggtaacccccggg

SEQ ID NO: 209197 - DNA, 802 bp, Homo sapiens
  misc_feature: GYAE6OF02I1D2J.17.25.C03.1.454.CMB.1.raw
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagccgtgggcctcgagtgaaggtctccgtgacaaggtcttcgtggtacttctacgtttacctccttatagtatacgaacgtgggtgccgtccgagggcccgcgtagggaaccaaccggtacccgtaggacggtacgggaaggtggggagtacgggggtaccgtaaaccccgtaacgtaacggtgggttacgtacgacgtaaggttcgttccttaccgtaaccccgtaggttaccccggtaccggggaacctacggtaccttaacccgtacgtaaccggacccgtaaccgtaaccctaccctaaccgtaaactaaaccgactaacgtaccctaacgtacggtacggtacggttacggtaaggtaccgtaccgtacgaactacgttacgtacggaaccggtaaccggaccggttacccgtaccgttaacgtttaccgtacgggtaccggtacgggtacgtacccggttacccgtaacggtaccggtttacccggggtaacgggtacccggtaaccccgggttacggggtacccgaccggggtttacccgggttaccccggtttcgggttaccccggttttccgggtaccccgggggg

SEQ ID NO: 209198 - DNA, 732 bp, Homo sapiens
  misc_feature: GYAE6OF02GJLWM.17.25.C03.1.454.CMB.1.raw
  modified_base (306)..(306): a, c, t, g, unknown or other
  misc_feature (306)..(306): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggcctcagtgaggtctcctgcaaggcttctggattccacgtttacctcctatagtactcaactgggtgcgccaggccgctggacacgacctggngtggatggggagtgggccgaacccctaacgacgtgggtcgttaccacgtgtcggtccttccaaccccgtactcccgtaccggggactacgtacccgttaaccacgtacgtaacccgaaccggtaaacctcccgttacctaaactaaaaccgacctaacggtaccccttaacgaacgttacggggtagtttacggaacgggtacgtacccgttagaacctagttaccgtcggaaacccggtaccgacccgggtacccgttccttaaacggtttaccgttgtaacggaccggtaacgtaccggttaccccaaccgggtaacgtttcccgggtaggtaaccggtaccccggttaacggacccggtaaccggggttaccccggttaccggttttttacgggtacccgtttccggggttaaccccgggggg

SEQ ID NO: 209199 - DNA, 728 bp, Homo sapiens
  misc_feature: GYAE6OF02HPFTQ.17.25.C03.1.454.CMB.1.raw
  modified_base (254)..(254): a, c, t, g, unknown or other
  misc_feature (254)..(254): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctctttcttggtgcagcagctacaagtgcccactcccaggtgcagcgtggtgcagtcgtcggggcgtgagggtgaagagtccgtggggcctcgagtgaaggtctcctggacaaggtcttntgggattcaccggtttacctcctagtagtatccaagtgggtcgccgaccgaggcccggttactacggaacaaaaccggtacctagggtaacggttggaaggtttagggggagttccgggggaacccgttaaaaccccgaacgtaacggttcgggttacgaccgtaacctaagggtttcgcgtttaccccaaaccctcgtccccggtaacgggaccgtaactacccgttaaccagtcgtaacccgaccgaacctaccctaccaacaaacacacgtacactacaggtattagggaagtcgacgtacgtacagttaccgtacgaaccggaccgtaaccggtccgttacccgtaacttttaacggcggtacggacggtaacgtaccggttaccgaaccgtacgggtacccgtcggaccggtaccggtaccgcggtaccggtaccgggtttccgttacgttaccggttcggtccggggg

SEQ ID NO: 209200 - DNA, 676 bp, Homo sapiens
  misc_feature: GYAE6OF02IRN46.17.25.C03.1.454.CMB.1.raw
  modified_base (236)..(236): a, c, t, g, unknown or other
  misc_feature (236)..(236): n is a, c, g, or t
  modified_base (295)..(295): a, c, t, g, unknown or other
  misc_feature (295)..(295): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaacgccgtggggcctcagtgaaggtctccngcaaggcttcgtggattctaccgttacctctatagtatcaagtggtgcgcgaggccgcnggaacaacgacctaggagtggagtgggagttcgggaccgtaaacccgtaacgacgttggtcgtccgacgagttcgtccttaccgaccctacgttcccgtaccgggaactacgtaaccttaaccagtccgaaccaaccgtaaaccctaccgtacccgaaactaaaccaccgtaacgacccttaacagtacggtaggtttacgaggacgtccgtagactacgtcgtacggaacgaccgtccggtaccgttacttaacgtttacgtgtacggcgtaaacgtccgtacccgtaaccggtacggttccgggacgtaaccggacccgttaacgggcgtaccgggtcccggttaaccgttttaccggtaccggttcggtaaccggggg

SEQ ID NO: 209201 - DNA, 628 bp, Homo sapiens
  misc_feature: GYAE6OF02G3SJT.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcgagtgaaggtctcctgcaaggcttcgtggattcacggtttacctcctatagtatcaactgggtgcgccaggcccgctggacaacgacctggagtggagtgggatcggggacgtaacccctaacgacgttgggtcgtaccacgtacggtcgttccttaccacccctagtcccgtacccggggacagtaccttaccagtcgaacctacgaacctccctacctaagtaaaccactacgaccctaagtactgggtagttcggaggacgcctacgaacctgtaccgtgtaacccgacgaacccgggtccgttattacgtttaaccgtggtacgaccgtagtacccgtcccgaacgtcggtacccggtgaccggcccgtaggcacggtccgtaccgtttgtaccgttcggtacggg

SEQ ID NO: 209202 - DNA, 928 bp, Homo sapiens
  misc_feature: GYAE6OF02ID7HN.17.25.C03.1.454.CMB.1.raw
  modified_base (182)..(182): a, c, t, g, unknown or other
  misc_feature (182)..(182): n is a, c, g, or t
tcagcgtagactagcacgaccggtgctcgatttagtagtgtagatttgggtttggggactcaacaaccacatcgtgtcctctagagaaaccctgtgagcacagctcctcaccatggactggacctggaggatcctcttcgtggtggcagcagctacagtgcccatcccaggtgcagctggtncagtcgtgggctgaggtgaagagccgtgggctcgagtgaacggtctccgtgacgaaggtctcgtggacttctaccgtttacctccttagtagtactcgaaaccgttggggtaacgccgaccgtacggcccgtcgtacggaaccgtaaaccggtaccgtacggtaaggtcggtaggttacggggaggttaccgggggaacccgttaaaccccgtaacggttaccggttacgggttacggtaacccgtaacggttccggtacgtttacccgtttacccgtaaaccccgttaccggtttaccccggtaacccggggtaacccggttaaccgttaacccggttttaaaccccaaacggttacccgggtaaacccccgtaaacccgggtttaaccccttaacccccgttaaaccccgttaaaacccggtaaaaccccaccggtaacccggtaaccctaaacggtaccggttaacggggtaacgtttaacgggttaacggacccgttaacccgtacggttaaacaccgtttaccgaaccggaacccggtaaacccgtacccggggtacctttaccgttaaccgttttaaccgggtctccggggtaaacccggttaggacccggtttaaccccggaacggttaacccggttaccgggtacccggaaccggtttaccccggtaggggttacccggaacccggtttacccgttcccgggtttttaccggacccggttaccggttaccccgggggg

SEQ ID NO: 209203 - DNA, 606 bp, Homo sapiens
  misc_feature: GYAE6OF02GVD5O.17.25.C03.1.454.CMB.1.raw
  modified_base (185)..(185): a, c, t, g, unknown or other
  misc_feature (185)..(185): n is a, c, g, or t
  modified_base (287)..(287): a, c, t, g, unknown or other
  misc_feature (287)..(287): n is a, c, g, or t
  modified_base (301)..(301): a, c, t, g, unknown or other
  misc_feature (301)..(301): n is a, c, g, or t
  modified_base (365)..(365): a, c, t, g, unknown or other
  misc_feature (365)..(365): n is a, c, g, or t
  modified_base (393)..(393): a, c, t, g, unknown or other
  misc_feature (393)..(393): n is a, c, g, or t
  modified_base (437)..(437): a, c, t, g, unknown or other
  misc_feature (437)..(437): n is a, c, g, or t
  modified_base (455)..(455): a, c, t, g, unknown or other
  misc_feature (455)..(455): n is a, c, g, or t
  modified_base (478)..(478): a, c, t, g, unknown or other
  misc_feature (478)..(478): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtncagtcgtggggctggaggtgaagagccgtggggcctcagtgaaggtctcctgcgaaggcttctggacttctaccgtttacctcctatagtatcaagtgggtnccgccgaggcccgntggacaacgacctggagtgagtgggagtcgggaccgaacccctaagcgtggtgtaccataggtnttccttacgaccctagtcccgacggacngtacctacatcgaccacgacctcctacaataacacacgacctanagtggacgttaggaggcnccgtagacctagtctaggaaccncgacggtccgttcttacgttacgtggacgcggtacgacgtcccgtaacggtccgttacgggtaggaaccgtaccgttaccgggacgtcgggtacccggttcggtttacggtccgttccgggtacgggg

SEQ ID NO: 209204 - DNA, 601 bp, Homo sapiens
  misc_feature: GYAE6OF02G8DJX.17.25.C03.1.454.CMB.1.raw
  modified_base (389)..(389): a, c, t, g, unknown or other
  misc_feature (389)..(389): n is a, c, g, or t
  modified_base (436)..(436): a, c, t, g, unknown or other
  misc_feature (436)..(436): n is a, c, g, or t
  modified_base (454)..(454): a, c, t, g, unknown or other
  misc_feature (454)..(454): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaaggcttcgtggattcacgtttacctcctatagtatcaacgtgggtcgcgccgaggccgcgtaggaccaacgacctggacggtggagtgggagtgggaccgaaaccctaacacgtggtgtacacgagtcgtcttacaccctatcccgtcggaacngtacttaccatcgaccacgacctcctaccaataaccacacgacctanacgtggagttagaggacnctagacctagtctagaccgagaccgtaccgttacttacgttacgtgtacgacgtacgtcgtacccgacggtaccgtccgggtagaccggtacccgtacgggacctacgggtccgtaccgttttacggtaccgtttcgggacccgggg

SEQ ID NO: 209205 - DNA, 686 bp, Homo sapiens
  misc_feature: GYAE6OF02H2T5N.17.25.C03.1.454.CMB.1.raw
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
  modified_base (457)..(457): a, c, t, g, unknown or other
  misc_feature (457)..(457): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatctcttcttggtggcagcagctacaagtgcccactcccaggtgcagctggtgcagtctggggctgaggtgaagaagcctggggcctcgagtgaaggtctcctgcaaggtcttctggattcaccgtttacctcctatgtatcaacgtgggtncgccaggccncgtggacacggacctggagtggatgggatgggccgaaacctaacacgtggtgtcactagtcgtacttccaaccctatacccgtccgggaactacggtaaccttacccaatccgaaacccgaaccgtaaccttccctaccgaaataaaaccacacgtacccttaanacggttacggtaagtttcggaaacgggctaccccttggaaacctagttccggaacgtaaccggaccgtaccgggtacccgttacgttaactttaacggcgttcgaccggtacgtaaccggttcccccgaaggaaccgtttacccgggtgaacggtcccccgttaaagggcccgtaccgggtccgggtttaccccgttttacgggacccttttcccgggtacccgggggg

SEQ ID NO: 209206 - DNA, 749 bp, Homo sapiens
  misc_feature: GYAE6OF02IZ7HE.17.25.C03.1.454.CMB.1.raw
  modified_base (588)..(588): a, c, t, g, unknown or other
  misc_feature (588)..(588): n is a, c, g, or t
  modified_base (633)..(633): a, c, t, g, unknown or other
  misc_feature (633)..(633): n is a, c, g, or t
  modified_base (645)..(645): a, c, t, g, unknown or other
  misc_feature (645)..(645): n is a, c, g, or t
tcagcgtagactagcacgaccggtgctcgatttagtagtgtagatttgggtttgggggactcaacaaccacatctgtcctctagagaaaaaccctgtgagcacagctcctcaccatggactggacctggaggatccttcttcttggtggcagcagctacaagtcgcccacctcccaggtgcagctggtgcagtcgtggggtctggaggtgaagaacgccgtggggcctgagtgaggtctcctgcgaggtcttcgtggtattctacgtttacctcctaattagtactctaacgttcgggtgaccggccgacggcccgtcgtacggtaaccaaccggtaccgttcggaggttaggggaacggttgggggtaacgtacgggggaacccgtaaaaccccttaacgtaccggttagggttacgttacgaccggtacggttcggttacctttaccctacccctaacgttcccggtacccgggaactacgtacccttaacctacgtaccgaaccctaaccggtaacccttaccccaacgtaaactaaaacccgactaccgtacccgtaacgtagtaggtaggttacgagggtacnccgtagacctagttcgacggaaccgtaccgaccggttacccgttnttaactttacgngtacggacgacgtaccgttacccgaacggtacggttccggtagtaccgacgttaccggacgtacgggttcccggttacgtttacgttccggtccgggtacgggg

SEQ ID NO: 209207 - DNA, 648 bp, Homo sapiens
  misc_feature: GYAE6OF02JFHEX.17.25.C03.1.454.CMB.1.raw
  modified_base (450)..(450): a, c, t, g, unknown or other
  misc_feature (450)..(450): n is a, c, g, or t
  modified_base (460)..(460): a, c, t, g, unknown or other
  misc_feature (460)..(460): n is a, c, g, or t
  modified_base (477)..(477): a, c, t, g, unknown or other
  misc_feature (477)..(477): n is a, c, g, or t
  modified_base (485)..(485): a, c, t, g, unknown or other
  misc_feature (485)..(485): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaaggcttcgtggtattctacgtttacctcctatagtactcaacgtgggtgccgccgaggcccgctagggacaacgaccttaggagtgggagttgggagtcgggaccgtaaacccctaacacgttggtacgtacacgaggttcgttcttaccacccagttcccgtacgggactacggaccttaccgatcgaacctacgaacctcctacaataaaccncacgtccaanagtggtagttgacgganccgtgacntactaggaccgtacgaccggttccgttacttaacttcgcgttaacgcgtaacgtacccggttaccccaacggtaccggttcccgggtaacgtaccgtcccggttaccgggaacgtacccggtaccggttaccctttggttaacccggttcggtacccgggggg

SEQ ID NO: 209208 - DNA, 641 bp, Homo sapiens
  misc_feature: GYAE6OF02JAC2M.17.25.C03.1.454.CMB.1.raw
  modified_base (281)..(281): a, c, t, g, unknown or other
  misc_feature (281)..(281): n is a, c, g, or t
  modified_base (346)..(346): a, c, t, g, unknown or other
  misc_feature (346)..(346): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagctgggcctcagtgaggtctcctgcaaggtcttcgtggattcacgtttacctcctatagtactcaactgggtcnccgccgagggccgcgtggacaaccgacctggaggtggagtgggagtggggaccgaacccgtaacncgtgggtcgtaccacgtacgttgtccttaccaccctattcccgtccggacacgtaccttacagtacgaccaacgaaccttccaccaaataaaccgaccagaacccttacacgttagggtacttaggaaggtcgtaccctaggaacctaacttcccgacggaacccaacggtaccggggtacccttacgttactttacgcgttacgacgttacgaccgttaccacggttaccgcggtagaccgtccgtaccggtacgacggtccggttacctttacggtccgttacggtccggggg

SEQ ID NO: 209209 - DNA, 646 bp, Homo sapiens
  misc_feature: GYAE6OF02GNDP5.17.25.C03.1.454.CMB.1.raw
  modified_base (417)..(417): a, c, t, g, unknown or other
  misc_feature (417)..(417): n is a, c, g, or t
  modified_base (427)..(427): a, c, t, g, unknown or other
  misc_feature (427)..(427): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctctgcaaggcttctggattcacgtttacctcctatagtatcaactgggtgcgccaggccgctggaccaacgacctgagtggatggggatggggacgaaccctaacacgtggtgtacacagtctctttccaccccatcccgtccgggacacgacttaccatcgacccacgaacctcctaccaataaaccncagccctaanacgtaggagttgaggtatcctagactatcgtagaaccgaccgtacgggacccgttacgttaaacgtttacccgtggtacgggccgaacggtacccgtaccccgtaaacgggtaccgtttacccggggtcggaacggttcccccggttaacggggcccgttaacgggtccccggggttcccgtttttacgggtacccgttttccgggtacccgggggggg

SEQ ID NO: 209210 - DNA, 724 bp, Homo sapiens
  misc_feature: GYAE6OF02H9O2I.17.25.C03.1.454.CMB.1.raw
  modified_base (618)..(618): a, c, t, g, unknown or other
  misc_feature (618)..(618): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagaagcgtggggcctcgagtgaaggtctcctgcaaggtcttcgtggattctacgttttacctcctatacgtatacaacgtgggtcgcgaccgtaggccgcgtcggaaccgtaaacggtaccgtggacggtaggacgtggggaactcggggaccgtaaaaccccgtaatacggtaggttcgtacaaccgtaggttcgttacctttaccgaaccccgtaattccccggtacgggaactacggtaacctttaacccgagttaccggaaccctaaccggtaaacccttaccccgttaaccctaaacgttaaaaacccacgtaaccgtacccttaacgaagttcgggtaagttacggaacgggtacaccgttgactaacgtcgtacgaccgacgaccggtcgtcttaacgtttccgngtacgacgataccgtcccgaacggtacttcccgggtagaacccggttcccgtaaggtccgaacgggttcccggttaccgttttacgaccggtttcggacccggggg

SEQ ID NO: 209211 - DNA, 656 bp, Homo sapiens
  misc_feature: GYAE6OF02HZEDO.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcgagtgaaggtctcctgcaaggcttcgtggattctacgtttacctcctatagtactcaacgtgggtcgccgccgaggccgcgtcggacgaacgaccgtggagtggagtgggagtacggggacctaacccgtaacgacgttcggtcgtacacgtagttcgttacttaccaccctactacccgtaccgggactacgtaccttaccatacgaaccacgtaacctcctaccaactaaacacacgtacctaacagttacggtaacgttagggaacggtacgtaccgtaacgaacctagttccgtacgaaccgtaccggaccggttcccgttaacgttacgtttacgtaggtacgacgtacgtaccgtaccccgacggtacgtcccggtagaccgtaccgtacggcgtacggtccggttacctttcggtccgtcggtcgggg

SEQ ID NO: 209212 - DNA, 568 bp, Homo sapiens
  misc_feature: GYAE6OF02HBQKK.17.25.C03.1.454.CMB.1.raw
  modified_base (293)..(293): a, c, t, g, unknown or other
  misc_feature (293)..(293): n is a, c, g, or t
  modified_base (405)..(405): a, c, t, g, unknown or other
  misc_feature (405)..(405): n is a, c, g, or t
  modified_base (429)..(429): a, c, t, g, unknown or other
  misc_feature (429)..(429): n is a, c, g, or t
  modified_base (512)..(512): a, c, t, g, unknown or other
  misc_feature (512)..(512): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatccaactgggtgcgccaggcccgntggacaacgacctgagtggatggggatgggcgaaccctacacgtggtgtcactagtgtcttcacccatccctccgggacagacttacatcgaccacgactcctcaataaacncagcctacagtcgagttgaggacncctagacatcgtgaccgacaccgggtccttacgtacttaaccgtgttcggcgtaacggcgttaccccgaggtacgtccgggtnaacggtccctaacgggcctacggccggttcccttttggacctttcggtaccggggg

SEQ ID NO: 209213 - DNA, 587 bp, Homo sapiens
  misc_feature: GYAE6OF02GJ7VQ.17.25.C03.1.454.CMB.1.raw
  modified_base (307)..(307): a, c, t, g, unknown or other
  misc_feature (307)..(307): n is a, c, g, or t
  modified_base (438)..(438): a, c, t, g, unknown or other
  misc_feature (438)..(438): n is a, c, g, or t
  modified_base (456)..(456): a, c, t, g, unknown or other
  misc_feature (456)..(456): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcgtggggcctcagtgaacggtctcgtgcaacggtcttcgtggtacttccacgtttacctccttaagtagtactcaacgttgggtcgcgccgaggccgngtcggaaccaaccgacctgacggtggagtgggatcgggacaacctagcgtgtgtacactgtcgtctacacctactccgacggacacgtacctacatacgaccacgtaacctccacaataacacacgtccanacgtgagttagacggacncctgacactcgtacgcgaaccgcgtaccgtcttacttaacgtggtccgacgtagtcctaccgacggtaccgtccgtacgaccggtccgtacggacgtcggccggttacgtttcgtacgttcgggtaccggg

SEQ ID NO: 209214 - DNA, 789 bp, Homo sapiens
  misc_feature: GYAE6OF02H179H.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtcctccgtgcaaggcttcgtggattcacgtttacctcctatagtatcaacgttgggtagcgtccaagggcccgacgtacggaccaacggacctaggacgttggacgttgggggagttcggggaccgaaaaccccgttaaacgaccgttgggtacgttaccgacgtaacggtttcggttcctttaccaaccccgtacgttcccccggtaccggggaacccaaacgttaaccctttaaccctaagtttaccgaaccctaaccggtaaaccctcccgttacccaaagtaaaaccaacgacgtaccctaacgacgttagggtacgtttacggaaggaccgtcctacgaactaacgttactacgggaaaccgtacccggtaacccgggtccctacgttaacgtttaccgtacggttaccgggaaccgtacggtacccggttaccccaaccggggtaccgttccccggggtaacggtaccggtaaccccggtaacgggtacccgaaccggggtcccggttacccggttttttaccggtacccgttttccgggttaacccgggggg

SEQ ID NO: 209215 - DNA, 701 bp, Homo sapiens
  misc_feature: GYAE6OF02FQM0L.17.25.C03.1.454.CMB.1.raw
  modified_base (260)..(260): a, c, t, g, unknown or other
  misc_feature (260)..(260): n is a, c, g, or t
  modified_base (341)..(341): a, c, t, g, unknown or other
  misc_feature (341)..(341): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttaccnccgtatagtatcaactgggtgcgccaggccgctggacaacgacctgagtggatggggatgggcgaacctaacacgtgggtntcgacagtcgtcttaccaccctatcccgtcccggggaacaacggtaaccttacccaagtacgaaccctacgtaaaccccttccctaaccccaaacttaaaaaccaccgtaaccgacccttaaacgaacgttacgggaaggttttacggaacgggtacgtaccctaggaacctacgttacgttacggacccggaaccgtaccggggtacccggtactttaaacgtttaccgtaggttcggaccgtaacgtaccggtacccctaacgggtcgttacccgggttgaacccggtccccgttaaacggggcctaacgggcccgggtttcccgttttacggacccgttttccggtacccggggggg

SEQ ID NO: 209216 - DNA, 695 bp, Homo sapiens
  misc_feature: GYAE6OF02ICDZY.17.25.C03.1.454.CMB.1.raw
  modified_base (162)..(162): a, c, t, g, unknown or other
  misc_feature (162)..(162): n is a, c, g, or t
  modified_base (382)..(382): a, c, t, g, unknown or other
  misc_feature (382)..(382): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctctttcttggtggcagcagctacaagtnccactcccaggtgcagctggtgcagtcgtggggctggaggtgaagaagcgtgggcctcagtgaaggtctctgcgaaggcttctggtacttctacgtttacctcctatagtatcaacgtgggtcgcgtccgacggcgtctagggaaccaacggcctaggaggttcggaagtggggtaagtcggggaccgtaaaccctaactacggttggttacgaccacgngtttacggtctttaccaaccctacgtcccggtaccgggaacacgtacctttaaccacgtcgaacctaacgaaccgttaccctacaactaaacccaacgtacgaccctaacacgttaggtacgttacggaggtacgccgtagacctaactcgtacgaaccggacaccggggtaccttacttacgttaccgtaggtacgtacggtacgtacccggtaccgtaccggtaccggttccgggtacgtacccggtaccgtaacgggttcccgaacgggttccggttacccgtttcggttacccgtcggttaaccggggg

SEQ ID NO: 209217 - DNA, 648 bp, Homo sapiens
  misc_feature: GYAE6OF02H0JXI.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcacatcacttgccggacaagtcacggacttaaaacctatttaattggtatcagcagaaacctggaaaacgccccagaccctctgatctctggtcgcatccactctggcgtaagtcggccgtacccagtcggaggtttcaggtcggcgtagtggatcgtgggactagtactttacaactcctaccacctactcccaacctacctctcgacctaaccgtggaggtactttggtacactaaacttccgttaaccttaccgtacgtaaccctaaagtaacggttacgttaacccgtaccgtttccccctaccgtaccttttaacggttttccggaacccggtaacggggtaacccttaaggttcgaacgtaacgttaaccgaaaacgttaaccggttggttacgggtacccttacggtaccctaacccgtctttaccgttacgtttaccc

SEQ ID NO: 209218 - DNA, 740 bp, Homo sapiens
  misc_feature: GYAE6OF02G68QJ.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatccctccctgtctgcctcgtggtgggggtcagagtccaccatcacgttcggccggacaagtccaacggtacgttaaaaccttatttaaagttggtatcagcaagaaaccgtaggaaaaccgccccaagaccctcctagacttctcgtagggtcacctactccctaaccgttcgtacggaccggtaaacggttcgggtcccgtaccccgtaaggttccggtaacgggtttccgaagggttcggggaccgtagggttaggtacgttacggttacggggaaccttaggttaacttttaccgaaacgttccctaccgaaccctaactaccctaccctaacgtccgtacgaaacctaaccgtggtaagggttacgtttcggacgtacttaacgttaccttaacctacgttacgtaaccaaacgtacggttaacgttaacccgtcccgtttaccccgcgttacctttaccggtttacggaacccgggtaacgggtaaacctaggttagaacgtaacgtaaccgtaaacgtacgtggttacgaccgttacgacctacctagtcccgttgttaccc

SEQ ID NO: 209219 - DNA, 804 bp, Homo sapiens
  misc_feature: GYAE6OF02IOJMK.17.25.C03.1.454.CMB.1.raw
  modified_base (204)..(204): a, c, t, g, unknown or other
  misc_feature (204)..(204): n is a, c, g, or t
  modified_base (220)..(220): a, c, t, g, unknown or other
  misc_feature (220)..(220): n is a, c, g, or t
  modified_base (242)..(242): a, c, t, g, unknown or other
  misc_feature (242)..(242): n is a, c, g, or t
  modified_base (280)..(280): a, c, t, g, unknown or other
  misc_feature (280)..(280): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctgaggtnaagagcctggggcctnagtgaaggtctctgcgaggctntggattcacgtttacctcctatagtatcacgttgggtncggccgaggccgtcgtacgggacctaaccggtaccgtaggaggtgggacgtaggggtacgtacggggaccgtaaacccgtaacgtacgtgggtcgtacgtacgtaacggttgttcccttaccaacccctacgttacccgacccggggtaactacggtaacccttacccgaagtcccgacccgtaaccgtaaccctttcccgaaaccctaacgtaaaaccaacccgtagtaccccgttaaacgaggtttacggaacggtttaggaacgggtaccgtccgtacgacgtacgttacgacggtaaccggtaccggtaccggttacccggttcttaaaccgggttttacgtaccggttaacggtaccgggttacggtaccggttaccccccgtaagggtaacccggtttcccgggggtaaccggtaacccggttaccccgggttaaccggggttaaccgaacccgggggttcccggttttaaccccggtttttcgggtaacccggttttccgggggtaaccccgggggg

SEQ ID NO: 209220 - DNA, 654 bp, Homo sapiens
  misc_feature: GYAE6OF02HD2ZO.17.25.C03.1.454.CMB.1.raw
  modified_base (280)..(280): a, c, t, g, unknown or other
  misc_feature (280)..(280): n is a, c, g, or t
  modified_base (383)..(383): a, c, t, g, unknown or other
  misc_feature (383)..(383): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggacgtaacccaactactggtgtacacagtcgtcttcgaccccatccgtccggacagacttaccntacgaccacgtaactccctaccaattaaaccactacgaccctacatcgggaacgtttggaacggtacgcccgttagaaccgtacttaccgttaggaacccgaacgtacccgggaccgttaccgtttaacgtttaaacgttcgtacggtacggtaacgaccggttccccgtaaccgggtaaccttcccgggggtagaaccgggtcccggtaaaccgggtccgaaccggtaccgggtccctttttacggaaccgttttccgggtaccgggggg

SEQ ID NO: 209221 - DNA, 708 bp, Homo sapiens
  misc_feature: GYAE6OF02GQAMV.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggtcagcagctacaagtcgcccactcccaggtgcagctggtgcaggtctgggctgaggtgaaggaagccgtggggcctcagtagtaaggtcctcctgcaagggcttcgtggtattactacgtttaccctcttatacgtatcaacgtgggtcgaccgccgacggccgtcgtcggaacacgacctggacggtggagttcggggagtcgggaccgtaaacccctaagacgttaggtcgtaccgaacgtacggtcgttccttacctaaccccgacgttcccgtacccggggaactacgtaacccttaccgtaaactcggaaccctacgtaaacccgtccttaacctaaactaaaccaccctacgaaccctaactcggtaaggtacggttagaacgggaacgtcctaagacctacttacgacgtaccggacctaccgggtacctacgttaacttctacgggtcgtacgtacgtaccgtacccgtaggtaccgttcccgggttacgaacggttcccgtaacggtccgaacggcccggttacctttacggtaccgttcgggtaacccgggg

SEQ ID NO: 209222 - DNA, 773 bp, Homo sapiens
  misc_feature: GYAE6OF02H0TEJ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtcgcagctggtgcagtcgtggggctggaggtagaagaaggccgtggggcctcagtgaaggtctccgtgacgaaggctttcgtggtattctaccgtttacctaccttaatagttatacgtaactggggggggggtctcggccgacggcccgcgtacggaaccgaaccggtaccgtggtaacggtggacggtggggtagtacggggtaccgtaaaccccgtaacgtacgttcgggttacggttacgacgtacggttcgttaccgttaccgtaacccctacgttcccggtaccgggaaccgtaacgtacctttaccgtacgtaccgtaacccgtaaccgtaacccttacccgtaaccctaaactaaaaccaccgtaaccgtacccttaacacggttaggttaacggtttacggaacggtacgtaccgttacgtaacctacgttacgtacgtaaccgaacccgtaccgggtacccgttacttaacgtttaacgtacggttacgaccggtacgtaccgtacccgacggtaacggttaccgggtacgaccggtaccgtaacggacgtaccggtccggttaccgtttcggtaccgttcggtccgggg

SEQ ID NO: 209223 - DNA, 709 bp, Homo sapiens
  misc_feature: GYAE6OF02JYEQR.17.25.C03.1.454.CMB.1.raw
  modified_base (188)..(188): a, c, t, g, unknown or other
  misc_feature (188)..(188): n is a, c, g, or t
  modified_base (310)..(310): a, c, t, g, unknown or other
  misc_feature (310)..(310): n is a, c, g, or t
  modified_base (408)..(408): a, c, t, g, unknown or other
  misc_feature (408)..(408): n is a, c, g, or t
  modified_base (431)..(431): a, c, t, g, unknown or other
  misc_feature (431)..(431): n is a, c, g, or t
  modified_base (549)..(549): a, c, t, g, unknown or other
  misc_feature (549)..(549): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttgggtggcagcagctacaagtcgcccactcccgaggtgcagctggtncagtcgtgggctggaggtgaagagccgtggggcctgagtgaaggtcctccgtgcgaaggtcttacgtggtacttcctacggttttaccctcctaagtagtaacttcgaaaccgttggggtcnccggaccgacggtccgtacgttaggggaccaacgtacctggaggtaggaggttgggacgtacggggaccgtaaaccctaacgtacggtggtacgaccntaaggttcgtccttaccgacccnctacccggtaccgggtaataccgttaccgttaccagtaccgaaccgaccgtacctaccctacaactaaacacgacctacctacgaacgtggtacgttacgacggtacgtacccgtaanaccgtattccgtaacgaaccggaccgtccgggtactaacgttcttaacgcgtacggacgtacggtacctaccgtaaccgtcggtaccgtacggaaccggtcccggtaaggacccgtacggacccgtttcgttaccggtaccggttacggtaccccggggg

SEQ ID NO: 209224 - DNA, 708 bp, Homo sapiens
  misc_feature: GYAE6OF02IVXGY.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtgggcctcgagtgaaggtctcctggcaaggcttcgtggtattcgtacgtttacctcctatagtatcaacgtgggtgcgcgaggccgctggaacaacgcctggacgtggagtggggagtgggaccgaaaccctaacgacgtgggtctacgacgtagttcgtcctttaccaaccccgtagttcccggtaccgggtaacacgtaaccgttaaccagtaccgaacccgtaaccgaaaccttccctaaccgtaaactaaaacaccgacgtaccctaacgacgttaggtaacggttagaacggaacgtcccgtaagactacgtacgtacggaaccgtaccgaacccgggtcgtttaacccgttattacccggttaggacggaccggtaaccgtaccgttaccccgacggttaaccggttacccgggttacgaaccggtacccgttaaccgggccgtaacgggtcccggttaccgtttacggtacccgtttcgggtaccggggg

SEQ ID NO: 209225 - DNA, 555 bp, Homo sapiens
  misc_feature: GYAE6OF02F523C.17.25.C03.1.454.CMB.1.raw
  modified_base (369)..(369): a, c, t, g, unknown or other
  misc_feature (369)..(369): n is a, c, g, or t
  modified_base (446)..(446): a, c, t, g, unknown or other
  misc_feature (446)..(446): n is a, c, g, or t
  modified_base (482)..(482): a, c, t, g, unknown or other
  misc_feature (482)..(482): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccatgtgcagctggtgcagtctggggctgaggtgaagagccgtggggcctcagtgaaggtctcctgcaaggcttctggattcacgtttacctcctatagtatcaacgtgggtcgcgccgaggccgctggacaaccgacctgagtggagtgggagtgggaccaaccctaacacgtggtcgtacacgtagtcgtcttccaccntcccgtccggacacgtacttaccatacgaccacgaactcctaccaactaaacacacgcctacatggagttgaggacnccgtgacatcagaccgacaccggccgtactattcgngtgcgagcgtcccgaaggtacgtccgggtagacgtccgtacggccacgggtccggtccgtttcgacgttcggg

SEQ ID NO: 209226 - DNA, 815 bp, Homo sapiens
  misc_feature: GYAE6OF02FLJBO.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagccgtgggcctcgagtgaaggtctccgtgcaaggtcttcgtggattctacgtttacctcctatagtactcaacgtgggtcgcgccgacggccgcgtcggaccaaccggtacctggacggtggaagtggggaatcggggacctaaacccgtaacgtacgtggtcgtaccgtaacgtaggttcgtaccttacccgacccctacgttccccggtaccgggaacctacggtaaccctttaccgacgttacccggaacccgtaacccgtaacccttacccctaaccgtaaaaccttaaaacccgaccgtaaccggtaaccccttaaaccggtaacggttacggggttaacggtttacgggaacgggttaaccggtacccgttaggaaacccgttaacgttccgtaacgggtaacccggaacccggtacccgggttaccccgtttacgtttaaacccgtttaccggtcggttaccgggaaccggtaaccggtacccggtaccccgtaaccggttacccggttacccggggtaagtacccggttacccggtaaccgggccgtaacgggtcccggtttacccgtttacgggtacccgtttcggggtaacccggggg

SEQ ID NO: 209227 - DNA, 733 bp, Homo sapiens
  misc_feature: GYAE6OF02GJ30K.17.25.C03.1.454.CMB.1.raw
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtcctccgtgacaaggcttcgtggattcacgtttacctcctatagtatcaacgtgggtncgccaggccgntggacacgacctgagtggatgggatgggccaacctaacgactgggtactcaacagttgtaccttacacccctatcccgtaccgggaacacggtacctttaaaccacgtacggaacccaacggtaaccctcccgtaacaaaccgtaaaaccaacgaccgtaccctaacgtatacgggtaagtttacgggaacgggtacgtaccccgttaggaacctaagttaccggtacgaacccggaaccggtacccgggtaccccgttacgtttaaacgtttaccgttcgggtacgtaccgggtaacgggtaccgttaaccccccgtaacgggtaacggtttccccggggtaacggtaacccggttaccccggtaacgggtaccgaccggggttacccgggtttacccgtttttacgggaacccgttttcgggtaaccccggggggg

SEQ ID NO: 209228 - DNA, 872 bp, Homo sapiens
  misc_feature: GYAE6OF02IN1CI.17.25.C03.1.454.CMB.1.raw
tcagcgtagactagcacgaccggtgctcgatttagtagtgtagatttgggtttggggtacgtcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtggaacgaagccgtgggggcctctaggtgaaggtccgtccgtgacgaacgggtcttcgtggtatttacgtaccggttttaaccttccttagttaacgtaacttcctaaacggttgggtacggccggtacccgacgggtcccgtcgtacgggaaccaaaccgtacccgttaggagtaggggagtacggggtagttacgggggacccgtaaaacccgtaaacgccggttagggttacggtacgtaacgttaacggttcgttacctttcccgaaacccctacgttccccgtacccgggggaacctaaacggttaaccgttaaaccccgtagttacccggtaacccgtaaacccgtaaacccgttccccgtaacccgtaaaccgttaaaaacccacccgtaaacgtaccccgtaaacgtaacggttacgggaacgtttaacgggaacgggtaaccgtaccgtaacgtacgtaacgttactaacgggtaaccgaacccggtaaccggtaccggttaccttaacgttaccgttacggtacgggaccgtaacgggtacccgtaccccgtaaccggtaaccgggttcccggtaaggacccgttacccggtaacccggtcgtacgggtcccgggtttcccgtttaccggttaccggttccgggttaacccgggggg

SEQ ID NO: 209229 - DNA, 768 bp, Homo sapiens
  misc_feature: GYAE6OF02G5672.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcgagtagaaggtcctcctgcgtaaggtcttcgtggtacttcctaccgtttacctcctatacgtatctaacgtgggtcgccgccgaggccgtcgtggaaccaaccgtaccgtggaggtacggagtaggggagtcggggacctaaacccgtaacgacgttgggtacgtacgaacgtacgttcgttaccttccaaccccgtacgtcccgtaccgggaactacgtaacccttacccagttaccggaaccctaaccgtaacccttccccgtaaacctaaacgttaaaacccgaccgtaaaccgtaccccgttaacgaacggttacggggtaacgtttacggaacgggtaccgtcccgtacgtaacctaccttaccgtaaccggaacccgtaaccggtcccgggtacccgtttaccgtttaacgtttccgtacgggtcgaccggtacggtacccggtaccccgtaacggtccggtaccggtaggtacccgtacccggttacgggaccgtacgggtcccgttacccgtttcggtaccgttcgggtaacccggggg

SEQ ID NO: 209230 - DNA, 622 bp, Homo sapiens
  misc_feature: GYAE6OF02H433B.17.25.C03.1.454.CMB.1.raw
  modified_base (250)..(250): a, c, t, g, unknown or other
  misc_feature (250)..(250): n is a, c, g, or t
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
  modified_base (448)..(448): a, c, t, g, unknown or other
  misc_feature (448)..(448): n is a, c, g, or t
  modified_base (463)..(463): a, c, t, g, unknown or other
  misc_feature (463)..(463): n is a, c, g, or t
  modified_base (536)..(536): a, c, t, g, unknown or other
  misc_feature (536)..(536): n is a, c, g, or t
  modified_base (548)..(548): a, c, t, g, unknown or other
  misc_feature (548)..(548): n is a, c, g, or t
  modified_base (572)..(572): a, c, t, g, unknown or other
  misc_feature (572)..(572): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctaacaagtgcccactcccaggtgcagctggtgcagtctggggctggaggtgaagaagccgtggggcctcgagtgaaggtcctcctgcaaggcttcgnggattcacgtttacctctaatagtatcaacgtgggcncgcgaggccncgtaggacaacgcctggagtggacgtgggagtacgggaccgaaaccctaaacgacgttgggtcgtaccaacgtagttcgtacttccaaccccatcccgtcgggacagtaccttaacatcgaaccacgtaacctccgtaaccaataaaaccncaacgaccctaaagngtacggtacgttaggaacggacgtcttagaacgtattcgacgaacggacgaccgggtcctattaacgttacgngtcgccgttaanacgttccccaaggtcgttaccggngaaccgtcccgtacggctacggcccggtttctttacgccgtttgacgggg

SEQ ID NO: 209231 - DNA, 682 bp, Homo sapiens
  misc_feature: GYAE6OF02JH0LC.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaaggcttctggattcacgtttacctcctatagtatcaacgtgggtgcgccaggccgctggacacgacctggagtggagtgggatggggaccaacccgtaacacgtggtcgtcacagtgtccttcgaccctagtccgtaccgggactaggtaccttaccagtcgaaccacgtaacctcccgtaccaaagtaaaccacgaacgtaccctaactacggtacggtaacgtttaggaacggtaacgcccttaaggacctacgtttaccgtaacggaacccggtacccgtaaccggggtcccggttaccttaagtttaccgtacggttacggaaccggtaacgtacccgtaccccgtaaggtaaccggttcccggtagggtaaccgtccccgttaacgggcccgtaacgggtcccggttaccttttacggtaccgtttccggtaacccgggggg

SEQ ID NO: 209232 - DNA, 714 bp, Homo sapiens
  misc_feature: GYAE6OF02IJFM6.17.25.C03.1.454.CMB.1.raw
  modified_base (219)..(219): a, c, t, g, unknown or other
  misc_feature (219)..(219): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcctgggcctnagtgaagtctcctgacaggctcgtggattcacgtttacctctatagtatacaacgtgggtgcgccaggacccgctacgggacaaacggtacctggtaggtggagtgggagtcgggaccgtaaaccctacgaccgttggtgtaccgagtagttcgtccgttacaacccgtcgtacccgtccgggaacaacggtacttaccgaagttcgaacccgtaaaccgtaaccgttcccctaaccgtaaactaaaaccacccgtaagtacccgttaactaagtacgggtaacggtttaaggacggttacgaccgtacgacctaacgtccgtaagaccgtaccgaccggtaccttacttaactttacgtcggtacggtccgaacggtaccgtcccgaaccggtacgtacccgggttacggaccccgtaccccggttaacgggcccgaacggggttccccggtttacccggtttaggttaccccgttacgggtaccccggggggg

SEQ ID NO: 209233 - DNA, 561 bp, Homo sapiens
  misc_feature: GYAE6OF02FMR81.17.25.C03.1.454.CMB.1.raw
  modified_base (278)..(278): a, c, t, g, unknown or other
  misc_feature (278)..(278): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctggggcctcagtgaaggtctcctgcaaggcttctggattcacgtttacctcctatagtatcaactgggtncgccaggccgctggacaacgacctgagtggatggggatggggacgaacccgtaacacgtggtcgtcacgagtgtcttcaccctatccctaccgggacagtaccttacatcgaccacgtaactccctacaactaaacacaacgcctaacagtggagttgaggtagccgtgactatcgtgacgacacggcctactattactgtcgcgtagacgtcccgagtacgtccggtagtacggtacccgtacggccgacggtccggtccctttggaccgttcggtacgggg

SEQ ID NO: 209234 - DNA, 870 bp, Homo sapiens
  misc_feature: GYAE6OF02H6T3I.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttctggtggcagcagctacaagtgcccactcccaggtgcagctggtgcagtcgtgggctggaggtgaagaagccgtgggacctcgagtgaaggttctccgtgacgaaggtcttgtggtactttcgtaaccgttttacctccgttaagtaacgttataccgaaacgttgggtacgccgccgtaaggtcccgcgttaacggaaccaaaccggtaccgtggaaggttacgggtaaggtcggggtaacgtcggggaacccgtaaaacccgtaacgtacggttacgggtacgtaccaacggttacggtttcgtacccttaacccgaacccgttacgttaccccggtaccggggaactaacggtaaccgtttaacccgagtttaccgaaacccgtacgtaaacccgttcccctaaccgtaaaaccgttaaaaccgacccgaacgtaccccttaaaccgtaaggttaccggggtaacgtttaacgggaaccgttaacggtcccgttaaggaacctaacggttacccgttaccggtaaaccggacccgtaacccgggttcccgttaacgttttaaaccgtcggtttacggaaccggacccggtaacggttaacccgtacccccggtaacggccggtttaaaccccgggtgaaaccccgggttaccccgtaaggggtacccgttaacgggtccccgggttttaccgtttaaccgggttacccgtttcgggtaaccccgggggg

SEQ ID NO: 209235 - DNA, 777 bp, Homo sapiens
  misc_feature: GYAE6OF02HZ8T1.17.25.C03.1.454.CMB.1.raw
  modified_base (234)..(234): a, c, t, g, unknown or other
  misc_feature (234)..(234): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtgcccactcccaggtgcagctggtgcagtctggggctggaggtgaagaagccgtggggcctcagtgaggtctcngcaggctctggattctacgtttacctcctatagtatcaagtgggtgcgccgaggccgtcgtggaaccaaccggacctggtaggtcggtaggtcggggtagtcggggaccgtaaaccccgtaacgtacgtcgggtcgtacgaacgtaggtcgttcgtttacccgacccctacgtccccggttaccgggaactaacgtaaccgtttacccagtaccgaacccaacgtacctaccctaaccctaaacgtaaaacccaaccgacctaccctaaacgacggttacggtaacggttacggaacgggtacgtcccgttaagaaccaccgtttccgtaaccgggtaaccggaacccggtaacccggggtcccgtttacgtttaaacccttacgggttagtacgggtaacccgacggttaacccggtaccccgtaacggttaaccgggttcccgggtttaacggacccgttaccccgggttaccgggaaccggtacccgggttaccccggttcccggtttttaagtccccgggtttacgggtacccgggggg

SEQ ID NO: 209236 - DNA, 820 bp, Homo sapiens
  misc_feature: GYAE6OF02GMGFM.17.25.C03.1.454.CMB.1.raw
  modified_base (209)..(209): a, c, t, g, unknown or other
  misc_feature (209)..(209): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactccagtgcagctggtgcagtcgtgggctgaggtgaagaagccnggggctcaggtgaaggtctccgtgcaaggcttcgtggacttcgacgtttacctcgtatagtatcaacgtggtcgcgtccaggtccgcttgggacaaccgtaccgtagaccggttggaagttcgggattcggggacccgtaaacccgttaaccgacgttacgggttctaccgaacgtacgggttgtccgtttaccgacccccaaggtttcccgtaccgggggtaacctaaacggggttaaccccttaacccgtacggttaccgaaacccgtaacccgggtaaacccgtttaccccgttaaccgaaaacctttaaaacccgtaaacgaccgttaaccccgttaaccggaacgtttacggggtaaaccggttttacgggaacggggttaaacccgtcccggttttaacgaaccgtacgttaccgttaccgggaacgtaacccgggtacccggtacccggtttacttaacggtttaacccgtggtttaccggaaccggtacgtacccgttaccggaaaccggtcggttttaacccgggcgtaacgtaccccgtttaacgggcgttaaccgggtccgtttacccggttttagaccggtttcccggttaacgggggg

SEQ ID NO: 209237 - DNA, 691 bp, Homo sapiens
  misc_feature: GYAE6OF02IWLYL.17.25.C03.1.454.CMB.1.raw
  modified_base (236)..(236): a, c, t, g, unknown or other
  misc_feature (236)..(236): n is a, c, g, or t
  modified_base (248)..(248): a, c, t, g, unknown or other
  misc_feature (248)..(248): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctgggcctcagtgaggtctctgcaggctngattcacttccnctatagtactcacgtgggtgcgccaggccgcgtcggacaacgacctggacgtggagtgggagtcgggaccgaaccctaacgcgttggtgtccacgtagtcgttccttccgaaccctacgtcccgtaccgggtacaacgtacccgttaaccacgttaccgaacccgtaaccgtaaacccgtaccccgtaccaaacgtaaaaccctaccgaaccgtacccctaaacgtacgttacgggtaaggtttacggaagggtaccggacccgtttagggaccctaaggttccctaaggtaacccggaccggtaacccggtcccggttacttaaccgtttacgtacggttcgtacgggaccgtaccgtacccgtaacgtaaccggttccggtacggacgtacccgtaggtaccgacggtaccggttccgttacggttccgttacgccggggg

SEQ ID NO: 209238 - DNA, 822 bp, Homo sapiens
  misc_feature: GYAE6OF02IJZ9Z.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcgagtgaaggtctcctgcaaggcttcgtggattcctaccgttttacctcctaatagtatcaacgtgggtgcgccgaggcccgcgtaggaccaacggacctggaggtggagtggggacgtacggggaccgtaaaccccgtaacgacgtgggttacgtaccgaacgtacgttcgttccttaccctaaccccgtacttcccggtacccggggaactaacggtaaccctttacccgacgttaccggaacccgtaaccgtaaacccttaccccgtaacccctaaacttaaaacccgaacccgtaaaccgtaccccgtaaaccgtaacggttacgggttaacggtttaacgggaacggtaaccgtacccgttaacgaaccgtaacgttaccgtacggtaaacccggaacccggtaaccccggggtacccgtttaaccgtttaaaccgttttaaccggttacggtaccgggaccggttaaacggtacccgtaaccccgtaaccggtaaccggttacccgggtacggtaacccggtaccccgttaaccggggaccgtaaccgggtcccggtttacccgttttaacggttcccgttacgggtacccggggg

SEQ ID NO: 209239 - DNA, 347 bp, Homo sapiens
  misc_feature: GYAE6OF02GIEKS.17.25.C03.1.454.CMB.1.raw
  modified_base (243)..(243): a, c, t, g, unknown or other
  misc_feature (243)..(243): n is a, c, g, or t
  modified_base (282)..(282): a, c, t, g, unknown or other
  misc_feature (282)..(282): n is a, c, g, or t
  modified_base (337)..(347): a, c, t, g, unknown or other
  misc_feature (337)..(347): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagccgtggggcctcgagtgaaggtctcctgcaaggcttntggattcacgtttacctcctatagtatacaacgtgggtnccgccaggccgctggacaacgaccgtgacggcggcgtggcgaaggcgacagtagnnnnnnnnnnn

SEQ ID NO: 209240 - DNA, 697 bp, Homo sapiens
  misc_feature: GYAE6OF02FYJBQ.17.25.C03.1.454.CMB.1.raw
  modified_base (280)..(280): a, c, t, g, unknown or other
  misc_feature (280)..(280): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaaggcttctggattcacgtttacctcctatagtatcaactgggtncgccgaggccgctggacaacgacctgagtggagtgggatcgggacgaaccctaacacgtggtcgtacacgaggttcgtaccttcgacccctagtcccgtaccggggaactaacggtaccttacccgataccggaacccaacggtaaccctcccctaaccgaaactaaaacccacaaccggtaccctaacaacgttacggggtaagtttacggaacgggtaacgtcccgtaggaacctacgttccttaacggaacccggtaaccgaccggggtcccgttacgttaaccgtttaccgtcggtacgaccggacgtacccggttccccgaacggttaccgtcccgggttacgaccggttcccgtaacgggcctaacgggtcccggttaccgttttacggtacccgttcgggtacccggggg

SEQ ID NO: 209241 - DNA, 762 bp, Homo sapiens
  misc_feature: GYAE6OF02JSQZ3.17.25.C03.1.454.CMB.1.raw
  modified_base (200)..(200): a, c, t, g, unknown or other
  misc_feature (200)..(200): n is a, c, g, or t
  modified_base (249)..(249): a, c, t, g, unknown or other
  misc_feature (249)..(249): n is a, c, g, or t
  modified_base (288)..(288): a, c, t, g, unknown or other
  misc_feature (288)..(288): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccgactcccaggtcgcagctggtgcagtcgtgggctgnggtgaagagccgtgggcctcgagtgaaggtctcctgacaaggtcttcgnggacttcacgtttacctcgtatacgtatcgaacgtgggngtccgcgagtccgcgtggaccaacgcctaggcggtggtagtggggactcgggggacctaaaccccgtaatacggtgggtacgtaccgtacgaggtttgttacccttccaaacccccgtattccccggtacggggaaactaccgtaacccgtttaacccgagttccgaaacccgtacgtaaaacccctcccgttaaaccccgtaaacttaaaaacccgaccgtaaccgtacccttaaacgtacggtttaaggggtaacggtttggaacgggtaacgtcccgttaacggactaaacggttccgtacgggaaccgtaacccggccgggttaccgttaaccgttttagttaaccgttggtacgacggaccggtaccgtaccccgaacggttccggtaacgggtttacgaaccggtaacccggtaccgggtcgtaacggtcccggtttaccgtttacgggtccggtttaccggcggggg

SEQ ID NO: 209242 - DNA, 617 bp, Homo sapiens
  misc_feature: GYAE6OF02IPKEG.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctcggacaacgacctggagtggatgggatcgggccgtaaacccgtaacgacgtggtgtcacgtagttcgtcctttccgacccctattcccgtaccggggacacgtacttaccatcgacccaacgaaccctccctaccaataaaccacacgaccctaacagtggtagttggaggacgcctagacctatctggaaccgacgaccggtccctacttactttacgtgtacgcgtacgtacgtccccgaacggcttcccgggtagaaccggcccgttaacgggccgtacggtcccgggtcccgttttacggaccgtttccgggtaccggggg

SEQ ID NO: 209243 - DNA, 612 bp, Homo sapiens
  misc_feature: GYAE6OF02GS8WF.17.25.C03.1.454.CMB.1.raw
  modified_base (246)..(246): a, c, t, g, unknown or other
  misc_feature (246)..(246): n is a, c, g, or t
  modified_base (434)..(434): a, c, t, g, unknown or other
  misc_feature (434)..(434): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcgagtggaaggtctcctgcaaggtcttntggattctacgtttacctcctatagtatcaacgtgggtgccgtccaggcccgcgtgggacaacgacctgaggtggatggggatcgggaccaacctacacgtggtgtaccacgtagtcgtccttccaccccagtcccgtaccggggacacgtaccttaccatcgacccacacctccctaccaataaacncgaacgccctaacgagtcggtagttggacgacgtcctacgactcgtctacggaccgacgccggtccgtacttacgttactggtacgcgacgtaccgtcccgaacggttcgtacccggcgtacgtacccgtacggacctacgggtccggttccctttaggtaccgttcgggtaccgggg

SEQ ID NO: 209244 - DNA, 668 bp, Homo sapiens
  misc_feature: GYAE6OF02GYN0N.17.25.C03.1.454.CMB.1.raw
  modified_base (347)..(347): a, c, t, g, unknown or other
  misc_feature (347)..(347): n is a, c, g, or t
  modified_base (471)..(471): a, c, t, g, unknown or other
  misc_feature (471)..(471): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtctcctgcaaggcttgtggattcacgtttacctcctatagtatcaacgtgggcgcgccgaggccgcgtggaaccaacggacctggacgtggagtgggatcggggaccaaaccctanacgtggtcgtcacgaggttcgtcttaccgaccctacgttcccgtaccgggaacagtaccttaccagtacgaaccgaacgtaaccctaccctacctaaactaaaccgaccgacgtaccctaaacngtagggtagttacggacggtacgccgtagaacctgtaccgtacggaaccgaaccgtccgggtacccttacgttacgttacgtggttacgacgtaacgtaccgtaccctacggtaacgtccgggtacggaaccggtacccgtaaccgggaccaccgggtcccggttacgtttaccggttacgttacccggtacggggg

SEQ ID NO: 209245 - DNA, 684 bp, Homo sapiens
  misc_feature: GYAE6OF02IKOK1.17.25.C03.1.454.CMB.1.raw
  modified_base (289)..(289): a, c, t, g, unknown or other
  misc_feature (289)..(289): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtgggcctcagtgaaggtctcctgcaaggcttctggacttctacgtttacctcctatagtatacaacgtgggtgcgccnggccgctcggacaacggcctgaggtggagtgggagtcgggaccgtaaaccctaacgacgtggtcgtacacgagtgtacttccgaccctatccgtccggaactacgaccttaccgatacgaccacgtaaccctccacaactaaaccactacgaccctaagagttaggtaggttaacgagggacgtacccgttagaacctaagttcgtacggtaaacccgacggtaacccgggttccttaacgtaaacgttttaccgtggttaaccgaccgggtaaccggtacgtaaccccggtacggtacgttacccgggggttaaaccccgggtacccggtaacgggccctaacgggttccccgggtaccctttttacgggaacccgtttcgggtaaccgggggg

SEQ ID NO: 209246 - DNA, 575 bp, Homo sapiens
  misc_feature: GYAE6OF02G5TFW.17.25.C03.1.454.CMB.1.raw
  modified_base (339)..(339): a, c, t, g, unknown or other
  misc_feature (339)..(339): n is a, c, g, or t
  modified_base (356)..(356): a, c, t, g, unknown or other
  misc_feature (356)..(356): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctggggcctcagtgaggtctctgcaaggcttcgtggattcacgtttacctctatagtactcaactgggtcgcgccgaggccgcgtcggacaacgccgtggagtggaatggggatcgggaccgtaaccctaancgtggtcgcactaggtntcgtacacccctagtcccgtccgggactacgaacttaccgatacgaccaccgtacctcctacaactaaacacacgacctacactagagttagacggactccagacacgtctgaccgacgacgccttacgactttacgtgtgaccgtagaccgtaccgaacgtcgtaccggtgaccgtaccgtacggtcacggccggttctttagtcccgttgaccgggg

SEQ ID NO: 209247 - DNA, 923 bp, Homo sapiens
  misc_feature: GYAE6OF02GR9OZ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctaacaagtgcccactcccaggtgcagctggtgcagtcgtgggctgaggtgaagagccgtgggcctcgagtgaaggtcctcctgacgaaggtccttcgtggtactttcgtaaccgttttaccgtaccttaattaacgttactaccgtaaacgttcggggttacggccggacccgaacggggtcccgtacgttacggggaaacctaaaccggtacccgttaggaaggtagggtaaggttcggggaacgttacgggggaacccgtaaaaaccccgttaaaccgtacggttacggggtacgttaccgaaaccgttaacgggttcgttacccgtttaaccgaacccccgttaaacggttcccccggtaacggggaaaccttaaccggtaaacccttttaaacccgacgtaacccggtaaaccccgaaacccggttaaaccccttaccccgttaaaccaaaaaccgttaaaacccgaaacccgtaacgtaaaccccgttaaactaaacgggttagggttaaacggttcgggaaacggttaccgtcccgttaagtaaccgtaacttccggtaacggaaacccgtaaccgtacccgggttaccctttaacgttaacgtttaaccgtcggtaacggtaccggaaagttaccccggtaccccgtaacgggttaaccgttacccgggtaaccggtaaccggttaaccccgttaaccgggaccgttaccgggtaccccggttttaccgtttaccggttacccggtttacggtaacccggggg

SEQ ID NO: 209248 - DNA, 738 bp, Homo sapiens
  misc_feature: GYAE6OF02JYNH1.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctctgcgaaggcttgtggtctttcctaccgtttacctcttatagtataccaacgtggggttcgccgccgtacgggcccgtacgtcgggaaccgaaccggacctaggacggtgggacggtaggggtacggtcggggaaccgtaaccccgtaactacgtcgggtcgtaccgacgtagttcggttaccttacctacccgtaccgttacccgtaccggggtaccaacggttacccttaaccgtacgtccggaaacccgaaccgttaacccctccctaactaaaccgtaaaccaaccgtaaccgtacccttaacgaacgttcgggtaagttacggacggaacgtcgtacgactatccgtaacgaaccgacggtacccggtaccttgtaacctttaacggtggttaacggacggtaaccgaccgtacccgacggtaccggtccggtaacggtaaccgtcccgtacggtcgaccgtccgggtacctttacgggtaccgttccgggtaccggggg

SEQ ID NO: 209249 - DNA, 628 bp, Homo sapiens
  misc_feature: GYAE6OF02IOU30.17.25.C03.1.454.CMB.1.raw
  modified_base (284)..(284): a, c, t, g, unknown or other
  misc_feature (284)..(284): n is a, c, g, or t
  modified_base (347)..(347): a, c, t, g, unknown or other
  misc_feature (347)..(347): n is a, c, g, or t
  modified_base (439)..(439): a, c, t, g, unknown or other
  misc_feature (439)..(439): n is a, c, g, or t
  modified_base (523)..(523): a, c, t, g, unknown or other
  misc_feature (523)..(523): n is a, c, g, or t
  modified_base (566)..(566): a, c, t, g, unknown or other
  misc_feature (566)..(566): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctaacaagtgcccactcccaggtgcagctggtgcagtcgtgggctgaggtgaagagccgtggggcctcagtgaaggtctcctgacaaggcttcgtggattctacgtttacctctatagtatcaacgtgggtncgccaggccgcgtggacaacgcctggagtggagtgggatcgggacaaccctaacgacgtggtntaccacgagttcgtccttaccacccgtacttcccgtccgggaacacgtaccttaccagtacgaacccacgtaacctccctaccaataaaccncactacctagtacgtagggtacgttagaacggcgtacctacgactatcgacgaaccgaccgacggtcccgttatacgtttacgnggttacgacggtacgtaccgtacccgacggtcgttacccgggngtacccgaccgtacgggacgtacgggtcccgttaccgtttcggtaccgtttcgggaccgggg

SEQ ID NO: 209250 - DNA, 700 bp, Homo sapiens
  misc_feature: GYAE6OF02ISNLU.17.25.C03.1.454.CMB.1.raw
  modified_base (272)..(272): a, c, t, g, unknown or other
  misc_feature (272)..(272): n is a, c, g, or t
  modified_base (510)..(510): a, c, t, g, unknown or other
  misc_feature (510)..(510): n is a, c, g, or t
  modified_base (523)..(523): a, c, t, g, unknown or other
  misc_feature (523)..(523): n is a, c, g, or t
tcagcgtagactagcacgaccggtgctcgatttagtagtgtagatttgggtttggggactcaacaaccacatctgtcctctagagaaaaaccctgtgagcacagctcctcaccatggactggacctggaggatcctcttcttggtggcagcagctacaagtgcccactcccgaggtgcagctggtgcagtcgtggggctggaggtagaaagaacgccgtggggcctcgagtgaacggtctcctgacaaggctcgtgacttctacgtttaccncctaatagtatacgaacgtgggtagccggacctacgggcccgtcgttacgggaaccaaaccggaccgtggaacggtagggtaagtggggaacgtacgggggaaccgtaaaacccgtaacgtaccggttagggtacgtaccaagtagttcgttccgttaccaacccgtaagtcccggtaccggaactaacgtaccttaaccagtaccaaccgaacgtaaccctacctacaaataaaccncaacgtacctacncgtaggagttacggagtacgactacgactactcgtacgaaccgacgtaccggcgttacgttaaacttcggtacggtagtaccgaacgtaccgtacctaacggcggttaaccggtgaaccgtccggtaaccgacggtcgggtacccggttgttaaccggttaccgttgggacccgggg

SEQ ID NO: 209251 - DNA, 720 bp, Homo sapiens
  misc_feature: GYAE6OF02HP4EJ.17.25.C03.1.454.CMB.1.raw
  modified_base (279)..(279): a, c, t, g, unknown or other
  misc_feature (279)..(279): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatccctccctgtctcgcctctggtgggggtcagacgtcaccatcacttgccggacaagtcacggacttaaaacctatttaaatggtatcagacagaaacctaggaaaacnccccagaccctcagactctcgtggtcgcactcctactctggacgaaggtcggccgtacccaagtccggtaaggtttcaggtcgggactaggtggtacttcggtagggaactaggtaactttacaacgttcctactaacccaatccctaaccctacttaccgtacggtacctaacccgtaggtacggttattacggacgttaacctaaactttacccgtaaccttacgtacgtaacccgaacgtaaacggttaaccgtttaaccctaacccggtttacccccctacgtaacccggttttaacccggttttaccgggaaccccggaaaccggggggttaaaccttaaacggggttacgttaaacggtaactaaacccgtaaaaccggtaacggttacggtacggtaccgtaccggacctaaccggtacttcgttacgttaccc

SEQ ID NO: 209252 - DNA, 802 bp, Homo sapiens
  misc_feature: GYAE6OF02IGH2X.17.25.C03.1.454.CMB.1.raw
  modified_base (221)..(221): a, c, t, g, unknown or other
  misc_feature (221)..(221): n is a, c, g, or t
  modified_base (234)..(234): a, c, t, g, unknown or other
  misc_feature (234)..(234): n is a, c, g, or t
  modified_base (275)..(275): a, c, t, g, unknown or other
  misc_feature (275)..(275): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagagccgtgggcctnagtgaagtctccngcgagtcttctggacttctaccgtttacctcctatagtacnctaacgtgggtcgaccgccgacggcccgcgttacggaacctaaccggaccgtggtacggttacggaggttacggggtacgtccggggacccctaaaaccccgtaaaccgtacggttacgggttaccgtaccgaccgtacggttcttcccgttacccgaacccctacgttccccggtaccggggaacctaacgtacccgtttaacccacgtttaccgaaccccgtaaacccgttaaccttaccccgtaaccctaaacgtaaaacccgaccgtaaccgtaccctaaacggtacgttacggtaacgggtttaacggacggtaccggttaccgttacgaccgtacgttaccggtaacgaaccggtaacccgacccgggttacccgttaccgtttaacgtttacccgttaggtccgggtacgtaaccggtaccgttcccctaacgggttccggtacccggtagggacccgttaccgacccgggttaccgccgggtaccggttccctttacggaccgtttccgggtaccgggg

SEQ ID NO: 209253 - DNA, 738 bp, Homo sapiens
  misc_feature: GYAE6OF02HEFK4.17.25.C03.1.454.CMB.1.raw
  modified_base (285)..(285): a, c, t, g, unknown or other
  misc_feature (285)..(285): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcgagtgaaggtctcctgcaaggcttcgtggattctacgtttacctcctatagtatcaacgtgggtncgccgaggccgctggaccaacgacctggagtggagtgggatcggggaccaaaccctaagacgtggtacgtacacgtagtcgttccttaccaaccccgtacgtcccgtaccgggaactacggtaaccttaccagttacgaacccctaacgtaaccctccctaaccaaattaaaacccaccgtaacgacccttaacacggttgggaacgtttaggaacgggtacgacccttaggacctacgttaccgtacggaacccgtaaccgacccggggtacccttacgtttaacgttttaccgtacggtacgggtaccgtaacggtacccggtacccccgtaagggttaaccggttccccgggtaaggtacccgtaacccggttaaccgggaccggttaaccggggtcccggtttaacccgtttttacgggtaaccccggttttccgggtaacccgggggg

SEQ ID NO: 209254 - DNA, 591 bp, Homo sapiens
  misc_feature: GYAE6OF02GS4DV.17.25.C03.1.454.CMB.1.raw
tcagcgtagactagcacgaccggtgctcgatttagtagtgtagatttgggtttggggactcagcaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacacgacctgagtggatgggatgggaccgaaccctaacacgtggtgtacacgagttgtcctttcaccctatcccgtccgggacacgtacttaccatcgacccacgactcctaccaataaaccacacgtccctaacagttggtagttagaggacgtcctagacctagttccgagacgaccgtaccgggtcccgttacttaacgttacgtggttcgacggtagtaccgtccccgacggtacgtcccgggtagaccggcccgtacggcgacggtccggtcctttaggaccgtttccgggg

SEQ ID NO: 209255 - DNA, 639 bp, Homo sapiens
  misc_feature: GYAE6OF02IC5MA.17.25.C03.1.454.CMB.1.raw
  modified_base (465)..(465): a, c, t, g, unknown or other
  misc_feature (465)..(465): n is a, c, g, or t
  modified_base (480)..(480): a, c, t, g, unknown or other
  misc_feature (480)..(480): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtgcccactcccaggtgcagctggtgcagtctggggctgaggtgaagagccgtgggcctcagtgaggtctcctgcaggtcttcgtggtattcgtaccgtttactcctatagtatcaagtgggtcgcgccgacggccgcgttacggaacaacggtacctggagtggacggtcgggtagtcggggaccgtaaacccgtaacgacgttcggtgtaccacgtagtcgttcttacccaccctacgtcccgtacgggaacctacgtaccttaccagttacgacccaacgtacctaccctaccaactaaaccncgacgtacctaacgngtacggagttacgagacgtcgacactatcgtacggaccgaaccgccggttccgtacttacgttacgtgaccgtacgagtacccgcccgtacgtcgtcccggagaccgtaccgtaccgcgtaccggtcccgtcgttttacggaccgttcgggtaccgggg

SEQ ID NO: 209256 - DNA, 550 bp, Homo sapiens
  misc_feature: GYAE6OF02I8A4U.17.25.C03.1.454.CMB.1.raw
  modified_base (409)..(409): a, c, t, g, unknown or other
  misc_feature (409)..(409): n is a, c, g, or t
  modified_base (424)..(424): a, c, t, g, unknown or other
  misc_feature (424)..(424): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctcagtgaaggtctcctgcaaggcttcgtggattcacgtttacctcctatagtatcaactggtgcgccaggccgctggacaacgacctgagtgatgggatgggacgaacctaacgacgtggtgtcacgagtgtcttcaccctatccgtacgggacagacttacgatcgaccacgactccacaataacacagccanatggatacgaggacnccgtgacactcgtcgaacgacgacggtcctacgttattacgtgtacgcgacgtactacccgagtacgtccggtaggaccgtaccgtacggcgacggtccggtcctttggtaccgttcggtacgggg

SEQ ID NO: 209257 - DNA, 780 bp, Homo sapiens
  misc_feature: GYAE6OF02IRWKN.17.25.C03.1.454.CMB.1.raw
  modified_base (220)..(220): a, c, t, g, unknown or other
  misc_feature (220)..(220): n is a, c, g, or t
tcagcgtagactagcacgaccggtgctcgatttagtagtgtagatttgggtttggggactcaacaaccacatctgtcctctagagaaaaccctgtgagcacagctcctcaacatggactggacctggaggatcctcttcttggtggcagcagctacaagtgcccactcccaggtgcagctggtgcagtcgtggggctggaggtgaagagccgtgggcctnagtgaaggtctcctgacaggcttctggattctacgtttacctctagtagtatcaacgtgggtgccgcacggccgcgtaggaacaacggccgtaggagtggagtggggagtcggggaccgtaaacccgtaacgtacggtgggtcgtacgaacgtaggttcgtcctttaccgacccgtacgtcccggtaccggggactaacggtaaccctttaccgagttaccgaacccgtaaccggtaacccttaccccgtacctaaacgtaaaaacccgaccgtaaccggtacccttaaacgtaacggtacggggttaacgttacgggaacgggtacctacccgtacggtacctaacgttccgtaacggaaccggtaacccggtaacccgggtcccgtttaacgttaacgtttaccgttaggacggtaccggaacgtaccggttaaccccgtacgggtaacccggttacccgggtacggtaacccggtaccccgtaaccgggggtaccgtaacccgggtcccgggtttacccgttttaccgggtaacccgtttcggggtaaccccggggg

SEQ ID NO: 209258 - DNA, 607 bp, Homo sapiens
  misc_feature: GYAE6OF02JBDNO.17.25.C03.1.454.CMB.1.raw
  modified_base (279)..(279): a, c, t, g, unknown or other
  misc_feature (279)..(279): n is a, c, g, or t
  modified_base (381)..(381): a, c, t, g, unknown or other
  misc_feature (381)..(381): n is a, c, g, or t
  modified_base (409)..(409): a, c, t, g, unknown or other
  misc_feature (409)..(409): n is a, c, g, or t
  modified_base (421)..(421): a, c, t, g, unknown or other
  misc_feature (421)..(421): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagccgtggggcctcagtgaaggtctcctgcaaggcttctggattcacgtttacctctatagtatcgaactgggtncgccaggccgctggacaacgcctgagtgatgggatgggacaacctaacgactggtgtcagagtcgtcttacaccctactccgtacggactagtacctaacgntacgaccaacgactcctacaataaacanacgacccttaancgtaggtagttgagggactccgtagactataccaggtaccgaaccaccggttccgtacttaacttccacggttagccgtaaggtaccgttaccccaaggtacgttacccgggttacgaacggtaaccccgtcgggtaacctacgggaaccggttcccgttttaggaaccgttttcccggacggggg

SEQ ID NO: 209259 - DNA, 794 bp, Homo sapiens
  misc_feature: GYAE6OF02GYDDT.17.25.C03.1.454.CMB.1.raw
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctggaggtgaagaagccgtggggcctcgagtgaaggtcctccgtgcaaggcttcgtggattcacgtttacctcctatagtatcaacgtgggtncaccgnggccgctcggacaaccgacctggagtcgggagtgggagtcggggaccgtaaaccctaacgacgtcggtcgtcacgaggttcgttctaccgaccctacgttcccggtaccggggaacctacggtaacctttaaccgacgttaccgaacccgaaccggtaaaccctttcccctaacccgtaaaacgttaaaaccccgaacgtaacccggtacccttaaacgtaacggttaagggtaacggtttacgggaaacggggtaccggacccttaagggaaccttaaccgttacgtaacggtaacccggtaccgttaacccggggttacccgtttacgttttaaactttaacccggttgggttaacgggaccggtaaccggtaccccgttacccggtacccggtaacgggtttacccgggtaggtaacccggttacccgttaacccggggcttacccgggtcccggtttaacccgttttcggttaaccccggtttggtaacccggggggg

SEQ ID NO: 209260 - DNA, 794 bp, Homo sapiens
  misc_feature: GYAE6OF02J3RLA.17.25.C03.1.454.CMB.1.raw
  modified_base (753)..(753): a, c, t, g, unknown or other
  misc_feature (753)..(753): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcgtggtgcagcagctaacgacgtcgcccacgtccgagtcgcacgtcgtggtgcgtacgtcggtcgggtgtaggtacggtagaaacggtccggtccggtcgggtacctccgtaggtcggtaacggtccttaccgaggtaaccgttacggtccgttacgtacgttaccgtttaccgttaaccgttaccctacgtaacgttacgtactaccggtacggttcgggacgaccgtccggacgtccgacgtacgacgtacgtacgcggtaggtggacggtcgggtacgtaccggaccctacgtaagcgtcgtactacgcgttacgtccgtccaccgtaccgtacgtaccggtacgaacctaccttaaccgacgtaaccgaccttaacccgaaccttacccgtaccgtaaaacgtaacctaaccgttccgaaaccgttccgtaaaggtacccgggtacggtacgttaacggaccggttacgtaccgtaacggtaaccgttacggttaaccgaccgggttaaccccggtacggtttacccgtcgttaacccgtttagggccgtttacggaccgttacgacccgtaccgtaccggtacggtaccggttgaccgtccgtaccggnttccggacgtccgtttaggaccggttcggaccgggtaccgg

SEQ ID NO: 209261 - DNA, 783 bp, Homo sapiens
  misc_feature: GYAE6OF02G25M5.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcgtggattctacgtttacctccttatagtatcaactgggtagcgaccacggcccgcgtggaccaaccgaccgtaggacgtcgggtatggggaagtcggggacgaaaccccgtaacgtacgttggtgtaccacgtagtcgtcttaccgaccctacgttcccgtacccggggacaacggtaacctttaacccgaacgttacggaacccctaaaccggtaaacccctttacccttaaccctaaacgttaaaaacccacgtaaccggtaccctaacgtacgtacgggtacgtttacgggaagggtaccgtaccgttacgaacgtacttaccgtacggtacccgaacccggtaccgggtacccggtttaacgttaacgtttaaccgttagggttaccgggtaccggtaacgtacccgggttaccccctaacgggtaaccgggttaccccgggtagggtaaccccggttcccggtaacgggtccccggtaacgggttccccgggttaccggtttttacgaccccgggtttttccgggacccgggggg

SEQ ID NO: 209262 - DNA, 794 bp, Homo sapiens
  misc_feature: GYAE6OF02F7TMC.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagccgtggggcctcgaggtgaaggtctcctgacaaggtcttctggtattctaccgtttacctcctatagtattacgaacgttgggtacgcgccgacggccgtcgtacggaaccaacggaccgttaggaggtggagttggggagtcggggaccgtaaaccctaacgtacgtggtacgtacacgtagtcgttaccttaccgacccctacgttcccgtaccgggaacctacgtaccttaccatacgacccaaccgtacctcccaaccgaaactaaaccacgaacgtaccctaaacgtagtacgggtagttacggaacgtaccggtaccctagggaaccctacgtaccgtacgaaacccgtaacccgtaccgggttacctttacgttaaactttaccgggtacgttaccgggtaaccggtaacccggtaacccgttaccccgaaaccggggtttccgggttaccccggggtaacgggtaaccccggttacccccggttaaccgggggaaccgttaaccccgggggtttaccccggggttttacccttttaaccggggttaaccccggttttcccgggggaaccccggggggg

SEQ ID NO: 209263 - DNA, 751 bp, Homo sapiens
  misc_feature: GYAE6OF02JBPZ4.17.25.C03.1.454.CMB.1.raw
  modified_base (313)..(313): a, c, t, g, unknown or other
  misc_feature (313)..(313): n is a, c, g, or t
tcagcgtagactagcacgaccggtgctcgatttagtagtgtagatttgggtttgggggactcaacaaccacatctgtcctctagagaaaaaccctgtgagcacagctccctcaccatggactgggacctggaggatcctcttcttggtggcagcagctacaagtgcccactcccaggtgcagctggtgcgtagtcgtggggctggaggtgaagaagccgtgggcctcaggtgaggtctcctgcaaggtcgttctggacttcacgtttacctccgttatacgtatcgtaacgtgggtgtcgccgaggacccggngtacgggacgtaaaccgtaccgtggtaacggtggtacgggttggggaaggttccggggacccgtaaacccgtaacgaccgttgggttaccgtacgaaccgtacggttcgttccttaccgaaccccgtacgttccccggtaccgggaaccctaagtaccctttaccacgtaccgaaccaaccgtacctaccctaaccctaaacgttaaacccaagtacgtaccctaacgtacgtagggtccgttaaggaccgggttacgccgtacaccgtaaccgttctaacggaccggtacccgacggttacccgtaaccgttttacttaacgttcggtcgtacgggaagtacccgtcccggaaccgttaaccggttcccggtaaggaaccgttcccgtaacgggccgtaccgcggttaccttttccggccggttacgggtaccgggg

SEQ ID NO: 209264 - DNA, 823 bp, Homo sapiens
  misc_feature: GYAE6OF02GOUQE.17.25.C03.1.454.CMB.1.raw
  modified_base (221)..(221): a, c, t, g, unknown or other
  misc_feature (221)..(221): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctgaggtagaagaagccgtgggcctnagtagaggtcctcctgcgaaggtccttcgtggtacttccgtaaccgttttaccctccttaatacgttactacgtaacgttggggtcgacccggaccgtacgggcccgtcgtacggaaccgaaaccggaccgttggacggttaggggaacggttgggggaaacggttccgggggaacccgttaaaacccccgtaaacggtaccggttagggtccgttaaccgtaacgtaaggttttccggttacccttacccgtaaccccgtaaccgtttccccggaccggggtaaacccttacgttaacccgttaaccgtaccgttaaaccgtaaccccgtaaccggtaacccttaccccgtaaccctaaaacgtaaaacccaacgtaaccgtaccccttaaacgtaaccggttaacgggttacggttaggaaaccggggccttaaccggtctaaccgtacgttaccgtaccgtaaaccgggcgtaaccgggtaccgttaccttaagttacgtggacgtcgaacgttaccgaccgtacggtccgtaccgggtacgaccgtacggtaccggacgccggtaccggttccgttcggttaccgttcggtaccgggg

SEQ ID NO: 209265 - DNA, 615 bp, Homo sapiens
  misc_feature: GYAE6OF02FT6DA.17.25.C03.1.454.CMB.1.raw
  modified_base (219)..(219): a, c, t, g, unknown or other
  misc_feature (219)..(219): n is a, c, g, or t
  modified_base (243)..(243): a, c, t, g, unknown or other
  misc_feature (243)..(243): n is a, c, g, or t
  modified_base (260)..(260): a, c, t, g, unknown or other
  misc_feature (260)..(260): n is a, c, g, or t
  modified_base (276)..(276): a, c, t, g, unknown or other
  misc_feature (276)..(276): n is a, c, g, or t
  modified_base (504)..(504): a, c, t, g, unknown or other
  misc_feature (504)..(504): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctaacaagtgcccactcccaggtgcagctggtgcagtctggggctgaggtgagaagcctgggcctnagtgaaggtctctgcaaggtcttntggattcacgtttaccnctatatatcatgggtncgccgaggccgcgtggacacgactgagtggagtgggatgggacctaaccgtaacacgtggtactcgacgtagtcgtccttcacccctatcccgtaccggggacctaggtaccttaccgagtccgaaccgacctaaacgtccctacaaactaaacaccacgaccctaatagtcggtaggttgagggtacgtcctagactactcgaaggtaccgacgaccggtaccgttnttaaccttcgtagtcgacgtacggaccgtacccgacgtccggtacgggtacggaccggtcctaacggccgtacggcccgggtttactttacggtaccgtttcggaccgggg

SEQ ID NO: 209266 - DNA, 627 bp, Homo sapiens
  misc_feature: GYAE6OF02H0PXX.17.25.C03.1.454.CMB.1.raw
  modified_base (284)..(284): a, c, t, g, unknown or other
  misc_feature (284)..(284): n is a, c, g, or t
  modified_base (293)..(293): a, c, t, g, unknown or other
  misc_feature (293)..(293): n is a, c, g, or t
  modified_base (338)..(338): a, c, t, g, unknown or other
  misc_feature (338)..(338): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgacaaggcttctggattcaccgttttacctcctatagtatcaactgggtncgcaggccntggacaacgctgagtggatgggatgggcgaaccctacacgtggtntacacgagtcgtcttcaacccatcccgtacggacagaccttaccatcgaccacgaactccacaactaaacacacgaccctaacagtaggtaacgttggaacgggacgcccgttaggaacctattccgtacggaccgaaccgacccgggtaccgttaccttaagtttacctgggtcgtaccgaaggtaccgacccgtaccggtaacgtcccgggttagaaccggttacccgaccgggaccgacgggttcccggtacccgtttttcggaccccgtttgggtacccgggggg

SEQ ID NO: 209267 - DNA, 675 bp, Homo sapiens
  misc_feature: GYAE6OF02HAS2Z.17.25.C03.1.454.CMB.1.raw
  modified_base (469)..(469): a, c, t, g, unknown or other
  misc_feature (469)..(469): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccgaggcccgcgtagggaccaaccggacccttaggaggttcggagtgggggaagtcggggaccgaaacccctaacgacgttagggtcgtacctaactaggtcgtactttccacccctatcccgtaccgggacacgtacttaccatcgaccacgaacctcccgtaccaataaaccacgacgaccttanaacgtggtagttaggtacgggaacgtcccgtacgaaccgtagtcctacggtaccgaacccggaccgggtcccgtacttaacgtttacgtacggtcggtacgacgaccggtcccgaaccggtacggttacccgggtgtaacccggtcccgtaacccggtcgtacggtcccgggttaccgtttacggtaccgtttcggtacccggggg

SEQ ID NO: 209268 - DNA, 634 bp, Homo sapiens
  misc_feature: GYAE6OF02GD8EG.17.25.C03.1.454.CMB.1.raw
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
  modified_base (304)..(304): a, c, t, g, unknown or other
  misc_feature (304)..(304): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaaggcttctggacttctacgtttacctcctatagtatcaactgggtncgccaggccntggacaacgccngagtggatggggatggaccgaaccctaagactggtctcacgtagtcgtctccacctactccgtacggacacgtaccttaccatacgacccaacgaacctccctacactaaacaccgacacctacagtggagttacgaaggtacgccgtacgactactacgtcggtaaccgaacggtacccggtaccgttaccttaacgtttaccggtggtaccgacgtaacggtccgtacccgaaccggtaacgttcccgggtacgtaccggtaccccggttacggcccgtaacggtcccgggttaccgttttaccgttacccggttcggtacccggggg

SEQ ID NO: 209269 - DNA, 717 bp, Homo sapiens
  misc_feature: GYAE6OF02I2AJR.17.25.C03.1.454.CMB.1.raw
  modified_base (220)..(220): a, c, t, g, unknown or other
  misc_feature (220)..(220): n is a, c, g, or t
  modified_base (223)..(223): a, c, t, g, unknown or other
  misc_feature (223)..(223): n is a, c, g, or t
  modified_base (233)..(233): a, c, t, g, unknown or other
  misc_feature (233)..(233): n is a, c, g, or t
  modified_base (269)..(269): a, c, t, g, unknown or other
  misc_feature (269)..(269): n is a, c, g, or t
  modified_base (294)..(294): a, c, t, g, unknown or other
  misc_feature (294)..(294): n is a, c, g, or t
  modified_base (606)..(606): a, c, t, g, unknown or other
  misc_feature (606)..(606): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggactcctcttcttggtggcagcagctacaagtgcccactcccaggtgcagctggtgcagtcgtgggctgaggtgaagagccgtgggcctnagngaaggtctcngacaagcttctggattctacgttacctctatagtanctaacgtggtagcgtcgacggccgngttcggacgaaccgtacctacggagtcggagtcggggacgtcgggacgaaccccgtaacgtacgtgggtactaccgacgacggtacgttccttccgaacccgtacgtcccggtacccgggaaccgtacgtaacccttaacccgaagtaccgaacccgtaaccgtaacccgttacccctaccgtaaacctaaacctaactaaccggacccttaactacggttacggtaaggtttacggaaggtacgtaccgtagtaaccgtagttacgtaacggaccgtaccgaccgggttacccgttagttacgtttaccgnggttaacgaacggtacgtacgttacccgaacggtccgttaccgggtaccgacgttaccgtagtcgggacccgtacggtcccggttaaccgttttcgacccgtttcccgggg

SEQ ID NO: 209270 - DNA, 656 bp, Homo sapiens
  misc_feature: GYAE6OF02IMX4S.17.25.C03.1.454.CMB.1.raw
tcagcgtagactagcacgaccggtgctcgatttagtagtgtagatttgggtttggggactcaacaaccacatctgtcctctagagaaaaaccctgtgagcacagctcctcaccatggactggacctggaggatcctcttcttggtggcagcagctacaagtgcccactcccaggtgcagctggtgcagtctggggctgaggtgaagaagccgtggggcctgagtgaaggtctcctgcaaggcttcgtggacttccgtacgttttacctcctagtagtactctaacgtgggtcgccgccgaggcccgcgtcggacgaacgacctggagtggagtgggagtcgggaccaacccgtaacgacgtggtcgtacacgagttcgtccttccaccctactcccgtccggaacacgtacttaccacgtacgacctaacgtaccctacccaccaagtaaaccacgtaacgtaccctaacgaacgtgggtaacgttaggaacggacgtaccgtacggactcgttacgtcgaaccgtaccgtaccggtacccgttaactacgtttaacgtggtacgaccgtacgaccgttaccccgagtacgtaccggtcgaaccgtccgtaaccggcgtacggtacccggtcctttacggtccgttcggtacgggg

SEQ ID NO: 209271 - DNA, 765 bp, Homo sapiens
  misc_feature: GYAE6OF02G9PZQ.17.25.C03.1.454.CMB.1.raw
  modified_base (257)..(257): a, c, t, g, unknown or other
  misc_feature (257)..(257): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcacgctacaagtcgcccactcccgaggtgcagcctgggtcgacagtcgtggggctaggaggtgaagaagtccgtgggcctcgagtgaaggtcctcctgacaaggcttntggacttcctaacgtttacctccttatagtatacaacgttgggtgccgcgtacggccgtctacggaacctaaccggtacctgaaggttcgggagtaggggagtcggggaacccctaaacccgttaacgacgttcggtagtaccacgtaacgggttctccgttaccaccctacgcccggtaccggggaactacgtaaccttacactacgaacccgaccgtaacctcccacctaaacgtaaaaccaccgaacaccgtaactagtcggtaacggtttagacgggaccgtaccgtacgtaacgtaacttaccgttacggaaacccgaccgtaacccggggtcccttaccgttaaactttccgtaaggttccgtaacggacgtaccggtaaccccgtaacggtcccggtaccggttacggacccccggttaccggttacccggaccgggttacccggtaaccggggttcccggtttttaccgacccgggtttttaccggtaaccccggggggg

SEQ ID NO: 209272 - DNA, 719 bp, Homo sapiens
  misc_feature: GYAE6OF02GDMOA.17.25.C03.1.454.CMB.1.raw
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaacggtcctccgtggcaaggtcttctggattcacgtttacctctatagtatcaacgtgggtncgccaggccncgtggaccaacgacctggacgtggagtggggatcggggaccaaacccctaagtaccgtggtcgtacacgtagttcgtaccttaccaaccccgtagttcccgtaccggggactacggtaaccttaccacgtacgacccaaccgtaacctccctaccgtaaactaaaccgacaacgtaccctaacgtacgtacgggtaaggtttaggaacgggtacgtccctaaggtacctacgttacgtacggaaccgtaccgaacccgggtcccgttaacgttaaccgtttaccggtaggttaccgacggttaacggtacccgtaccccgtaacgggtaaccgttacccggggttacgaaccggtcccgtaacgggcccgtaacggtcccggttaccgtttaccggtacccgttcggggtaacccgggg

SEQ ID NO: 209273 - DNA, 791 bp, Homo sapiens
  misc_feature: GYAE6OF02I5550.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacgaagtcgcccactcccaggtgcagctggtgcagtcgtgggctaggaggtagaagacgccgtgggcctcgagtagacggtctcgtgacgagtcttcgaggtactttaccgtaccgtttacccttacctaagttaacggttaacttaccgtaaccgttggggtaccgtccgacccgtaacggcccggtcgtaacggaaccgaaaccggtaccgtgggaaggtcggacgttcggggacgtacggggaacccgtaaacctacgtaggttcggtacgtaccgtaacgtacggttgtaccttacccgacccgtacgtacccggtaccggtacacgttaacccgttacgacgtaaccggacctaacccgtacccttcccgtaacctaacgtaaacccgactaacggtacctaacgtacggtacgtacggttacgaaccggttaccgaccgtaaacgtctacgtacgttacgaacccgtaccgaccgggtaccttacgtaccgtttagtacggtaccgtacgggtaaccgtaccggttaccgaaccggtaccggttaccggtggtaaccccgttaaccggttccggggacgtccggggttaaccctttccgggtttaccgtaccggtttccgggaacccgggg

SEQ ID NO: 209274 - DNA, 654 bp, Homo sapiens
  misc_feature: GYAE6OF02HLN96.17.25.C03.1.454.CMB.1.raw
  modified_base (225)..(225): a, c, t, g, unknown or other
  misc_feature (225)..(225): n is a, c, g, or t
  modified_base (238)..(238): a, c, t, g, unknown or other
  misc_feature (238)..(238): n is a, c, g, or t
  modified_base (337)..(337): a, c, t, g, unknown or other
  misc_feature (337)..(337): n is a, c, g, or t
  modified_base (597)..(597): a, c, t, g, unknown or other
  misc_feature (597)..(597): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttctggtggcagcagctacaagtgcccactcccaggtgcagctggtgcagtctggggctgaggtgaagagcgtgggctcagtgaagtcncctgcaggcttcnggattcacgttacctctatagtactcaactgggtcgcgccaggccgcctggaccaacgaccgtagacgtggagtgggagtcgggacgtaacccctaacncgtaggtcgtacacgagttcgtacttccaccctacgtccgtacccggtaactaacgacctttaaccgacgtacgaaccccgtaacgtaacctcccgtaaccaaactaaaccacgtaaccgtaccgttaaccaggtacggtagttacgggagtacggtccctagactacgttaccgaccgacgacccgtaccgtccggttaccttaacgttccgtggtacgaccgacgtaccgttaccccggacgtacggtcccgggttanacggtacccggtaacgcgtacggtccgttcccgtttacgtccgttcggtacccgggg

SEQ ID NO: 209275 - DNA, 978 bp, Homo sapiens
  misc_feature: GYAE6OF02HTAKG.17.25.C03.1.454.CMB.1.raw
  modified_base (334)..(334): a, c, t, g, unknown or other
  misc_feature (334)..(334): n is a, c, g, or t
tcagcgtagactagcacgaccggtgctcgatttagtagtgtagatttgggtttggggactcaacaaccacatctgtcctctagagaaaaccctgtgagcacagcctcctcaccatgacgcgaccgtggaggactcctctttcgttggtggcacgcagacctaacaagtcgaccccacctcccgaggtgcgacgcgtggtcgcgagtcggtgggctaggaggtagaaacggaacgcggtcgggcctacgaggtagaacggtcctcctcgacgaacggtcctttcgtggtacttcgttaccgtttaccttcctatagttactactacgttgggtanccgtacgcggccgtcgtacggaaaccaacggtaccgtaggtacggtagggaggtttacgggggagtaccgggggacccgttaaaaccccgtaaaaccgtacggttacgggttacggttacccgaacgttacggttttccggttcccgtttaaccccgaccccgttaaaccggttccccccgggttaaccggggtaaaccgtaacccggtttaaaccccgtttaacccgtaaagggtaacccggtaaaccccgtaaacccggttaaacccccttacccccttaaacccgttaaaaacccttaaaaacccgaacctaaacccggttaaccccgttaaaccgttacggttaaccggggttaaacggtttaccgggtaaacggggaacccgttacccggttacggtaaaccgtacgtttccggttaaaccgaacccggtaacccgggtaccccgggttaccggtttaacccgtttaaacgttttaccggttacggtaccgttaccgggtaaacggtaccccggtacccccggaaagggttacccggtttccccggggtaaggtacccggttaccccggtaaccggaccggtaccggttaccggtttacccggttttacccggtttacggtcccgggttaacccggggg

SEQ ID NO: 209276 - DNA, 792 bp, Homo sapiens
  misc_feature: GYAE6OF02IGBBQ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgagtgaagagcctgggcctcagtgaaggtctcctgacaaggcttctggattcacgtttacctcctatacgtatcctaacgtgggtagccgtccgaacgggtcccgacgttacgggaaccgtaaacccggtacccgtagggaacggttgggacgttacgggggtacgttcgggggaacccgtaaaacccccgttaaaccggtacgttcgggttacggtacccgtaacggtaacggtttcggttaccctttacccgaacccccggtaacgtccccgggttacccggggaacctaacggttaacccgtttacccaaaggtttccggaaaccctaaccgtaacccttaccccgtaacccgtaaactaaaaaccgacctaaacgtaacccgtacgaacggttagggtaacggtttagggaaccggtaacgtaccccgttaagacgtaacttacgtacggaacccgacgtaacccgggaccgtttaaccgttattaaccggtgtaccggtacgtaacgaccgtcccgtaccgtaacgtcccgggtaagaccggtacccttaacgggctaacggtccggttactttacgccgttcgaccggggg

SEQ ID NO: 209277 - DNA, 843 bp, Homo sapiens
  misc_feature: GYAE6OF02IA5XQ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtgggcctcgagtgaaggtctccgtgcaaggtcttcgtggattcacgtttacctcctatagtatacaacgtgggtcgccgccgacggccgtcgtacgggaaccaaccgaccgtaggaggttcggaagttgggggaacgtcggggaacccgtaaaaccccgttaaccgagttacgggttctaccgacgtaggttccgttaccttaccgtaaccccgtagttccccggtaccgggaacctaacggttacccttaaccgacgtttacccggaaccctaaaccggtaacccctttccccgttaaaccctaaaacgttaaaaacccgaccgtaaaccgtacccttaaaccgtaaggttacgggtaacgtttacgggaacggtaccggtacctaacggacctaacgttccgtaaccggaaccggtacccgtaacccgggttacccgttaaccgtttaacgtttaccggttaggtaaccggtaacggtaacggtaaccccgttacccggaaaccggttccgggttaccccgggtaacggtaacccggttaccccgttaacgggggaccttaaccggggtccccggttttaaccccggtttttacggttacccccgggttttacgggtaccccgggggg

SEQ ID NO: 209278 - DNA, 573 bp, Homo sapiens
  misc_feature: GYAE6OF02GX8HR.17.25.C03.1.454.CMB.1.raw
  modified_base (422)..(422): a, c, t, g, unknown or other
  misc_feature (422)..(422): n is a, c, g, or t
  modified_base (448)..(448): a, c, t, g, unknown or other
  misc_feature (448)..(448): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaacgtggtgcgccaggccgctggacaacgacctgagtggatggggatcggggacgtaaacccctaacgacttgggtcgtacacgtagtgtccttcacccatcccgtcggactagaccttaccatacgaccacgaactcctactactaaacncacgctacataggagttagaggtacnccgtacgacagtctagacgaccgacgtccgtacttacttacgtgaggtcgagtaccgtccgacgtacggtccggtagacggtaccgtacggcgtacggccgtcccgtttcgtacgtcgtccgggg

SEQ ID NO: 209279 - DNA, 682 bp, Homo sapiens
  misc_feature: GYAE6OF02H4A1U.17.25.C03.1.454.CMB.1.raw
  modified_base (193)..(193): a, c, t, g, unknown or other
  misc_feature (193)..(193): n is a, c, g, or t
  modified_base (308)..(308): a, c, t, g, unknown or other
  misc_feature (308)..(308): n is a, c, g, or t
  modified_base (409)..(409): a, c, t, g, unknown or other
  misc_feature (409)..(409): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatccttcttcgttggtggcagcaagtctacaagtcgccctactcccgaggtcgcagcgtggtncagtcgtggggactggaggtgaacgacgccgtgggcctcgagtggacggtctcgtgactaggtcttcgtggacttactccgttttacctcctattagtactacgaacgtgggtcnccgtccgacggtccacgtcggactaaccggactggtagtcggagtggggtatacggggaacctaaccgtaagcgtagtgtacacgtaggtcttacgtaccncctacgtcccgtcgggaactacgtaacctttacacgttacgacccgtaacgtaacctcccgttaaccaaacgtaaccacgacgtacctaggaggttacgggtattacgggaacgtacgccgtagacttaccgtagtaccgacgtacccggaccggttcctaagttcgtttaccgtggaaccgtacgacgttaccgtacccgtacggtcgttacgggtcgaacctttccggacgcgtaccgggtcctttaccgtcgcccggttagtaccggggg

SEQ ID NO: 209280 - DNA, 768 bp, Homo sapiens
  misc_feature: GYAE6OF02F5D29.17.25.C03.1.454.CMB.1.raw
  modified_base (245)..(245): a, c, t, g, unknown or other
  misc_feature (245)..(245): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcgagtgaaggtctcctgcaaggcttntggtattcacgtttacctctatagtatctaacgtgggtgccgccgacggccgtcgtacggaccaaccgaccgtaggacggttgggaagttggggagttgggggacccgaaacccgttaaccgtacgttagggtcgtacctaacgtaggttcgttacctttaccaaccccgtacgttccccggttaccggggaacctaacggtaaccttaaccgtaactacggaaccccgacgtaaacccgttcccctaaaccgaaactaaaacccacaaccggtacccctaaagacggttacgggtaggtttacggacggtacgtacccgtagaaacctacttaccgtaacgaacccggtaaccggacccggggtacccgtttacgttaactttaccggttacggttcggaccggtaacgtacccggtaccccgtaacggtacggttcccgggtagaacccggtacccgttaaacgggcccgtacgggtacccggttaccgttttacgggtaccgtttccgggtaaccggggg

SEQ ID NO: 209281 - DNA, 821 bp, Homo sapiens
  misc_feature: GYAE6OF02HHQHT.17.25.C03.1.454.CMB.1.raw
tcagcgtagactagcacgaccggtgctcgatttagtagtgtagatttgggtttgggagtcagtctcagtcaggacacagcatggacatgagggtccccgctcagctccgtggggctcctgctactctggctccgagctgccagatgtgacatccagatcgacccagtcctccactccctcctgtctcgcctcgtggtggggtcaggtacgtccaacctactcctacgttcggacccggtaacaacggtccgaacggtaaccgtttaaaaaccgttaattttaaaagttcggtactacgacgtacaaacggtaaaaccgtacggaaaaaccgccccaacgtaacccttccgtaggtaacttccgttcggtgggtaccactaacctccgtacgttccgacggtaacggtaaggttccggacccgttaccacggtacggttacggttcgaacgggttcggacgtaggtaggtacgttggtaacgggactaagttacttacgtaacctcctaaccaaccgtacgtaaccctacctaccgtttccgactaaccggtattacgggtaacgttcgtaagtaccgtaaacctttacgttaaccgttaaccgtacgttaccggttaaaccaacgttaacggtaaccgtttacccgtacccgtttaccccgtcgtttaaccggtttaacccgggttaccgggaaaccgggtaaccgggtttaaccgtaagtttaaccggtacgtaaaaccgaaccgggttaaacgtaaccgggttaccgttcggggactaccggttacccgtaccgtaggtttaccctcggtttaaacccc

SEQ ID NO: 209282 - DNA, 684 bp, Homo sapiens
  misc_feature: GYAE6OF02GEKV8.17.25.C03.1.454.CMB.1.raw
  modified_base (294)..(294): a, c, t, g, unknown or other
  misc_feature (294)..(294): n is a, c, g, or t
  modified_base (554)..(554): a, c, t, g, unknown or other
  misc_feature (554)..(554): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcgagtgaaggtctcctgcaaggcttctggattcacgtttacctcctatagtactcaactgggtgcgccaggccgngtcggaccaaccgacctgaggtggagtggggagtggggaccgtaaacccgtaacgacgttgggtcgtacaccgtagttcgtccttacgacccctacgttcccgtccggggaacctacggtaaccttaacctactacggaacccaacgtaaccctaccctaccgaacttaaaaccgaccacgtaccctaacgagtacgggtaagttggaacggtacgccctaggaacctatccgtaggaaccgtacgccgggtacccgttntaacgtttccgtggtacgtacgggacgtacggtccccgtaacggtacggtcccggtaggtaacccgtccggtaaccggtacgaccgggttacccggtccgttttaggaccccgtttgggtacccgggggg

SEQ ID NO: 209283 - DNA, 621 bp, Homo sapiens
  misc_feature: GYAE6OF02F0X8O.17.25.C03.1.454.CMB.1.raw
  modified_base (245)..(245): a, c, t, g, unknown or other
  misc_feature (245)..(245): n is a, c, g, or t
  modified_base (257)..(257): a, c, t, g, unknown or other
  misc_feature (257)..(257): n is a, c, g, or t
  modified_base (278)..(278): a, c, t, g, unknown or other
  misc_feature (278)..(278): n is a, c, g, or t
  modified_base (387)..(387): a, c, t, g, unknown or other
  misc_feature (387)..(387): n is a, c, g, or t
  modified_base (518)..(518): a, c, t, g, unknown or other
  misc_feature (518)..(518): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagcctgggcctcagtgagtctctgcaggtctcgtgnttcacgtttccnctatagtactcacgtgggtcncgccgaggccgtgtcggaacacggcctggagtggagtggagtcgggacctaaaccctagtacgtggtcgtcaacgtgttcgtccttccacccgtactccgtaccggganacgtaccttaaccgcgtacgaccgacctaaccgtcctaaccaaactaaccgctacgccttaacgagtcggtagttacgagtaccgctcgactgttccgagacggacccgtcggtccttacgttacttacgngtaacgcgtaaccgtacgtccccgaaggttcggtccggttacaaccggtcccggttaacgaccgtccgggtcccgtttacgtcgttaccggtcgggtaccggg

SEQ ID NO: 209284 - DNA, 888 bp, Homo sapiens
  misc_feature: GYAE6OF02H1XFH.17.25.C03.1.454.CMB.1.raw
  modified_base (235)..(235): a, c, t, g, unknown or other
  misc_feature (235)..(235): n is a, c, g, or t
tcagcgtagactagcacgaccggtgctcgatttagtagtgtagatttgggtttggggactcaacaaccacatctgtcctctagagaaaccctgtgagcacagctcctcaccatggactggacctggaggatcctcttcttggtggcagcagctacagtgcccactcccagtgcagctggtgcagtcgtgggctggaggtgaagagccgtggggcctcgagtgaacggtcctccgngacgacggtcttcgtggactttcctaaccggtttttaccctccgtttaagtacggttaacttccgtaaaccgtttgggggtccgccggacccgtacggggtcccgtaccgttcggggaaacccaaacccgggtacccgttaggtaacggtcggggtaacggttacgggggtcgttacccggggggtaaccccgtaaaacccccgttaaaccggtaccgggttaggggttacctaccgaacccggttaggttccgtttacccttacccgaaccccgttacgtacccggtttaccccgggggaacttaacgggttaacccctttaccgaacgtaccggtaaccccgaacggtaaacccctttcccgtaacctaaaacgttaaacccgaccgtaaccgttacccgttaaccgagggttaacgggttaggtttacggaaccgggacttaacccgttacggaacctcgtttaccgtaccggaacggtaacccgggtacccggttacctttaccgtttaaactcggttcggttacgacggtaacgtacccgtttcccggaacggttaacggtcccggttagggaaccccgttccggtacgggacccttaccggggtccgttttacccgtttaagggtccccgttaggggtaccccgggg

SEQ ID NO: 209285 - DNA, 761 bp, Homo sapiens
  misc_feature: GYAE6OF02ICWIW.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagacgccgtgggcctcgagtgaaggtctccgtgacgtaaggtcttcgtaggtacttcgtaaccggttttacctaccttaatacggtattccgaaaccgtggggtacgccgtaccgacggtccgtcgtacggaaccgtaaccggtaccgtaggtagtcggtaggtacggggtaagtccggggaacccgtaaacccgtaaccgtacggttggtacgtactacgtacggtttacgttccttccctaacccgtacgttacccggtccggggtaactacggttaacccttaactacgtaccgtaaccgtaaccgtaaccgttaccctaaccgtaaactaaaccgaacctaacccgtacctaacgttaggttacgggttaacgttacggtacggaccgttccgtacgaactacgttacgtacgaaccggtacccgaccggttccgtaaccgttattaccggtggtacgtaccgtagtacccgccgaacggtcgtaccggtcgacggtacccggtacgaccggtacggccgttccggtttacgtcccgttgggtacccgggg

SEQ ID NO: 209286 - DNA, 556 bp, Homo sapiens
  misc_feature: GYAE6OF02HEFN6.17.25.C03.1.454.CMB.1.raw
  modified_base (336)..(336): a, c, t, g, unknown or other
  misc_feature (336)..(336): n is a, c, g, or t
  modified_base (340)..(340): a, c, t, g, unknown or other
  misc_feature (340)..(340): n is a, c, g, or t
  modified_base (367)..(367): a, c, t, g, unknown or other
  misc_feature (367)..(367): n is a, c, g, or t
  modified_base (405)..(405): a, c, t, g, unknown or other
  misc_feature (405)..(405): n is a, c, g, or t
  modified_base (409)..(409): a, c, t, g, unknown or other
  misc_feature (409)..(409): n is a, c, g, or t
  modified_base (508)..(508): a, c, t, g, unknown or other
  misc_feature (508)..(508): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctgggcctcagtgaaggtctcctgcaaggtcttctggattcacgttttacctcctatagtatcaacgtgggtgcgccaggccgctggacaacgcctgagtggatgggatcgggacaacctacacgtggntcanagtgtccttcacccatccgtaccgganacgtacttacgatcgaacacgactcctccaataaaccncgancctacataggagttgaggagcctcgactatcgtaggaccgacgacgggcccttagttaccttagtcggtgacgacgacgtaccgacgtacgttccgganaacccggtcctacggccgtacggcggttcctttgaccgtttcggcggg

SEQ ID NO: 209287 - DNA, 755 bp, Homo sapiens
  misc_feature: GYAE6OF02G2XA4.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtagaagaacgccgtggggcctcgagtgaaggtctcctgcaggtcttcgtggtatttaccgtaccgttttaccctaccttataagttactacgtaacgttggggttcgccggcccgaggggcccgtcgtacgggaacccaaaccggtaccctagggaacggttggggtaacgtgggggaagtcggggaacccgaaaccccgttaacgtaacggttcgggtacgtacctacgtacgtttcgtccttaccaccctacgtcccggtaccgggaactacgtaccttaaccgactacgaaccaaccgtacccttacccaccgtaaacaaaccgtaccaacgtacctaacagttacgggtagttaggaacgggtacgtaccgtagtaacctcgttacgtacggaacccgtaaccggaccgggttacccgttacttaacgtttacgtacggttacgaccggtaaccggtaccgacccgtaacggaaccggtttccgggacgtaccggttacccgacggtacggtacggtcccggttaccgttcgtaccggtttcggaccgggg

SEQ ID NO: 209288 - DNA, 606 bp, Homo sapiens
  misc_feature: GYAE6OF02HITI0.17.25.C03.1.454.CMB.1.raw
  modified_base (246)..(246): a, c, t, g, unknown or other
  misc_feature (246)..(246): n is a, c, g, or t
  modified_base (284)..(284): a, c, t, g, unknown or other
  misc_feature (284)..(284): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagccgtggggcctcagtgaaggtctcctgcaaggtcttcgnggtattctacgtttacctcctatagtatcaactgggtncgccgaggccgcgtggaccaacgccgtggacgtggatggggatcggggaccgaaacctaacgcgtggtgtcacgagtcgttcttaccaccctagtcccgaccgggactacgaccttaccacgtacgaccaaccgtaactccctacaactaaaccacacgtcctaacagtaggacggttgaaggtcgcctagactagtcctggaaccgaccgaccgtccgtacgttacttacgtcggttcggacgtacggacgtccctacggtacgtccggtagaccgtccgacggacgtcggtcccgtccgtttggtaccgttcggtccggg

SEQ ID NO: 209289 - DNA, 632 bp, Homo sapiens
  misc_feature: GYAE6OF02G0K0E.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaggtctcctgcaaggcttctggattcacgtttacctcctatagtatcaactgggtgcgccaggcccgctggaccaacgacctgaggtggagtggggatcggggccgaaacccctaacgaccgtgggtgtaccacgagtcgtccttcacccctactcccgtaccgggacacgtaccttaccatcgaccaccgaacctccctacaactaaaccacacggccctaacagttagggagtttcggaaggtacgccctagacacgttccgtacgggaacccgaaccgacccgggtccttaccgttaacttacgttggtacgccgggaacgtaccgtaccccgacggtggtcccgggtgacggtacccgtcgggacacgggtcccggttaccttttacggaccgtttggacccgggg

SEQ ID NO: 209290 - DNA, 765 bp, Homo sapiens
  misc_feature: GYAE6OF02J1N4C.17.25.C03.1.454.CMB.1.raw
tcagcgtagactagcacgaccggtgctcgatttagtagtgtagatttgggtttggggactcaacaaccgacatctgtcctctagagaaaaccctgtgagcacagctcctcaccatggactggacctggaggatcctcttcttggtggcagcagctacaagtgcccactcccaggtgcagctggtgcagtcgtgggctggaggtgaagacgcgtgggcctcagtgaaggtctcctgacgaggtcttcgtggtacttccaccgttttacctcgttatagttatccaacgttgggtcgtccgccgacggtccgtcgtacggaacaaccgaccgtggtaacggtggaaggtggggacggttcggggacccgtaaaccccgtaacgtacggttcgggttacgtaccgtaacgtacgttcggtttaccttacccgaaccctacgttaccccggtaccgggggaaacctaacggtaacccgttaacccgacgttaccgaaacccgtaaccgtaacccgtaccctaaaccgtaaacctaaaaccctaaccgaaccgtacccttaaccgagttacgggtacgttaggaacggaaccgtaccgttagaacctacgtacctacggaaccgtaccggtacccggtaccttacgttaacgttaccgttaggtacgtacgacggtacccgtaccgtacggacggtttaccggtcgtaaccggtcccgtaaccggcgtccggtacccggttccttttaaggtacccgttccggtaccggg

SEQ ID NO: 209291 - DNA, 731 bp, Homo sapiens
  misc_feature: GYAE6OF02HGLZU.17.25.C03.1.454.CMB.1.raw
  modified_base (285)..(285): a, c, t, g, unknown or other
  misc_feature (285)..(285): n is a, c, g, or t
  modified_base (296)..(296): a, c, t, g, unknown or other
  misc_feature (296)..(296): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagccgtggggcctcgagtgaacggtctcctgcaaggtcttctggacttcacgtttacctccgtatagtatcgaactgggtncgccaggccgntgggaaccaacgaccgtgaggtggagtgggagtggggacctaacccctaagacgtggtacgtcaactaggtcgttccttcaacccctagtcccgtaccggggaactacggtaaccctttaccgactaccgaacccgtaaccgtaacccttccctaacccaaacttaaaaccgaccgtaacgaacccttaaccgtaagttacgggtaagtttacggaacgggacgtacccgtaggtaacctacggtccgttaacggaacccgtaaccgtaaccgggttaccccgttactttaaaccgtttaaccggtggtaacgtaccgggtaaccggtacggtacccctaacgggtaaccggttcccgggtaaggtacccgtacccggtaccgggacgtaccgggtaccgttcccggtttaggtaccggttccggtaaccggggg

SEQ ID NO: 209292 - DNA, 697 bp, Homo sapiens
  misc_feature: GYAE6OF02GG576.17.25.C03.1.454.CMB.1.raw
  modified_base (246)..(246): a, c, t, g, unknown or other
  misc_feature (246)..(246): n is a, c, g, or t
tcagcgtagactagcacgaccggtgctcgatttagtagtgtagatttgggtttggggactcaacaaccacatctgtcctctagagaaaaaccctgtgagcacagctcctcaccatggactggacctggaggatcctcttcttggtggcagcagctacaagtgcccactcccaggtgcagctggtgcagtctggggctgaggtgaagaagccgtggggcctcgagtgaaggtctcctgcaaggcttntggattctacgtttacctccttatagtatcaacgtgggtgcgccgaggcccgctaggaccaacgacctgaggtaggagtgggagtcggggaccgtaaccctaacgctggtcgtacagtacgtgttcttaccaccctagtcccgtaccgggaaccagttaccttaccgacgtcgaacccgtaccgtaaccctccctacctaaaacgtaaaaccaaccgaccgtaaccctaacgttaagtacggggttaaggtttacgggaacgggtacgtcccgttacggaactacgttcctagggaaccgtaccgtaccgggtaccgtttacttacgttacgtaggtggtacggtacgaccgtacccgaacggtacggttacccgggtagacccgtcccggaaccgggtccgtaccgggttccggttacccgtttacggtaccggttcgggttaccggggg

SEQ ID NO: 209293 - DNA, 712 bp, Homo sapiens
  misc_feature: GYAE6OF02JLSRA.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccgaggtgcagctggtgcagtcgtgggctgaggtgaagaagccgtggggcctcgagtggaaggtctccgtgcaaggtcttcgtggtattctacgtttacctcctattagtatacgaacgtgggtgccgccgacggcccgcgttacggacgaacgacccgtggacggtggagtgggagttcggggaaccgtaaccctaacgtacggtggtcgtacgagtaacgttcgtccgttaccaaccccgtacgttcccggtacccgggaactacgtaccttaccgactacgacctacgaaccctcctaccctaataaacccacgtacgcctaacacgttacggtaagttcggaacggtacgtacccgtagtaaccgtaccgttaccgttaacgggtaccgaaacccggtacccgggttcccgttaacccgtttaaactttaccggtgtaccggacgaacggtaccgtacccggtacgtacccggtcggttacggacgtacccggtaacggccgacggtcccgttacgtttacggtccgtttcggtccgggg

SEQ ID NO: 209294 - DNA, 563 bp, Homo sapiens
  misc_feature: GYAE6OF02IM3O1.17.25.C03.1.454.CMB.1.raw
  modified_base (374)..(374): a, c, t, g, unknown or other
  misc_feature (374)..(374): n is a, c, g, or t
  modified_base (413)..(413): a, c, t, g, unknown or other
  misc_feature (413)..(413): n is a, c, g, or t
  modified_base (424)..(424): a, c, t, g, unknown or other
  misc_feature (424)..(424): n is a, c, g, or t
  modified_base (445)..(445): a, c, t, g, unknown or other
  misc_feature (445)..(445): n is a, c, g, or t
  modified_base (453)..(453): a, c, t, g, unknown or other
  misc_feature (453)..(453): n is a, c, g, or t
  modified_base (481)..(481): a, c, t, g, unknown or other
  misc_feature (481)..(481): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcggccaggccgctggacaacgacctgagtggatgggagtcggggaccgaaaccctaacgacgttgggtgtacacgagttcgtcttccaacccntcccgtcgggacagacttaccagtcgaccacgaactccncaacaacacancctacatggagttggaggacnctgactanctagacgacgacgccgtctattctgcgngacgacgtcccgacgcgttcccggtgaccgtccgtaccggacgacggccggttacccgttcggtacgtttcggtaccggggg

SEQ ID NO: 209295 - DNA, 706 bp, Homo sapiens
  misc_feature: GYAE6OF02GUBRT.17.25.C03.1.454.CMB.1.raw
  modified_base (286)..(286): a, c, t, g, unknown or other
  misc_feature (286)..(286): n is a, c, g, or t
  modified_base (548)..(548): a, c, t, g, unknown or other
  misc_feature (548)..(548): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaaggtctcctgcaaggtcttcgtggattcacgtttacctcctatagtatcaacgtgggtcncgccaggccgctggaccaacgacctggagtggatggggatcggggaccgaaccctaacacgtggtgtcaacgtaggttagtccttaccaacccctactcccgtacccggggaacacggtaaccttacccgacgttacgaacccgtaaccggtaaacccctttccctaaccaaaactttaaaaacccgaccgtaacgtaccccgttaaacaacggttagggggtaacgtttgggaaacgggtaccgtacccgttagtaacccngttaccgtacggaaacccggtaccgacccggggttccgttacttaacgtttacgtcggtagaccgacgttaccgtcccgaagtccggttacccggtagaccgtacccggttacggccgtacgggtcccggttcttttacggccgttcgggtccggggg

SEQ ID NO: 209296 - DNA, 618 bp, Homo sapiens
  misc_feature: GYAE6OF02JG8ZI.17.25.C03.1.454.CMB.1.raw
  modified_base (221)..(221): a, c, t, g, unknown or other
  misc_feature (221)..(221): n is a, c, g, or t
  modified_base (231)..(231): a, c, t, g, unknown or other
  misc_feature (231)..(231): n is a, c, g, or t
  modified_base (242)..(242): a, c, t, g, unknown or other
  misc_feature (242)..(242): n is a, c, g, or t
  modified_base (256)..(256): a, c, t, g, unknown or other
  misc_feature (256)..(256): n is a, c, g, or t
  modified_base (264)..(264): a, c, t, g, unknown or other
  misc_feature (264)..(264): n is a, c, g, or t
  modified_base (276)..(276): a, c, t, g, unknown or other
  misc_feature (276)..(276): n is a, c, g, or t
  modified_base (288)..(288): a, c, t, g, unknown or other
  misc_feature (288)..(288): n is a, c, g, or t
  modified_base (336)..(336): a, c, t, g, unknown or other
  misc_feature (336)..(336): n is a, c, g, or t
  modified_base (392)..(392): a, c, t, g, unknown or other
  misc_feature (392)..(392): n is a, c, g, or t
tcagcgtagactagcacgaccggtgctcgatttagtagtgtagatttgggtttggggacgtcaacaaccacatctgtcctctagagaaaaccctgtgagcacagctcctcaccatcggactggacctggaggatcctcttcttggtggcagcagctacagtgcccactcccaggtgcagtctggtcgcagtcgtggggctggaggtgaagacgctgggctnagtgaggtcnctgcaggctcnggattcacgttccnctatacgntacaactgggtncgcaggccgtcnggacaagcctgagtcggatgggatgggccgtaacctaacgactgggtntcgacaggtgtccttacacccacgtccgtaccggggatacgtaaccgttcacgttnacccaacggaccctacccgttccaagtaaaaccctaccacggtacccttacgaagttcgggaagttgggacgttaacggctacgtacacctcttcggaaccgacctacgggtcccctaagttccttaaagcgtgggtacgacgggtacgtcccgtaccggttacgcgtttacggaacttcccggtaccgagttcgggcgttaccggtgttacccctcggtcggggg

SEQ ID NO: 209297 - DNA, 768 bp, Homo sapiens
  misc_feature: GYAE6OF02FVIB1.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtagaagaacgccgtggggcctcgagtagaaggtcctccgtgacgaaggtcttcgtggtacttcgtaccgtttacctacctatagttactactaacgtggggtgccgaccgacgggcccgtcgtacgggaacctaaaccggtaccgttaggaacggtgggaagtggggaaggtacggggacccgtaaacccctaacgaccgttgggtacgtaccgtaacgtaggttcgtaccttaccgaccccgtacgttccccggtaccgggaactacgtaacccttaccgtaacgtacgaacccgtacgtaacccgttcccctaacctaaaacgtaaaacccaccgtaacgacccttaaagacgtagggtacgttacggaacgggtacctaccgtagaaccgtacttaccggaacggtaaccgaacccggtaccgggttcccttaaacttacgtttacgcggttaacggacgtacgtaccgtaccccgacggtacggttacccggaggtaacccgtacccggtacgggactcccggggtaccggttaccgttttaggacccggtttcgggaccgggg

SEQ ID NO: 209298 - DNA, 605 bp, Homo sapiens
  misc_feature: GYAE6OF02HPZRL.17.25.C03.1.454.CMB.1.raw
  modified_base (282)..(282): a, c, t, g, unknown or other
  misc_feature (282)..(282): n is a, c, g, or t
  modified_base (339)..(339): a, c, t, g, unknown or other
  misc_feature (339)..(339): n is a, c, g, or t
  modified_base (456)..(456): a, c, t, g, unknown or other
  misc_feature (456)..(456): n is a, c, g, or t
  modified_base (560)..(560): a, c, t, g, unknown or other
  misc_feature (560)..(560): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcgtgggcctcagtgaaggtctccgtgcaaggcttcgtggattcaacgtttacctcctatagtactcaacgtgggtncgccgaggccgcgtggacaacgacctgaggtggagtgggatgggacgaacccgtaanacgtggtgtacactaggtgtccttacacccacttccgtaccgggactagtaccttaccgaatcgaaccctacgaacctccgtaccaataaaccacacgtactacagtggacgttagnggtacgtccagctaagcgtacgacgaccgaccggccttacgtatttaccgtgtcgacggagaccgtacccgaggtactccgggtagaccgtcccgttaaccggnaaccgggtcccgtaccgttttacgtaccggttccggtaccggggg

SEQ ID NO: 209299 - DNA, 738 bp, Homo sapiens
  misc_feature: GYAE6OF02ITZXU.17.25.C03.1.454.CMB.1.raw
  modified_base (201)..(201): a, c, t, g, unknown or other
  misc_feature (201)..(201): n is a, c, g, or t
  modified_base (458)..(458): a, c, t, g, unknown or other
  misc_feature (458)..(458): n is a, c, g, or t
  modified_base (574)..(574): a, c, t, g, unknown or other
  misc_feature (574)..(574): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctgggaggatcctcttcgttggtggcagcagctacaagtcgcccactcccaggtgcagcgtggtgcgtagtcgtgggntggaggtaggaagaacgtccgtggggcctcgaggtcgtaaggtcctaccgtgtaccgaaggtcttcgtggtacttacctaccgtttacctacctagtacgtatacgaacgttgggtacgcgaccgacggccgtcgtacggtaaccgaaccggtaccgtaggacggtagggtacggtaggggtacggacgggtaacccggtaaacccctaacggtacgtcgggttacggttaccacgtacggttcgttaccgtacccnccccgtaacgtccggtaaccgaacgtacgtaacgttacccaggtaccgaacccgacgtacctaccctaacgaactaaaccacacgtactaacgagtaggtacgtcgaagtcgaccngacctcgtacgtacggaaccgtacgccggtaccttacgttaacttcggtagtaccggaaggtaccgtaccctaccggaccgtacggtcccggttacgacggtttcccggaccggcccgggtacggtccccgtttggttaaccgttccggttcccgggtacgggg

SEQ ID NO: 209300 - DNA, 820 bp, Homo sapiens
  misc_feature: GYAE6OF02HTAGU.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggagatcctcttcttggtggcagcagctacaagtcgacccacctcccgaggtgctagctggtgcagtcgtggggctaggaggtagaaggacgtccgtacggggcctacgaggtagaacggtctaccgtgacaaggtccttacgtagtacttccgtaaccgtttaccactagtacgtactacgtaacgtcgggtactccgaccgtaacggcccgtaggtacgaaccgtaaccggaccgtaggacggtaggaggtacgggacgtaccgggaaccctaaaccgtaacgtacggtacggttacgtacctacgttacgttccgttacctacccgaacccgtaccggtaccccggtacggaaaccgtaccgttaaccttaaccgacgtacccgtaaacccaaccggtaaacccttccgtaaaccaaaactaacccacgaaccgtaacctacggtaggtacggtaacggttaacgggaccgtacgtaccgtagtaaaccgcgttaacgtaaccggaaccggtaccgtaacccgggtactttaacgttaacttaccgggtacggaaccgttacgggaaaccgttcccgtaacccggaagggttcccgaacccgggttcggtaaacccggtcccgggtcggaaaccggttccgggtttaaccccgttacggtttaaccggttaccgtccgggggtaaacccggg

SEQ ID NO: 209301 - DNA, 921 bp, Homo sapiens
  misc_feature: GYAE6OF02FGTCX.17.25.C03.1.454.CMB.1.raw
  modified_base (696)..(696): a, c, t, g, unknown or other
  misc_feature (696)..(696): n is a, c, g, or t
tcagcgtagactagcacgaccggtgctcgatttagtagtgtagatttgggtttggggactcaacaaccacatctgtcctctagagaaaccctgtgagcacagctcctcaccatggactggacctggaggatcctcttcttggtggcagcagctacaagtgcccactcccaggtgcagctggtgcagtcgtggggctgaggtgaagagcctggggcctcgagtcgaacgggtctccgtgacaagggtcctttcgtgggtactttccaacggttttaccctcctaagttaggtacttaccaacgttggggtacgccggtccccgaggtccccgtcgttacgggaaccaaaccggtacccgttaggtaacggttcggggtaacgttcgggggggtaacttacgggggggtaacccctaaaaccccccgttaaaacggtaacccggttgggggtttaccgtttacccgaaaccgttaaccggggtttcggtttaccccgttttaccccaacccccccgtaaacggtttcccccggttaaccccggggggtaacccttaaccgggtaacccttttaaacccgaacgttaccggaaccccgtaacggtaaccctcccgttaccaaacgtaaaaccctaccgacgtacccttaaccagttacgggtaacggtttaggaacggtaccgtcccttagggaaaccncgtttaccgaacggaaccggtaaccgtacccggggttacccgttacgtttaacttaacccggttaggtacggacccggtaacggtccgttaaccccgacggtttaaccggtcccggggtttaggaaccccggttaccccgttaaccggggtaccccgttaacggggtccccgggtttacccgttttaccggggtaacccgtttttcccggggtaacccggggggg

SEQ ID NO: 209302 - DNA, 831 bp, Homo sapiens
  misc_feature: GYAE6OF02GD9W9.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccacgtcccaggtcgcacgcgtggtgcgagtcgtgggctggaggtaggaagacgtccgtcggggacctcgtaggtagtaacggtcctccgtcgacgtaacggtcgttcgtacggttacttaccgttaaccgtttaccttacgttaacgttaacgttaacttaccgtaacggttcgggtacgacccggaccggtaccggtcccggtacggtacggaaccgtaaccggtaccggtagggtacgggtacgggtaacggtacggggtaacggtaaccgggtaaccccgtaaaaccgttaacgtacggttcggtacctaccgtacgttacgtttccgttacccttacccgaacccgttaccgttacccggtaaccggtaacctaacgttacccgttaaccgtaccgtaacccgaacccgtaaccgtaacccttaccctaaaccgaaacgtaaaccgaccgtaacgtaaccgtaaggtaggttacgggtaacggttacggacgtactaccgtagtacctaccgtacgtaacgaacccgtaccgtaccgttacgttacttacgtacgtcggaacgacgtaccgtacccgtaccggtacggtaccggtcggaccgtaccggtccggtacggtaccgtccgggttcccgttacgttacggtccggtccgggaccggg

SEQ ID NO: 209303 - DNA, 729 bp, Homo sapiens
  misc_feature: GYAE6OF02GG0MH.17.25.C03.1.454.CMB.1.raw
  modified_base (230)..(230): a, c, t, g, unknown or other
  misc_feature (230)..(230): n is a, c, g, or t
  modified_base (287)..(287): a, c, t, g, unknown or other
  misc_feature (287)..(287): n is a, c, g, or t
  modified_base (294)..(294): a, c, t, g, unknown or other
  misc_feature (294)..(294): n is a, c, g, or t
  modified_base (317)..(317): a, c, t, g, unknown or other
  misc_feature (317)..(317): n is a, c, g, or t
tcagcgtagactagcacgaccggtgctcgatttagtagtgtagatttgggtttgggggtagtcagtctcagtcaggacacagcatggacatgagggtccccgctcagctcctggggctcctgctactctggctccgagctgccagatgtgacatccagatcgacccagtcctccactccctccctgtctgcctcgtggtgggggtcagagtcaccatcacttcgccgganaagtccacggtacttaaaactattaaagttgtatcagtcaaagaacctaggaaaacnccccganacctcctagtactactcgtggtncctactccacgtcgtcgacgtagcggtccgtacctagtcggtagttcgaggtcggctaacggtgtacgtcggtagggaacctaggttaactttaccaacttcctaccgtaaccaaccttaccaacccgtactaccgtcgtaacctaaccggtacggtaaggtaacttggtaccaacgtaacttaccgtaacttaccgttagtaaccctaacgtaacgttaaccgtttaacccgtacccgtttccccctacggtaacccttacgttttaaccgggacccggtaaaccggggggtaaaccttaacggttaggaaccggttaaactaaacccggtaaaaccggttaccgttaagggtaccggtcctttaccggaacccgttaacccttaacggtttacccgtttaggtttacccc

SEQ ID NO: 209304 - DNA, 621 bp, Homo sapiens
  misc_feature: GYAE6OF02IHOP1.17.25.C03.1.454.CMB.1.raw
  modified_base (188)..(188): a, c, t, g, unknown or other
  misc_feature (188)..(188): n is a, c, g, or t
  modified_base (201)..(201): a, c, t, g, unknown or other
  misc_feature (201)..(201): n is a, c, g, or t
  modified_base (296)..(296): a, c, t, g, unknown or other
  misc_feature (296)..(296): n is a, c, g, or t
  modified_base (310)..(310): a, c, t, g, unknown or other
  misc_feature (310)..(310): n is a, c, g, or t
  modified_base (422)..(422): a, c, t, g, unknown or other
  misc_feature (422)..(422): n is a, c, g, or t
  modified_base (455)..(455): a, c, t, g, unknown or other
  misc_feature (455)..(455): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtcctccatccctcctgtctgcctntggtggggtcagntcaccatcacttgccggacaagtcacggtacgttaaaaccttatttaaattggtatcagcaagaaacctggaaaacgccccagtacccttcctanatcctcgtgggtcncacttccactctcggacgtaaggtcggtccgtacccagttcgggtacgttcgtaaggtcggtatagggtgacttcgggagggtaccagttactttacgaactctacacctancctactactcgtcactaacgtagtagtatgtanactatacttactactacgtacaacgtagtacgttacgacgttcccctagtaccttacggtttaccggaaccggtacggggtaacctaagggttcgaaacgtactaaccggaaacgtaacggttgtaaccggtctaccgtaacctaccgtacgttccgttcgttacc

SEQ ID NO: 209305 - DNA, 680 bp, Homo sapiens
  misc_feature: GYAE6OF02FL86F.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcaggtgaaggtctccgtgcaaggcttctggattcacgtttacctcctatagtatctaacgtgggtacgcgccagggccgctggaacaaccgacctgaggtgggagtgggagtggggaccgaaaccccgtaacacgttcgggtgtcgaacgaggtcgttccttacacccctacgtcccgtacccgggacgtacgtaaccttaccgatcgaacccaacgaacctccctaccaactaaaccaccaacgtcctaacagtgggtagttaggaggtacgccgtagactacgtcgtagaaccgaccgtaccggtcccgtacgttaacgttacgtcggttaacgaccggtaaccggtaccgttacccggaacgtaccggttacccgggtacggacccggtacccgttaaccgggccggtaccggacccgggtttacccgtttacggtacccgtttcgggtacccggggg

SEQ ID NO: 209306 - DNA, 748 bp, Homo sapiens
  misc_feature: GYAE6OF02HR3I6.17.25.C03.1.454.CMB.1.raw
  modified_base (102)..(102): a, c, t, g, unknown or other
  misc_feature (102)..(102): n is a, c, g, or t
  modified_base (725)..(725): a, c, t, g, unknown or other
  misc_feature (725)..(725): n is a, c, g, or t
  modified_base (739)..(739): a, c, t, g, unknown or other
  misc_feature (739)..(739): n is a, c, g, or t
tcagcgtagactagcacgaccggtgctcgatttagtagtgtagatttgggtttgggggagtcagtctcagtcaggacacagcatggacatgagggtccccgntcagctccgtggggctcctgctactctggctccgagctgccagagtgtgactatccagatcgacccagtctccactccctcctgtctcgcctcgtgggtcgggggtacagtacgtacctaccatacctacgttcggaccggaaccaaaggtaccgaacggttaaaccgttaaaaaacctttaagttttaaaaagttcgggtaactacgaacgtaacgtaaaacggtaaaaaccgtaagggaaaaaccccgccccgtaaacgacccgttaccctaaggtaaccttacgtccggtagggtacggtacctaactccctaaccgtctacgggaaccgttaacgtccgggtacctaccccgtaggttaccggtacgttacgtagggtacgacgtaggttagtactggtaacgggtactaaagtactttaacaacttctaccaaccgtactaaccaccttaacgtctaaccgtaacaaaccggtagtacggtagttacgtactaactaacttacgtaacttacgtataacaacgtagtaaccgttacctaccggttccctacgtaacgttccgttacggaaccggtaaggtaactaaggtcaacgttacgaacgtaacgagtaggtacnctacgacttacgtntacttctac

SEQ ID NO: 209307 - DNA, 990 bp, Homo sapiens
  misc_feature: GYAE6OF02HFNJ1.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatcgacccagtctccactcctccctgtctcgtcctcgtggtgggggtcaggacgtcaccatcctaccgttcggaccggaacaacggtccgaccgggtaaccgtttaaaaccttaagttttaaagttggtaactacagaccgaaacgtaaaccctagggaaaaaccgcccccaacgtaccccttcctagtacttcccgttacggttgggtaccgacctaacctcccgtaaccttcggtacgggtaccgggtaacgggtccgggtacccgttacccctaacggttaccgggttaagggtttaccggtaagggtcgggtacgtaggggttacggtacgttacggggtacggggtaactaacgggtttaccttttaaccgaaacgtttacccctaacccgtaacccgtaacccttaaccccgtaaacccgttacccgtttacccggtaaccggtaacccgttaaacccgggttagggtaaaccgggtttacgttaacggttacccggttaaaaccgtttaaccgtttaacccggtttaaaccgtttaaccgttaaccggtttaaacccgtaaaaccgggttaaaccggggtttaaccccgttttaaccccggttaccccgggtttttacccccgtaccggttttacccggttttaacccgggttttaccggggaaacccgggttaaaccggggggttaaaaccccttagggtttaacccggtaaacggttaaacccggtaaaccccggtaaaacgggtttaacccgggtagggtttaaccggtacccgtttacggaaaccccctttaaccgggtactttcccggtttaccggtttaacc

SEQ ID NO: 209308 - DNA, 761 bp, Homo sapiens
  misc_feature: GYAE6OF02JIVVO.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcgtgggctcagtgaaggtctctgcaggcttctggattcacgtttacctcctatagtatcgaactgggtgccgccgaggccgctacgggacaaccgacctggaaggtggagtggggacgtcggggaccgtaaacccctaagaccgttgggtcgtaccaacgtaggttacgtcttacccaaccctacgttccccggtaccggggaactacgtaaccttaccgactacgaacccgtaaccgtaaccttccctaccgaaacttaaaaccgacctaaacggaccccttaaacgaacgttcgggtaacgggtttacgaaacggggtacctaccccgttagaacccgtatttacccgtaaggaacccgaacccggtaccgggtacccgttacttaacgtttaaccgtggtaccggaaccgtacggtacccgtccccgtaacgggtaccgttttacccgggggacgtaacccgggtaccccgttaaccggggacccgttacgggtccccgggttttacccgtttttacggggtaacccttttcccggggggaacccgggggg

SEQ ID NO: 209309 - DNA, 772 bp, Homo sapiens
  misc_feature: GYAE6OF02HE59E.17.25.C03.1.454.CMB.1.raw
  modified_base (184)..(184): a, c, t, g, unknown or other
  misc_feature (184)..(184): n is a, c, g, or t
  modified_base (296)..(296): a, c, t, g, unknown or other
  misc_feature (296)..(296): n is a, c, g, or t
  modified_base (314)..(314): a, c, t, g, unknown or other
  misc_feature (314)..(314): n is a, c, g, or t
  modified_base (493)..(493): a, c, t, g, unknown or other
  misc_feature (493)..(493): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgccactcccaggtgcagctggtncagtctgggctgaggtgaagagccgtgggcctcgagtgaaggtctccgtgcaaggtcttctggtatttcgaaccgttttacctccgtaatagtagtccaaacgttggggtcnccgtccgaagggtcccgngtcgggaaccaacggtacctggacgtggaacgtgggacgttgggaccgtaaaccctaacgacgtggtgtacctaacgtacgttcggttacttccaacccgtattcccggtaccgggaactacgaccgtttaccgaagtccgtaaccaaccgtaaccttcccgtacctaaaactaaaccncgaacgtacccttaacgtaacgttagggaacgttacggaagggtaacctccgtaacgaactacgttaacgtcgaaacccgtccggtaccggttacccttacttaaacgttttaccggtagtaccggaaccggtaacgggtacccgttacccccggaaggttaacccggttccccggggttagaaacccgggtcccccggtttaacgggaccggtacggggttaccccgggtttaaccctttttacggggaaccccgtttttccggggtaacccgggggg

SEQ ID NO: 209310 - DNA, 699 bp, Homo sapiens
  misc_feature: GYAE6OF02J2YSR.17.25.C03.1.454.CMB.1.raw
  modified_base (164)..(164): a, c, t, g, unknown or other
  misc_feature (164)..(164): n is a, c, g, or t
  modified_base (214)..(214): a, c, t, g, unknown or other
  misc_feature (214)..(214): n is a, c, g, or t
  modified_base (341)..(341): a, c, t, g, unknown or other
  misc_feature (341)..(341): n is a, c, g, or t
  modified_base (384)..(384): a, c, t, g, unknown or other
  misc_feature (384)..(384): n is a, c, g, or t
tcagcgtagactagcacgaccggtgctcgatttagtagtgtagatttgggtttgggagtcagtctcagtcaggacacagcatggacatgagggtccccgctcagctcctgggctcctgctactctggctccgagctgccagatgtgacatccagatcgaacccngtcctccactcctcctgtctcgcctcgtggtcggggtacagagtccaacnctcaccgttcgaccggaacaacgttcgaaccgggtactttaaaacctaatttaaacgttggaactcagctaacgaaacctaggaaacgtcccagccctacgtacactctcgtagtcgacactctacngtacgagtacggtcgccttacccgagtcggttacgttaccggnggtcggtacgtaggtagtacgtacggtaggtactaacgtttacgttaacaccgtcgtaccaacctactaccaccgtctaccgaccgtaaccgtaacgtaggttacgtaagttcgaactaacgtacgttaccgttaccgtaaccgtacgtaaccgtaacgaccggttaacccttacccgtaaccgttacccgtacgtttaccgttaccggttaccggtaaccggtaacggtaacgttacggtactaaccggtaacttaaccgaaacgtcgttaccgtcggaactaccgtaccgtaccgttactcccggttagtccc

SEQ ID NO: 209311 - DNA, 700 bp, Homo sapiens
  misc_feature: GYAE6OF02FMD0N.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagcgtgggcctcagtgaacggtctccgtgcgaggtcttcgtggacttctacgtttacctcctatagtactcaacgtgggtcgccgccgacggccgtcgtacgggaacctaaccggtaccgtaggtacggtacgggtacgtacggggacgtacgggaccgaaacccgtaacgtacgtgggtcgtacgacgtgtcgtcttaccaccctacgtccgtaccggactacgtacctacgactacgaccacgtaacctcctacgaaacctaaccacgtactacgtaacagtcggtagtacgaagggacctaccgtagacctagtacgtaggaaccgtccgggacccgtaccgtttacgttaaccgttcgttacgggacggtccgtaaccgggttccgacccggtacggtccggttacccgggtacgaccccggttccggaaccggtaccggttacggttacccggttccggtttaacgtttcccggtcggggtaacccgggg

SEQ ID NO: 209312 - DNA, 847 bp, Homo sapiens
  misc_feature: GYAE6OF02GJ19L.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttggtggcagcagctacaagtgcccactcccaggtgcagctggtgcaggtcgtggggctggaggtaggaaaggaacggccgttcgggggccctcgaaggttggaaacgggttcctcccgtggacgaaacggtcctttcgtgggtactttccgtaaccggttttaccctaccgttaattacggtaacttaaccgtaaacgttcgggggtacgtccggaccctacggggcccggtacgttacgggaacccaaaccggtacccgttgggacgggttgggaagttcggggaacgttacgggggaaccgtaaacccccgtaagaccgttcgggtacgtacgaccgtagttcgttaccttccgaccccgtagtacccggtaccgggaactaacgggtaccctttaaccgacgtaccggaaccctaacgtaaacccgttccctaaccgaaaacctaaaccgaccgtaacggtaaccttaaaccgacggttacgggtaaggttacggaacggtacgtaccttaggactacgtacgtacgaaccggtaacggtaccggtacccgtttacttaaccgttacgtggtacggtaccggtaggtaacccggtccccggtaacggtaccgttacccgggtacggacccgttaccggtaccgggacccgtaacgggtcccgggtttaccctttacgggttacccgtttgggtacccgggggg

SEQ ID NO: 209313 - DNA, 700 bp, Homo sapiens
  misc_feature: GYAE6OF02HTW4Q.17.25.C03.1.454.CMB.1.raw
  modified_base (238)..(238): a, c, t, g, unknown or other
  misc_feature (238)..(238): n is a, c, g, or t
  modified_base (294)..(294): a, c, t, g, unknown or other
  misc_feature (294)..(294): n is a, c, g, or t
  modified_base (305)..(305): a, c, t, g, unknown or other
  misc_feature (305)..(305): n is a, c, g, or t
  modified_base (324)..(324): a, c, t, g, unknown or other
  misc_feature (324)..(324): n is a, c, g, or t
  modified_base (368)..(368): a, c, t, g, unknown or other
  misc_feature (368)..(368): n is a, c, g, or t
  modified_base (375)..(375): a, c, t, g, unknown or other
  misc_feature (375)..(375): n is a, c, g, or t
  modified_base (523)..(523): a, c, t, g, unknown or other
  misc_feature (523)..(523): n is a, c, g, or t
  modified_base (623)..(623): a, c, t, g, unknown or other
  misc_feature (623)..(623): n is a, c, g, or t
tcagcgtagactagcacgaccggtgctcgatttagtagtgtagatttgggtttgggtacgtcaacaaccacatctgtcctctagagaaaccctgtgagcacagctcctcaccatggactggacctggaggatctcttcttggtggcagcagctacaagtcgcccactcccgaggtgcagcctggtgacagtcgtggggctggaggtgaagacgccgtgggcctgagtgaggtctccgngcgaggcttcgtggtattcacgttttacctccgtatacgtatccaacgtgggtgcnccgaggcccgntacggaacaacgacgtggngtacggatggggatcggggacctaaccctaatacgtgggttacnccgtaancggtttcgtcttacccggaccctacgtcccgggtaccggataaccgtaaccttacccgagtaccgtaacccgacggtaaccttaccctaaccgtaaactaaaccgactaaccgttccgtaaccagggtacggaagtttcggaaggacncccgtaatcaacgtttcacggaaccttacgacccggtcgttaacccttagtttaacgtcggtacgaaccgggtcgtaaccgttccccgacgggttaaccncgggttacgacccggtaaccctcgggaccgtaacgggtcccggttacccggttttagtacccgttcgggtaccgggg

SEQ ID NO: 209314 - DNA, 669 bp, Homo sapiens
  misc_feature: GYAE6OF02HWBK7.17.25.C03.1.454.CMB.1.raw
  modified_base (288)..(288): a, c, t, g, unknown or other
  misc_feature (288)..(288): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctctttcttggtggcagcagctacaagtgcccactcccaggtgcagctggtgcagtctgggctgaggtgaagaagccgtggggcctcgagtgaaggtctcctgcaaggcttcgtggtattctacgttttacctcctatagtactcaacgtgggtncgccgaggccgctacggacaaccgaccgtggacgtggatggggagtcgggaccgtaaacccctaacgacgttacggtacgtacgactaaggtcgttcttccacccgtacgtcccgtaccggtaacacgtaccttaccgatacgaacccgacgaacccttcctacctaaattaaaaccacgaacgtacccttaacgaacggtaggtaacgtttaggaacggactacccgtagaccgtagttacgtaccgacgaccgtaacccgggtcccttacgttagttaaccgtggtagccgtaacgaccgtccccgaggtaccgttccgggagaccgtaccggtacgccgtaacggccggtttacctttggacccgttcggtaccgggg

SEQ ID NO: 209315 - DNA, 604 bp, Homo sapiens
  misc_feature: GYAE6OF02IAWRV.17.25.C03.1.454.CMB.1.raw
  modified_base (220)..(220): a, c, t, g, unknown or other
  misc_feature (220)..(220): n is a, c, g, or t
  modified_base (445)..(445): a, c, t, g, unknown or other
  misc_feature (445)..(445): n is a, c, g, or t
  modified_base (551)..(551): a, c, t, g, unknown or other
  misc_feature (551)..(551): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagcgtgggcctnagtgaaggtctccgtgcgaaggtcttcgtggtacttctaaccgtttacctcctatagtactcaacgtgggtcgcgccgacggcgcgtagacgaacgacctaggagtggagtgggagtcgggaccgtaaaccacgtcgtggtctacacgagtctcttaccacctactccgtaccggaacacgtaccttacgataccgacctacgacctcccgtaccaaataaaccncacgtaccaacgtagtggtagttgagacgcagacagttcgacggacgaccgaccggcttacttaactacgcggtgacgacgaccttacccgaaggttcgtaccggngaccgtaccgtacggcgacgtccggttactttcggtaccgttgggtaccgggg

SEQ ID NO: 209316 - DNA, 646 bp, Homo sapiens
  misc_feature: GYAE6OF02FKR59.17.25.C03.1.454.CMB.1.raw
  modified_base (284)..(284): a, c, t, g, unknown or other
  misc_feature (284)..(284): n is a, c, g, or t
  modified_base (297)..(297): a, c, t, g, unknown or other
  misc_feature (297)..(297): n is a, c, g, or t
  modified_base (319)..(319): a, c, t, g, unknown or other
  misc_feature (319)..(319): n is a, c, g, or t
  modified_base (325)..(325): a, c, t, g, unknown or other
  misc_feature (325)..(325): n is a, c, g, or t
  modified_base (451)..(451): a, c, t, g, unknown or other
  misc_feature (451)..(451): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtggaaggtctcctgcaaggcttctggattcaccgtttacctccttatagtactcaacgtgggtncgtccgagcccgntacggacaacgacctgagtggntggggntagggaccgaaccctaacgactggtgtccacgagtcgtaccttaccaccctagtcccgaccgggtacacggtaccttaccatacgaccacgtacctccctaccgaactaaaccacgactccctaanacgttgggagttaagacgggtaacacccgtgaacctcgtacgtaggacccgaaccgtacccggggtaccttacgttaacttaccgtaggttaccgacgggtacgtaccgtcccgaacgtacggtaccggttacgaccgtcccgtaacgggtactaccggtcccggttaccgtttacgtaccgttcgggtacgggg

SEQ ID NO: 209317 - DNA, 591 bp, Homo sapiens
  misc_feature: GYAE6OF02ITNRY.17.25.C03.1.454.CMB.1.raw
  modified_base (356)..(356): a, c, t, g, unknown or other
  misc_feature (356)..(356): n is a, c, g, or t
  modified_base (433)..(433): a, c, t, g, unknown or other
  misc_feature (433)..(433): n is a, c, g, or t
  modified_base (463)..(463): a, c, t, g, unknown or other
  misc_feature (463)..(463): n is a, c, g, or t
  modified_base (473)..(473): a, c, t, g, unknown or other
  misc_feature (473)..(473): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagcctggggcctcagtgaaggtctcctgacaaggctctggattcgacgtttacctcctatagtatactaacgtgggtcgccgcgacggccgcgtcggaacaacgaccgtgacgtggagtgggagtcgggaccgtaacctaacgcgtggtnacgacagtcgttctaccaccctagtccgtacggactacgtacctaccatcgaccgaacgacctccacaacgtaaacncaacgtcctagacgttgaagttggacgacnccgtagactntacgtagacgacgaccggtctacttacttacgtgtcggacgtacgtacgccctaacggcgtcggacgtacgacccgttacggcgtacgggccgttctttacgaccgttcggtaacggg

SEQ ID NO: 209318 - DNA, 649 bp, Homo sapiens
  misc_feature: GYAE6OF02JLT09.17.25.C03.1.454.CMB.1.raw
  modified_base (277)..(277): a, c, t, g, unknown or other
  misc_feature (277)..(277): n is a, c, g, or t
  modified_base (565)..(565): a, c, t, g, unknown or other
  misc_feature (565)..(565): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctgggcctcagtgaggtctctgcaggcttctggattcacgtttacctcctatagtatacaacgtggggtncgccacgggccgtcgtggaccaacggacctggaagtggagtcgggagtcggggacgaaaccctaacgacgttggtacgtcgacgtaggttcgtccgtttaccacccgtacgtcccgtaccggggaactacggtaccttacccgaatccgaacccaacgtaaaccttccccgtaccaaactaaaaccacccgtaagtaccccgttaaacacgtacgggtaagttcgaaacggggctacccgtgaaccctagtcgtacggaccgacgacggtcccttattaacgttacgngtacggcgtacgtacctacccgaagtcgtacggtgaaccgtcccgacggctacggccgttaccgtttggtaccgtcggtcgggg

SEQ ID NO: 209319 - DNA, 216 bp, Homo sapiens
  misc_feature: GYAE6OF02HN3TH.17.25.C03.1.454.CMB.1.raw
  modified_base (172)..(216): a, c, t, g, unknown or other
  misc_feature (172)..(216): n is a, c, g, or t
tcagcgtagactagcacgaccggtgctcgatttagtagtgtagatttgggtttggggactcaacaaccacatctgtcctctagagaaaacccctgtgagcacagctccctcaccatggactggaccctggaggatcctcttcttggtgcagcagctacagtcgcccactccnnnnnnnnnnnnnnnnnnnnnnnnnnnnnnnnnnnnnnnnnnnnn

SEQ ID NO: 209320 - DNA, 679 bp, Homo sapiens
  misc_feature: GYAE6OF02H7KRF.17.25.C03.1.454.CMB.1.raw
tcagcgtagactagcacgaccggtgctcgatttagtagtgtagatttgggtttgggggactcaacaaccacatctgtcctctagagaaaaccctgtgagcacagctcctcaccatggactggacctggaggatctcttcttggtggcagcagctacaagtgcccactcccaggtgcagctggtgcagtctgggctgaggtgaagaagccgtggggcctcagtgaaggtctcctgcaaggcttcgtggattcacgtttacctcctatagttatcaacgtgggtgcgccgaggccgcgtggacaacgacctggaggtggatggggatggggaccgtaaaccctaacgacgtggtcgtcaacgtagtcgttcttaccaccccgtctacccgtccggggaactacggtaccttacccgatccgaaccctacgaacctccctaccaaactaaaccaccaacgtaccctaacgagttacgggtacgttaggaacgggtacgtcccgttagaacctagtcgttacggaaccgacgtaacccggtccgttacttaacgttcgtaggtcggacggtaacgtaccggtaccccgaaggtccggttcccgggtaaggtacccggtacccgttaccgggaccgaacgggtcccgggttaccgtttacggttaccgttcgggtacccggggg

SEQ ID NO: 209321 - DNA, 559 bp, Homo sapiens
  misc_feature: GYAE6OF02H9532.17.25.C03.1.454.CMB.1.raw
  modified_base (240)..(240): a, c, t, g, unknown or other
  misc_feature (240)..(240): n is a, c, g, or t
  modified_base (343)..(343): a, c, t, g, unknown or other
  misc_feature (343)..(343): n is a, c, g, or t
  modified_base (380)..(380): a, c, t, g, unknown or other
  misc_feature (380)..(380): n is a, c, g, or t
  modified_base (429)..(429): a, c, t, g, unknown or other
  misc_feature (429)..(429): n is a, c, g, or t
  modified_base (502)..(502): a, c, t, g, unknown or other
  misc_feature (502)..(502): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctctgcaaggnttctggattcacgtttacctctatagtatcaacttgggtcgacgctaggcccgacttcgggaacaaccgacctggagtggactgggatcgggacaaccctaangtggtgtacacgagtcgtcttacacccatccgcgganacgtactcatcgaccacgtaactcctacaactaaacactacgcctaacngtgagtagacggagccctagacatcgtagacacgaccgccgtacttagttcgtcgagcgtacgacttacccgngtacgtacggcgacgacccgtggaccgtaggccgtacgtttgaccgttggtaccggg

SEQ ID NO: 209322 - DNA, 734 bp, Homo sapiens
  misc_feature: GYAE6OF02GKRSY.17.25.C03.1.454.CMB.1.raw
  modified_base (191)..(191): a, c, t, g, unknown or other
  misc_feature (191)..(191): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgnggggctgaggtgaagagccgtggggcctcagtgaaggtcctctgcaaggtcttctggattcacgtttacctctatagtactcaacgtgggtgcgccaggccgcgtggacaacgtaccgtgagttcggagtggggagtcggggacgtaaacccctaacgtacgtgggtctacaacgtaggtcgttaccttaccaaccccgtacttccccggtaccggggtaaccctaacggtaaccctttaacccgaacgttacggaaaccctaaacccggaaacccctttcccttacccgaaaacgttaaaacccacgtaaccgaaccccttaaacgacgttacgggtaaggtttacggaacgggtacgaccgttacgaacgtacgttcgtaacggaaccgtaaccgaccgggtccttactaacgttacgtacgtcggaccgtaagtaccgtacccgaacggtaccggtttccgggtagtacccggtaacccgtacggggccacggggttcccggttacccgtttttacggtaccggtttcggtacccggggg

SEQ ID NO: 209323 - DNA, 832 bp, Homo sapiens
  misc_feature: GYAE6OF02IZJLU.17.25.C03.1.454.CMB.1.raw
tcagcgtagactagcacgaccggtgctcgatttagtagtgtagatttggtttgggactcaacaaccacatacttgtccgtctaggagaaaaccctgtgacgcgacagctcctcaaccatcgactggactggaggatcctcttcttggtgcagcacgctacgaagtgcccactccgaggtgcgaagcgtgtgactagtcgtgggctggagggtagaacgacgccgtcgggcctcgagtgaacggtcctccgtacgacgaacggtcttccgtcggtaccttacgtaccgtttaccctccttaattagtactaccgtaaccggttgggtacggccgtaccgacgggtacccgcgttagggaaccaacgtaccgtggaagtacgggtacgtgggtaacgtcgggaaccctaaccgtaacgcgttgggtacctacggacgtacggttcgtaccgttaccaacccgtacgtcccggtacggactacgtaccttacgactcgaaccgaacgccttacgactaaacgtaacacgaacctacctaacgtacgtaacgggtagttaacggacggtaccgacccgttaggaaaccttcggtacccgaaggaaacccggtacccgggtaacccggtccgttttaaccggtttaactttaccgggtacggttacccggggaaaaccgtttacgtaaccccggttcccccgggaaacgggtttaacccgtttaaccccggggtcggaaaaccggttttccccgtaaccggttaacccgggtgggtttaccccccggttttaaagtttcccccggggttaacgttttccccggggaacccggggggg

SEQ ID NO: 209324 - DNA, 701 bp, Homo sapiens
  misc_feature: GYAE6OF02GLUQW.17.25.C03.1.454.CMB.1.raw
  modified_base (283)..(283): a, c, t, g, unknown or other
  misc_feature (283)..(283): n is a, c, g, or t
  modified_base (307)..(307): a, c, t, g, unknown or other
  misc_feature (307)..(307): n is a, c, g, or t
  modified_base (350)..(350): a, c, t, g, unknown or other
  misc_feature (350)..(350): n is a, c, g, or t
  modified_base (440)..(440): a, c, t, g, unknown or other
  misc_feature (440)..(440): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctcctgcaggcttctggattcacgtttacctctagtagtatcaacgtgggtncgccaggccgctggacaacgctgngtggagtgggatgggaccaaccctaacgacgttgggtcgtcanaggttctcctaccaccctacgtccgtccggactacgtaccttaccgacgtcgaaccaaccgtaacctcccgtaaaccaacttaaaacccncgtaacctaccctaagtacggttagggtaacggttggaacgggtacgtcccgtaggtaacctcgttaccgaagtaacccgggacccgtaccggggtacccttacgttaaacgttcgtacggttcgggaccggtaaccggttcccgtaaccccggtacggtccggttacccggggttacgtaacccggtacccccggtaaggcccggtacgggttcccgggttaccctttttccgggtacccggtttggggtaacccggggg

SEQ ID NO: 209325 - DNA, 532 bp, Homo sapiens
  misc_feature: GYAE6OF02FXYEX.17.25.C03.1.454.CMB.1.raw
  modified_base (261)..(261): a, c, t, g, unknown or other
  misc_feature (261)..(261): n is a, c, g, or t
  modified_base (431)..(431): a, c, t, g, unknown or other
  misc_feature (431)..(431): n is a, c, g, or t
  modified_base (483)..(483): a, c, t, g, unknown or other
  misc_feature (483)..(483): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggggcctcagtgaaggtctcctgcaaggcttctggattcacgtttaccncctatagtatcaactgggtgcgccaggccgctggacaacgacctgagtggatgggatggggcgaaccctaacactggtgtcacagtgtcttcacccatccgtcgggacagaccttaccatcgacctacgaactcctcaataaacacagcctaacatggagttggaggacncctgacatctagacgtacacggcctactatactgtgcgagacgtccctacgntacccggtgacgtcgtacggcacggccggtctttgaccttcgtacgggg

SEQ ID NO: 209326 - DNA, 751 bp, Homo sapiens
  misc_feature: GYAE6OF02FNW5I.17.25.C03.1.454.CMB.1.raw
tcagcgtagactagcacgaccggtgctcgatttagtagtgtagatttgggtttgggagtcagtctcagtcaggacacagcatggacatgagggtccccgctcagctccgtggggctcctgctactctggctccgagctgccagatgtgacatccagatcgacccagtcctccatccctccctgtctgcctcgtggtgggggtcaggacgtcaccatcacttcggacccggacaacggtcgaacgggtacgtttaaaaaccttaattttaaagttggtatcagacaagaaaccgtggaaaaccgccccaagaccctcctgactctcgtggtcacactccactcgtgacgtaagtggaccgtcctagtcggaggttcaggtggcgtaggtggacgtcgtagggactagttactttacaacttccaccgacctactacctaaccctacttccgttacggaacctaaaccggtagggtaacggttacgtttacggacgtaaccgttaaactttaccgttaaccgttaccttaacggtaacctaaaaccgtaacgggttaaaccggttttaaccccgtaaccccggttttaccccccgtacggtttaacccgttttacccggggaacccggttaacggggtaaacccgttaaagggttcgaacggtaaccgttaaaccggaaacccggttaacgtcgggttacggtaccttacgggaaccctaacccggttatttcccggttacttaccgttaccg

SEQ ID NO: 209327 - DNA, 691 bp, Homo sapiens
  misc_feature: GYAE6OF02GYK1F.17.25.C03.1.454.CMB.1.raw
  modified_base (336)..(336): a, c, t, g, unknown or other
  misc_feature (336)..(336): n is a, c, g, or t
  modified_base (684)..(684): a, c, t, g, unknown or other
  misc_feature (684)..(684): n is a, c, g, or t
tcagcgtagactagcacgaccggtgctcgatttagtagtgtagatttggggtttgggggagtcagtctcagtcaggacacagcatggacatgagggtccccgctcagctcctggggctcctgctactctggctccgagctgccagatgtgacatccagatcgacccagtcctccactccctccctgtctcgcctcgtggtcgggggtcagacgtacaccatctacgttcggaccggaacaacgtacgacggtaacgttaaaactatttaaagtggtatcagacaacgtaaacgtaggaaaccgccccaagtaccctctagtactacgtcgtcggtncctactcctactcgcgtaacggacggtcggccctaccagtcggtacgttacgagggttcggacgtagggtagacggttgacggggaatagttacttacctaacgttcctaaccgtaacctaactacccgaaccttaccgttacgaacggtaaccctaaaccggtagtacgggttatacgttaacgtaactaaccttacgtaccgttaactcgtaaacccaacgttaacgttaccggttaccctaccgtttcccgacgttacctttaccggttcggaaaccgggtaacgtaaccttagtacgaacgtacgaaccgtaatcggtgtacgctaccgaccttacctgttcgngtttacc

SEQ ID NO: 209328 - DNA, 640 bp, Homo sapiens
  misc_feature: GYAE6OF02HRDEP.17.25.C03.1.454.CMB.1.raw
  modified_base (212)..(212): a, c, t, g, unknown or other
  misc_feature (212)..(212): n is a, c, g, or t
  modified_base (220)..(220): a, c, t, g, unknown or other
  misc_feature (220)..(220): n is a, c, g, or t
  modified_base (247)..(247): a, c, t, g, unknown or other
  misc_feature (247)..(247): n is a, c, g, or t
  modified_base (301)..(301): a, c, t, g, unknown or other
  misc_feature (301)..(301): n is a, c, g, or t
  modified_base (351)..(351): a, c, t, g, unknown or other
  misc_feature (351)..(351): n is a, c, g, or t
  modified_base (393)..(393): a, c, t, g, unknown or other
  misc_feature (393)..(393): n is a, c, g, or t
  modified_base (424)..(424): a, c, t, g, unknown or other
  misc_feature (424)..(424): n is a, c, g, or t
  modified_base (451)..(451): a, c, t, g, unknown or other
  misc_feature (451)..(451): n is a, c, g, or t
  modified_base (492)..(492): a, c, t, g, unknown or other
  misc_feature (492)..(492): n is a, c, g, or t
  modified_base (583)..(583): a, c, t, g, unknown or other
  misc_feature (583)..(583): n is a, c, g, or t
  modified_base (625)..(625): a, c, t, g, unknown or other
  misc_feature (625)..(625): n is a, c, g, or t
tcagcgtagactagcacgaccggtgctcgatttagtagtgtagatttgggtttggggtacgtcaacaaccacatctgtcctctagagaaaaccctgtgagcacagctcctcaccatggactggacctggaggatctcttcttggtggcagcagctacaagtgcccactccaggtgcagctggtgcagtctggggctgaggtgaagaagccgnggggccanagtgaaggtctcctgcgaaggtcttcnggtattcgacgttacctccgtatagtaactcaacgttgggtgccgcaggccgtnggaacgaaccgacgtgaggtcggaagtcgggagtggggacccaaccgtanacggtaggttcggacacctaaggttggtaccttcacccctancccgggttaccggacacggttacctacgtancgaccctacgaaactccctacctaaanaaaccgaacacgactactaacgtgtaacggttggaaggacnccgtacgacgattcggtcaaccggacgaaccgggtccttacgttaactttctacggttcaacggtggaccgtccgaacgaacggtttccgngtaaccgtacccgtagggacgtacggccgttccggttttacncggttacgtccgggg

SEQ ID NO: 209329 - DNA, 592 bp, Homo sapiens
  misc_feature: GYAE6OF02JEECE.17.25.C03.1.454.CMB.1.raw
  modified_base (219)..(219): a, c, t, g, unknown or other
  misc_feature (219)..(219): n is a, c, g, or t
  modified_base (467)..(467): a, c, t, g, unknown or other
  misc_feature (467)..(467): n is a, c, g, or t
  modified_base (481)..(481): a, c, t, g, unknown or other
  misc_feature (481)..(481): n is a, c, g, or t
  modified_base (491)..(491): a, c, t, g, unknown or other
  misc_feature (491)..(491): n is a, c, g, or t
  modified_base (512)..(512): a, c, t, g, unknown or other
  misc_feature (512)..(512): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagccgtggggcctnagtgaggtctcctgcaggcttctggattctacgtttacctcctatagtactctacgtgggtcgcgccgaggccgcgtacggaccaaccgaccgtggaggtacggagtggggagtcggggaccgaaccccgtaacgtacgtggtcgtacgacgtagttcgtccttccacccacgtcccgtaccggactacgtaaccttaccgactacgaacccacgtaaccctccctacaaataaacaccagaccctangtcggagttgagcnctagacatcngaccacgcgtcctattattcngtagacgtagaccgtccaaggtcttccggagtaccgccgttacggctacggccggttacctttggaccgttggaccgggg

SEQ ID NO: 209330 - DNA, 730 bp, Homo sapiens
  misc_feature: GYAE6OF02GP5HU.17.25.C03.1.454.CMB.1.raw
  modified_base (247)..(247): a, c, t, g, unknown or other
  misc_feature (247)..(247): n is a, c, g, or t
  modified_base (264)..(264): a, c, t, g, unknown or other
  misc_feature (264)..(264): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagttctggggctggagggtgaaggaagccgtggggcctcagtgacggtctctgcaggcttgnggattctacgtttaccncttatagtattacaacgtggtgccgccgagggcccgtcgtacgggaccaaccggccgtaggagtcgggagtggggagtcgggaccgaaaccctaacgacgtgggtcgtaccgtaacgtggttcgttccgttaacccgaaccccgttcgttccccggacccggggtaacgttaaaccggtaaccctttaacccgaacgttcccgggaaccaaaccccggtaacctacccctaactaaaccttaaaacccgaaccgtaaaccgtacccgttaacgtacgtagggtacggttacggacggtacggtacctcgtaactacgttacgtaaccggtaacgacccgtaaccgttccgtaacttaccgttaacgtggtacgaccggagtaccgtacccgacgtaaccggttcggtacgtacgaccccgttaggacctacggtccgttcgttacgttaccgtcccgggtaccggg

SEQ ID NO: 209331 - DNA, 691 bp, Homo sapiens
  misc_feature: GYAE6OF02HMQYA.17.25.C03.1.454.CMB.1.raw
  modified_base (245)..(245): a, c, t, g, unknown or other
  misc_feature (245)..(245): n is a, c, g, or t
  modified_base (284)..(284): a, c, t, g, unknown or other
  misc_feature (284)..(284): n is a, c, g, or t
  modified_base (361)..(361): a, c, t, g, unknown or other
  misc_feature (361)..(361): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactccaggtgcatctggtgcagtcgtggggctgaggtgaagaagccgtggggcctcagtgaggtctccgtgcaaggcttcnggtattcacgtttacctctaatagtatcaacgtgggtcncgccgacggccgagtcggaacaacggtaccgtggagtggagtggggagtcggggaccaaaccctaacgcgttgggtntaccgaactaggttgtccttccacccctagttcccgtaccgggaacctaacggtaccctttaacccgagttacccgaaccctaacgtaaccccttcccgtaacctaaaccaaaaccctacgaccggtacccttaacaggttagggtaggttcggaaggtccgtccctaggactacgtcgtacgaacccgacgaccggtccttacttacgtttacgcggttacgacgtacgtaccggtacccgtacggttaccgtccgggtacgtaacccgtaccgggtaccggcgaccggttccggttacccgttttacggaccgtttcgggaccggggg

SEQ ID NO: 209332 - DNA, 665 bp, Homo sapiens
  misc_feature: GYAE6OF02HNEEQ.17.25.C03.1.454.CMB.1.raw
  modified_base (404)..(404): a, c, t, g, unknown or other
  misc_feature (404)..(404): n is a, c, g, or t
  modified_base (468)..(468): a, c, t, g, unknown or other
  misc_feature (468)..(468): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagcgtggtgcagtcgtggggctgaggtgaagaagccgtgggcctcagtgaagtctcctgcgaaggtcttacgtggattctacgtttacctctatagtactcgaacgtgggtcgccgccgacggtccgcgtacggaacaaccgtacgtagaggtggaacgtgggaagtcgggaaccgtaaacccgtaacgacgtaggtacgtcgacgtggttcgtcttaccgaaccctntcccgtacggactacgtaaccttaccgaatccgaccaacgaccctcccgtaaccaactaaaccncgtaccgacctactacgtacggtaacgttaggacgaacgccgtagtacctacgttacgtacgaacgaccgaccgtccgtacgttacttacgtcggtccgaacgtcgtaccgtacccgaacggtaccgtaccggtacgaccgtaccgtaccggcgtaaccggtcccgttacgtttacgtaccggttcggtacccgggg

SEQ ID NO: 209333 - DNA, 817 bp, Homo sapiens
  misc_feature: GYAE6OF02IK6PZ.17.25.C03.1.454.CMB.1.raw
  modified_base (773)..(773): a, c, t, g, unknown or other
  misc_feature (773)..(773): n is a, c, g, or t
tcagcgtagactagcacgaccggtgctcgatttagtagtgtagatttgggtttgggagtcagtctcagtcaggacacagcatggacatgagggtccccgctcagctccgtgggctcctgctactctggctccgagctgccagatgtgacatccagatgacccagtctccatcctcctgtctctcctcgtggtggggtcagacgtcacctactctacgttcgaccgaacgaagtccaacggtaacttaaaaaccttattttaaagttggtactacgaagaccgaaacgtaaaaccgtaaggaaaaaccgccccaacgtaccccttacctacgttaacttccgttaccggttgggttacgacctaaccgttaccctaacgtttccgtacggaccggtaaacggttccgggtacccgtacccctacggttaccggtacggttaccgagggtcgtacgaaggttacggtacgtttacgggagggtaactagttaaacgtttaccaacgttccgtacctaacctaactacccaaacccgtaccttctaccgtaacctaaacggtcgtaaggttacttaggtacgttaaccttaacgttcttaaacccgtagttaacgaacctaaaccggtaaggtttaaccttaccgtttacccgttccctaccgttacccgttttaccgggttaccggaaacccgggttagggtaaaacccgtttaagtacggtaaaaccgtaccgttaaaaccggaaccggtttaaacggtcggtaagggttaccnccggttaacccgaacttacggttttacccgttcgtttaaccccg

SEQ ID NO: 209334 - DNA, 593 bp, Homo sapiens
  misc_feature: GYAE6OF02G35YI.17.25.C03.1.454.CMB.1.raw
  modified_base (284)..(284): a, c, t, g, unknown or other
  misc_feature (284)..(284): n is a, c, g, or t
  modified_base (543)..(543): a, c, t, g, unknown or other
  misc_feature (543)..(543): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcgagtgaaggtctcctgcaaggtcttcgtggattcacgtttacctcctatagtatcaacgtgggtncgccgaggccgcgtggacacgtacctggagtggatgggagtgggaccgtaacctacgacgtgggtacgtacacgagtcgtcttaccacccacttcccgacgggacagtaccttaccacgtacgaccacgaacctcctacaactaacacacgacctacagtggagttagaggtacgccgtagacacgtcgacgacgaccgtaccggtccgttacttacttcgtcgtacgcgtacgtcgtacccgacgtacgtccgggtanacgtccgtaacggcgtacggtccgtcgttacggtaccgtcggtaccgggg

SEQ ID NO: 209335 - DNA, 644 bp, Homo sapiens
  misc_feature: GYAE6OF02JNMU5.17.25.C03.1.454.CMB.1.raw
  modified_base (304)..(304): a, c, t, g, unknown or other
  misc_feature (304)..(304): n is a, c, g, or t
  modified_base (315)..(315): a, c, t, g, unknown or other
  misc_feature (315)..(315): n is a, c, g, or t
  modified_base (331)..(331): a, c, t, g, unknown or other
  misc_feature (331)..(331): n is a, c, g, or t
  modified_base (343)..(343): a, c, t, g, unknown or other
  misc_feature (343)..(343): n is a, c, g, or t
tcagcgtagactagcacgaccggtgctcgatttagtagtgtagatttgggtttggggtactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaacgccgtggggcctcgagtaggaaggtcctccgtgcaaggtcttcgtagacttctacgttacctcctaatagtactcagtggtcgcgcgacggccgntggacacgacnggacgtggagtggagnggaccaacctanacgtggtgacgacgtagtcgtccttaccacctacgtcccggtcggaactacggtacctaccgagtccgaacctaccgtaaccacctaaccgtaaactaaacgacctacgaaccttaaccgaggtaccgggttagttacggaaggtaccgtacgtaccgaacgtctacgacggaacccggacgtaccgtacccgtagttaacttacggtacggtacgacggtcgtaccgtaccacggtacggttccgaagcccgtacgtccgaacggaccgttccggtacgttcgtaccgttcgaaccgggg

SEQ ID NO: 209336 - DNA, 789 bp, Homo sapiens
  misc_feature: GYAE6OF02GZYNI.17.25.C03.1.454.CMB.1.raw
  modified_base (246)..(246): a, c, t, g, unknown or other
  misc_feature (246)..(246): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctgaggtgaagagccgtggggcctcagtgaaggtctcctgcaaggtcttcnggattcgtacgtttacctcctatagtactacaacgtgggtgcgccaggccgcgtaggaccaacgtacctggagtggagtggggagtcggggacctaaccccgtaacgtacgtgggtcgtacctacgacgttcgttccttacccgaaccccgtacgttaccccggtacccggggaacctaaccggttaaccctttaaccccgagtttaacccggaaccctaacccggtaaacccttccccgtaaacccgtaaaccgttaaaaacccgaccgtaaccgtaaccccttaacgaacggttacgggtaacggttacgggaacgggtaacgtaccgtacggaaccgttaacttccggtaacggaaccggtaaccggtacccgggttccgttaacgtttaacgtttaaccgtcggtaacgtaccgtaacggtacccgtaccccgtaacggtaccggttacccgggtaaggtacccggtacccggttaccgggacccgtaccgggtcccggtttacccgtttacggtacccggttacccgggtacccgggg

SEQ ID NO: 209337 - DNA, 643 bp, Homo sapiens
  misc_feature: GYAE6OF02FZODK.17.25.C03.1.454.CMB.1.raw
  modified_base (293)..(293): a, c, t, g, unknown or other
  misc_feature (293)..(293): n is a, c, g, or t
  modified_base (342)..(342): a, c, t, g, unknown or other
  misc_feature (342)..(342): n is a, c, g, or t
  modified_base (362)..(362): a, c, t, g, unknown or other
  misc_feature (362)..(362): n is a, c, g, or t
  modified_base (452)..(452): a, c, t, g, unknown or other
  misc_feature (452)..(452): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcgtggattcacgtttacctctatagtatcaacgtgggtgcgccaggccgcnggacaacgacctgagtggatgggatggggacgaaccctaacacgtggtntcactgtgtccttcaccctntccgtccgggacacgacttaccagtcgaccacgaacctccctaccaataaaccacacgacctaacacgtaggtacgttggaacgggtacncccgtagaacctagtcctaggaaccggtaccgaccgggtcccgttaacttaacgtttaccgttggttaccggaccgtaggtaccgtaccccgaacggttaaccgtcccgggttaaggacccggtacccggtaccgggacctacgggtcccggttcccttttacgggacccgtttccgggtaacccgggggg

SEQ ID NO: 209338 - DNA, 634 bp, Homo sapiens
  misc_feature: GYAE6OF02JVN6Y.17.25.C03.1.454.CMB.1.raw
  modified_base (248)..(248): a, c, t, g, unknown or other
  misc_feature (248)..(248): n is a, c, g, or t
  modified_base (251)..(251): a, c, t, g, unknown or other
  misc_feature (251)..(251): n is a, c, g, or t
  modified_base (437)..(437): a, c, t, g, unknown or other
  misc_feature (437)..(437): n is a, c, g, or t
  modified_base (469)..(469): a, c, t, g, unknown or other
  misc_feature (469)..(469): n is a, c, g, or t
  modified_base (486)..(486): a, c, t, g, unknown or other
  misc_feature (486)..(486): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcgagtcgtggggctggaggtgaagaagccgtggggcctcgagtgaaggtctctgcgagtcttcngtntctacgtttcctctatagtatctaacgtggtcgccgaccgcggccgtcgtacggaccgaaccgaccgtggacgtgggacgtgggtacggtcggggaacccgtaaacctaacgtcgtcggtacgtacacgtacgttcgttcttaccgacccgtacctcccggttaccgggaactaacgtacctaccncgtaaccgacctaacgtacctccgtactaaanacctacgacgtacctanacgttaggaggtagacgatccgtagtacagttacgagaccgaccgacgtcttactacgttgcgtacggcgaacgtccaccggttcgacggttcggagtacccgaccgtcggccacggtccgttaccgttacggttcggttcggcgggg

SEQ ID NO: 209339 - DNA, 793 bp, Homo sapiens
  misc_feature: GYAE6OF02F93UY.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcagtgaggtctcctgcaaggcttcgtggtattcacctttacctcctatagtacttcaacgttgggtgccgtccagggcccgcgtacgggaccaaaccggtacctagggacggtgggagtgggggaagtgggggacccgaaacccgtaacgacgtggtacgtcactaggtcgttccttaccaccccacgttcccgtaccggggtaacctacgtaccctttaaccacttacgaacccaccgtaaacctccccttaccgaaacttaaaccgaccgacgtacccctaacgtaacgttcgggtaacgttagggaacggtaccgtacccgttacggaaactacgttaccgttacggaaacccggtaacccggtaaccgggtacccggttaacgttttaaaccgttaacccggtttaacgggttaccgaccggtaacggtacccggttaacccgaacgggttaacccggttaccccgggttaacgggaacggtacccccgggttaacgggcccgttaacgggggtaccccggttacccgtttttcgggttaaaccggtttcccgggggtaaacccggggg

SEQ ID NO: 209340 - DNA, 618 bp, Homo sapiens
  misc_feature: GYAE6OF02F8J1B.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagcctggggcctcagtgaaggtctcctgcaggcttctggattcacgtttacctcctatagtatcaactgggtgcgccaggccgctggacaacgacctggagtggagtgggagtcggggactaaacccctaacgactgggtcgtcacgtagtgtccttcaccctatcccgtccgggacacgtaccttaccagtcgaccctaacgaacccttcccacctaaactaaaccacacgtacctacagtagggtaagtttcggaaggtacgtcctagacctatccgtagaccgacgacggtccgtacttattactgtcggcgagtaccgtacccgacgtaccgtccgggtacgtaccgacccgtacgggacgtaccgggcccggttacccgttttggacccgtttcgggtacccggggg

SEQ ID NO: 209341 - DNA, 653 bp, Homo sapiens
  misc_feature: GYAE6OF02IYBV9.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctggcaaggcttctggtattctacgtttacctcctatagtatcaacgtgggtgcgccgaggccgtctggaccaacgaccgtgagtggagtgggacgtgggaccgaaccctaacgaccgtggtcgtcacgtagtcgttacttccaccctactcccggtaccgggactacgtaaccttaccagtcgaccaaccggaaccttccctaccgaaactaaaccgactacgaccctaacgagtacgggtacggttggaaacgggctacccgtagacctaagtcgtacggtaaccgacgaccgggtccgttacttaacgttccgtgtcgacgggtacgaccgttcccgagggtaaccgtcccgggtagaccggtacccgttaagggcctacgggttcccgcgttttaccggcggtttacccggcggggg

SEQ ID NO: 209342 - DNA, 719 bp, Homo sapiens
  misc_feature: GYAE6OF02H0HGQ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctgggaggatcctctttcttggtggcagcagctacaagtcgcccactcccaggtgcagctggtgcagtcgtggggctggaggtagaagaacgtccgtggggcctcgaggtgaacggtctccgtgacgaaggtcttcgtggtacttcctaccgtttacctcttagtacgttactacgaacgttcgggtagccgaccgacggccgtccgtaggaaccgaaccggaccgtggaggtaggtagtggggtacgtcgggacccgtaacccgtaacgtacggtggtcgtaccacgttgtcggtaccttcccaacccgtacgttcccggtacccgggaactaaccggtaaccttacccagtacccgaaccgaacccgtaaccttacccgtaacctaaaacgtaaacccacctaacgtaccctactaggtacggttagttacggagacgtacctagacctacgtcgtacgaccgaccgcgtaccgttacttactacgtgacgtacgaggtaccgtcccgacggtaccgtccggtaacgccggtaacccgtacggccgtacgggtccggttaaccggttttcggtacccgttcgggtacccggggg

SEQ ID NO: 209343 - DNA, 636 bp, Homo sapiens
  misc_feature: GYAE6OF02F062M.17.25.C03.1.454.CMB.1.raw
  modified_base (263)..(263): a, c, t, g, unknown or other
  misc_feature (263)..(263): n is a, c, g, or t
  modified_base (284)..(284): a, c, t, g, unknown or other
  misc_feature (284)..(284): n is a, c, g, or t
  modified_base (349)..(349): a, c, t, g, unknown or other
  misc_feature (349)..(349): n is a, c, g, or t
  modified_base (448)..(448): a, c, t, g, unknown or other
  misc_feature (448)..(448): n is a, c, g, or t
  modified_base (462)..(462): a, c, t, g, unknown or other
  misc_feature (462)..(462): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagccgtggggcctcgagtgacggtctccgtgcaaggcttcgtggattcacgtttaccncttatagtatcaacgtgggtnacgccgaggccgcgtaggacaacgtaccctgtagtggagtgggagtcgggaccgaacccgtaacncgttgggtgtccaacgacgttgttcctttacaccccgtagtcccgtccggaacacgtaacttacccataccgaccaaccgaacctcctacaataaaccncaacgaccctaacncgtaggagttacggaggtacgaccctagaccatacgtacggacctaaccgccggtaccgttaccgttattaccgtggtacgacgtacgcgttacccgacgtccggtacggttacgacgtacccgtacggaccgtacggtaccggttcccttagtacccggttggtacccggggg

SEQ ID NO: 209344 - DNA, 834 bp, Homo sapiens
  misc_feature: GYAE6OF02FN706.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagagccgtgggcctcgagtgaaggtcctccgtgacgaggtcttgtaggtacttctaccgttttaccctcctagttaagtactacgaacgtggggtcgccgtccgacgggcccgtcgtacggaacctaaccggacccttggacgggttggaacgtggggacgtggggaacccgtaaaccccgttaacgacgttggggtactacgaacgtaggttcgttaccttacccgaaccctacgtcccgtacccggggaactaacggtaacctttaacccggagtaacccgtaaccgaaacccggttaaacccttcccccgtaaaaccgtaaacccttaaaaaaccgacccgtaaccgtaaccccgttaacgtaaaccgggtagggttaacggttaacggggaaaccggtccggttaacccgagtaaccgtacgttaccggtaacggaaccgtaaccgggtaccccgggttacctttaccgtttaaaggtttcccggttacggttaacggccgttaaaccggttaccgttaccccaaacgggttcccggtaaccgggtacggtacctaaccccgggtacggaccgggtccggttaccccggtccgtttttacgtaccccggtttaggggtaccggggg

SEQ ID NO: 209345 - DNA, 685 bp, Homo sapiens
  misc_feature: GYAE6OF02I7FH8.17.25.C03.1.454.CMB.1.raw
  modified_base (239)..(239): a, c, t, g, unknown or other
  misc_feature (239)..(239): n is a, c, g, or t
  modified_base (283)..(283): a, c, t, g, unknown or other
  misc_feature (283)..(283): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagcgtgggctcagtgaggtctctgcagcttcnggattcacgttacctctatagtatcagtgggtcgcgccaggccncgtaggacaacgtacctggacggtggacgtgggagttcgggacctaaaccgtacacgtgggtctacacgtacgtggtccttacacccgactccgtaccgggactaacgacctttacgatcgaacctacgtaactccctactaataaaccacgtaacgtaccctaaactacgtacggtaacgttggaaacgggtacgtaccgtacgtaccgtaacttcggtacggtaaccgaacccgggtaaccgggtcccgttaacctttacgtttaaccggtagtacccgggaggtaacccgtacggtaaccccaagggtaacccgttaccgggtacgaccgttacccgggtaaccggacggtaccggttcccggttacttttaccggtaccgtttacgggtacccggggg

SEQ ID NO: 209346 - DNA, 602 bp, Homo sapiens
  misc_feature: GYAE6OF02IAIBN.17.25.C03.1.454.CMB.1.raw
  modified_base (243)..(243): a, c, t, g, unknown or other
  misc_feature (243)..(243): n is a, c, g, or t
  modified_base (270)..(270): a, c, t, g, unknown or other
  misc_feature (270)..(270): n is a, c, g, or t
  modified_base (334)..(334): a, c, t, g, unknown or other
  misc_feature (334)..(334): n is a, c, g, or t
  modified_base (501)..(501): a, c, t, g, unknown or other
  misc_feature (501)..(501): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagctggggctcagtgaaggtctcctgcaaggcttcgnggtattcacgtttacctcctatagtancaacgtgggtcacgcacggccgctggaccaacgctggatggatgggatgggaccgaaacctaancgtggtcgtaccaagtacggtcgtccttacaccctaatcccgtacgggactagacttacccgatcgaccacgactcctacaataaacactacgcctaacagtcggaagttggaacggtagaccgtgaccagttacacggaacgactccgggccgttactaattacgnggtacgacgaggacgttcccgaacggtaacgtccgggtagacgtacccgtaggacccggtaggtacccggttccggtttactaccgttcggtacccggggg

SEQ ID NO: 209347 - DNA, 715 bp, Homo sapiens
  misc_feature: GYAE6OF02F3SER.17.25.C03.1.454.CMB.1.raw
  modified_base (601)..(601): a, c, t, g, unknown or other
  misc_feature (601)..(601): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaaggagccgtggggcctgagtgaaggtcctcctgtcaaggtcttcgtggtattccacgtttacctcctagtatactctaactgggtagccgccagggcccgtacgttcgggaccaaaccggtcccttaggaacggttgggtaagtcgggggtagtcggggacccggtaaaccctaacgacccggttgggttcgtaccgaacgaacgtttcggttaccttccgtaaccccgtacgttccccggtaccgggactaacggtaaccctttaacgactcggaacctaaccgtaaaccctccgtacctaaactaaaccgaacaccgtacctaacgacgttgggtaacgttaggacggtacgtccgaagtacctagtacctaggaacccgacgtaccggtaccttntaacgtttctacggttgacgtacgacgtacccgtggtaacccgttcggtacgaccgtccggtaaccggcgtacgggccctttaccggtttaccgtcggttccgggtacccgggg

SEQ ID NO: 209348 - DNA, 573 bp, Homo sapiens
  misc_feature: GYAE6OF02JD10M.17.25.C03.1.454.CMB.1.raw
  modified_base (244)..(244): a, c, t, g, unknown or other
  misc_feature (244)..(244): n is a, c, g, or t
  modified_base (347)..(347): a, c, t, g, unknown or other
  misc_feature (347)..(347): n is a, c, g, or t
  modified_base (470)..(470): a, c, t, g, unknown or other
  misc_feature (470)..(470): n is a, c, g, or t
  modified_base (479)..(479): a, c, t, g, unknown or other
  misc_feature (479)..(479): n is a, c, g, or t
  modified_base (540)..(540): a, c, t, g, unknown or other
  misc_feature (540)..(540): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtacagagtcaccattcacttgccggacaagtcacggtcgttaaaacctntttaaagtggtatcagcagaaaacctggaaaacgccccagtacctctgactctactggtgactattcccattccgagccggaagttcggcgtcccaatccggngtttcagtggctaggtggactcgtaggacagtatttccaaatcctcactatccaactctctcggactaacctgaggtactttgcgactattactactactggtacaacgagttacgttaaccncgttacccnggtacttacgtttcggacctaggggtaaccaaggttgaagtacgtacaaaacggctttcgnggaacttggacctaccctaaggtcctcggttcc

SEQ ID NO: 209349 - DNA, 724 bp, Homo sapiens
  misc_feature: GYAE6OF02IKU02.17.25.C03.1.454.CMB.1.raw
  modified_base (163)..(163): a, c, t, g, unknown or other
  misc_feature (163)..(163): n is a, c, g, or t
  modified_base (198)..(198): a, c, t, g, unknown or other
  misc_feature (198)..(198): n is a, c, g, or t
  modified_base (301)..(301): a, c, t, g, unknown or other
  misc_feature (301)..(301): n is a, c, g, or t
  modified_base (312)..(312): a, c, t, g, unknown or other
  misc_feature (312)..(312): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactccttcttcttggtggcagcagctacaagtncccactcccaggtgcagctggtgcagtcgtgggcngagggtgaacgagtcccgtggggccctacgaggtaggtaacggttcctccgtaggaccaagggtcctttcgtggtacttctacgtttacctccttaactagtntacagtgggtnccgccaggccggtcgtacggaaccaacgtaccgtgtaacggtggacggtagggggataccggggtaaccgtaaacccctaaaccggacgttcggttaccggtcaccgttacgttcgtacccgtttacacccgtaccgttaccgtaccgggaacctacgtaacctttaccgactacgaacccaaccggtactacccttaccaaactaaacgaccacgtcctaatacggttgaaggttcggacgacgtaccgtacgctaacgtcgtaacgtaccggaacccggtcgtaccgttcgttaacgtttacgtcggtaacggtcaaccgggtccaaccggtacggtaaccgtcgggtacgacgtacccggtagggtccgcggtaccgggttcctttacgggacggttccggtacggggg

SEQ ID NO: 209350 - DNA, 703 bp, Homo sapiens
  misc_feature: GYAE6OF02IDEZX.17.25.C03.1.454.CMB.1.raw
  modified_base (456)..(456): a, c, t, g, unknown or other
  misc_feature (456)..(456): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttctggtggcagcagctacaagtcgacccactcccaggtgccagcctggtcgcagtcgtggggctggaggtgaagagtccgtgggcctcgagtggtaaggtctccgtgacgaacggtcttccgtggactttcgtaccggttttacccacgttaacgtagttactaccgtaacgttggggtaccgccggtacccgaacgggtcccgtcgtaacgggaacccgtaaccggtaccgttggacggtagggtaacggtcggggtaagttccggggaacccgtaaacccgtacgtaggtcggtcgacacggtgttcgtccttaccnccctagtcccggtacgaactcgtaccgtcacgtacgaacctacggtaccttaccgacctaaacaaccgactacgaccctagtacgtacgtaggttacgacggacgtccgtagactactacgtacggacgtaccgacggtcccttattaccgttagtcgcgtacgacgtaccgtcccggtaacgtcggtaccgtggtaccggaccttcgggaactcgggtaccttcgtaccgtcgttcggacccgggg

SEQ ID NO: 209351 - DNA, 670 bp, Homo sapiens
  misc_feature: GYAE6OF02IEMTF.17.25.C03.1.454.CMB.1.raw
  modified_base (247)..(247): a, c, t, g, unknown or other
  misc_feature (247)..(247): n is a, c, g, or t
  modified_base (355)..(355): a, c, t, g, unknown or other
  misc_feature (355)..(355): n is a, c, g, or t
  modified_base (395)..(395): a, c, t, g, unknown or other
  misc_feature (395)..(395): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtgcccactcccaggtgcagctggtgcagtctggggctgaggtgaagagccgtggggcctcagtgaaggtctccgtgcaaggcttcgnggattcgacgtttacctcctagtagtactacaactggggtcgcgccgaggtccgcgtaggaccaaacgacctgagtggaacttggggatcggggacctaacccctaanacgtggttcgacctagtacggtgttaccttcgaaaccccncgtacccggtcggaacgtaacgtaaccttaaccagtacaccgaacgtaactccctacgaaataaaccgactacgacctaactagtggtaattcggagacggtcctgacgactctaggacggaacctacgggtacccgttactaagttcgacggttacgacgttaaccgacgttcccgaacggtccgtaaccggggtgtaacccggtacccgttaggggacccgacggttcccggggttacccttttacgggtacccgttttccgggaccgggggg

SEQ ID NO: 209352 - DNA, 782 bp, Homo sapiens
  misc_feature: GYAE6OF02JMEP2.17.25.C03.1.454.CMB.1.raw
  modified_base (246)..(246): a, c, t, g, unknown or other
  misc_feature (246)..(246): n is a, c, g, or t
  modified_base (281)..(281): a, c, t, g, unknown or other
  misc_feature (281)..(281): n is a, c, g, or t
tcagcgtagactagcacgaccggtgctcgatttagtagtgtagatttgggtttggggtacgtcaacaaccacatctgtcctctagagaaaaccctagtgagcacagctcctcaccatggactggacctggaggatcctcttcttggtggcagcagctacaagtgcccactcccaggtgcagctggtgcagtctggggctgaggtgaagaagccgtggggcctcgagtgaggtctctgcaggcttcnggattcacgtttacctctatagtatcaactgggtncgccaggccgctggcaacgaccttgacgtggacgtggggagtcggggaccgaaacccgtaagaccgtcggtgtaccacgtaacggtcgtctttaccgaacccctattcccgtcccggggaactacggtaccttacccgacttacgaaccccgtaacgaacctttcccctaaccgtaacttaaaacccaaccgaacggtaccctaacgtaacgttacggggaacggttttaggaaccggggttaaaccgcccggttacggtaaaccctaacgttacccgtttacgggaaaccccgggaacccgtaacccgggggtaccccgttaacccgttttaaacgttttaaccggttacggtttaccgggtacggtaaccgggtaccgttaccccggaaccggtaaccggttacccgggtttcgaaccggtccccggtaaacgggtccccggtaccggtaccggggtttccccttttacggggtaccgttcccgggtttaaccgggggg

SEQ ID NO: 209353 - DNA, 701 bp, Homo sapiens
  misc_feature: GYAE6OF02GIV0L.17.25.C03.1.454.CMB.1.raw
  modified_base (185)..(185): a, c, t, g, unknown or other
  misc_feature (185)..(185): n is a, c, g, or t
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtncagtcgtggggctgaggtgaagaagcctggggcctcaggtgaaaggtctcctgaccaagggtcttctggattcgtactttaacctcctatagtatcaacgtgggtncgccaggccngtgacaacgctgagtggagtggcgtgggaccgaaacctaacacgtggtcgtacacgtagttcgttacctaccgtacccagttaccccggtaccggggtaacaacgtaaccttaacccgtagtaacccaaccgtaaacccgtaaacctacccgtttaaccaaagtaaaaccctacgaaccgtaccctaaacgtaacgttacgggtaacggttgggaaacgggtacgtaccccgtagaaccgtacgtaacgtacgaccggtaaccggacccggtacccgttactttaaacgttacgtacggtcgtacgaacggtcctaccgacggtaaccgtccgggtaacacggtaccgtacgggacgtccggtccggttaccgtttacgtaccggttacggtcccggggg

SEQ ID NO: 209354 - DNA, 756 bp, Homo sapiens
  misc_feature: GYAE6OF02JEV7H.17.25.C03.1.454.CMB.1.raw
  modified_base (192)..(192): a, c, t, g, unknown or other
  misc_feature (192)..(192): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtcgngggctaggaggtgaagaagccgtggggcctcaggtgaaggtctccgtgcgaaggtcttgtggtattcctaccgtttacctcctaataacgtataccaacgtgggtcgccgccgacgggcccgtacgtacgggtaaccaaaccggtcctgggtagtcgggaacggtcggggtacgtacggggaccctaaacccgtaacgtagttacgggtcgtacacggtagttccggttccttaaccgacccgacgtcccgtccgggaactaacggttaaccctaacgtaacgtcgaaaccccgtaacgtaaccccgtccctaaaccgtaaactaaaacctaccgcgtaacccgtaataaccggttggtaaacggttcgtaacggtacgcccttaaggacctaacgttcgagaaccgtacggtccgacccgtttagtacgttacgtacgtcggacctaacgggtaccgttcccaagggtcccggtttaacgggcgtaaacccggtcccggtacggttccccgggaaggtttcccgggtaaccccttttgggacccgtttacggggtacccgggg

SEQ ID NO: 209355 - DNA, 683 bp, Homo sapiens
  misc_feature: GYAE6OF02H0NAO.17.25.C03.1.454.CMB.1.raw
  modified_base (247)..(247): a, c, t, g, unknown or other
  misc_feature (247)..(247): n is a, c, g, or t
  modified_base (358)..(358): a, c, t, g, unknown or other
  misc_feature (358)..(358): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcgagtgaaggtctcctgcaaggcttcgnggattctaccgtttacctcctatagtatcaacgtgggtgcgccgaggcccgcgtcgggaactaacggaccgtggaggtgggagtggggagtcggggaccgaacccgtaacncgtggtcgtcgacgtagttcgtccttccaaccctacgtcccgtaccggactacgaaccttaccagttacgaaccaaccgtaacccttcccctaacctaaactaaaaccaccgtaacgacccttaacgtagttacgggtagtttaagggaaggtacgtccgtagacctacgttccgtacggaaccgaccgaccgggtacccgttacttaacgtttacgcggtacgaccggtaagtacccggtcccaacgggtaaccgttccgggaagaccggtacccggtacggacgacgggtcccggttaccttttcggaccgtttcgtaacggg

SEQ ID NO: 209356 - DNA, 821 bp, Homo sapiens
  misc_feature: GYAE6OF02GDFYS.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaaggcttctggattcacgtttacctcctatagtatcaactgggtgcgccgtaggccgcgtcggaaccaacgacctaggaggtggaagtggggagttcggggaccgaaaccccgtaacgacgtgggtacgtcacgtagtcgttaccgtttccaccccgtacttacccgtaccgggaacctaacggtaaccctttaccctaacgttaccggaaccccgtaaccgaaaccccgtttcccctaacccgtaaaacttaaaaccccgaaccgttaaaccggtacccccttaaacggacgtttaacggggtaacgggttttacgggaaacggggtaccggtacccgttaacgggtaacccgtagtttacccggtaacgggtaacccggaacccggtaaccccgggggttccctttaccgtttaacctttaacccggtcggttaccgggtacggtaaccggtacccggtttaccccgaaaccgggtaccggttaccccggggtaggtaaacccggtccccgttaacggggtacccgtacgggtacccccgggttacgtttttaccgggtaccgtttccggggttaacccgggggg

SEQ ID NO: 209357 - DNA, 621 bp, Homo sapiens
  misc_feature: GYAE6OF02JO426.17.25.C03.1.454.CMB.1.raw
  modified_base (203)..(203): a, c, t, g, unknown or other
  misc_feature (203)..(203): n is a, c, g, or t
  modified_base (352)..(352): a, c, t, g, unknown or other
  misc_feature (352)..(352): n is a, c, g, or t
  modified_base (546)..(546): a, c, t, g, unknown or other
  misc_feature (546)..(546): n is a, c, g, or t
tcagcgtagactagcacgaccggtgctcgatttagtagtgtagatttgggtttggggtacgtcaacaaccacatctgtcctctagagaaaaccctacgtgagcacagctcctcaccatggactggacctggaggatcctcttcttggtggcagcagctacaagtgcccactcccaggtgcagctggtgcagtcgtggggctgnggtgaagagcgtggggcctcgagtgaaggtctctcgcgaaggcttctggtacttcgtacgttttacccttcctaattagttatcaacgtggggttcgcgaccgacggccgcgtggaccgtaacgtacccttggacggtggagtaggggngtcggggaccgaaccctaacgtacgtgggtcgttacactaggttgttacgttccacccacgtcccgtaccgggaccacggtacctacacgtacgacctaccgaactcctacccaataaaccgacacgcctaactagtggtaggttgaacggtgtccagtcactctcgacacgttcgccctattacttacgtggngacggactccggtacacccggtgtccggtgaaccgtccgaaggtcacgggtccgtacgtttcgcgttcggacggg

SEQ ID NO: 209358 - DNA, 658 bp, Homo sapiens
  misc_feature: GYAE6OF02JZHCX.17.25.C03.1.454.CMB.1.raw
  modified_base (141)..(141): a, c, t, g, unknown or other
  misc_feature (141)..(141): n is a, c, g, or t
  modified_base (225)..(225): a, c, t, g, unknown or other
  misc_feature (225)..(225): n is a, c, g, or t
  modified_base (294)..(294): a, c, t, g, unknown or other
  misc_feature (294)..(294): n is a, c, g, or t
  modified_base (644)..(644): a, c, t, g, unknown or other
  misc_feature (644)..(644): n is a, c, g, or t
tcagcgtagactagcacgaccggtgctcgatttagtagtgtagatttgggtttggggacgtcaacaaccacatctgtcctctagagaaaaccctagtgagcacagctcctcaccatggactggacctggaggatcctcttnttggtggcagcagctacaagtgcccactcccaggtgcagctggtgcagtctggggctggaggtgaagaagccgtgggcctcagngaaggtctcctgacaaggtcttctggattcacgtttacctcctatagtatcaacgtagggtcgcggccncggccgcgtaggaccgaacgaccgtgagtggagtgggagtgggccgtaacctaacacgtaggtgtacacaggtgtcttacgacccgtactccgtacggtaagaccggaactttacccgaagtacgtaaccgaaccgtaacttaccccgtactaaacttaaacccgaacggtaacctacccgtaacctaagggtcgtaaggggttacgaacgggtacggaccgtagtaacgtaaccgttgtaaccggtacgaccgaccggtacgttcgtaacttacgtcgtaaggtccgaagtaccgtaccgtacggacgttcgggacgtacgaggtaccgacggtcggacgttccgtttntccgttggtacggg

SEQ ID NO: 209359 - DNA, 677 bp, Homo sapiens
  misc_feature: GYAE6OF02GF6MD.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagcgtgggcctcagtgaagtctcctgcaggcttctggattctacgtttacctctatagtatcaacgtgggtcgccgccgacggccgcgtcggacaacgtaccgtgacggtggattgggagtgggaaccgaaccctaagcgttgggtctactacgaggttcgtcttccgaccctacgtcccgtccgggactacgtaaccttaaccacgtcgaccgtaaccgaaccttaccctaacgaactaaaaccacgtaccgacctaacagtaggtaggttcgaacggtacgtcctacgaactactccgttacggaaccgtacggtacccggttacccgttaccttaacgtttacctaggttcgaaccggacggttaccgtacccggtacggttaccgtccgggtaacggtacgtacccgtaacgggtccgttaacgggcccgttttcccggttacggttacccgttccgggtaaccgggg

SEQ ID NO: 209360 - DNA, 700 bp, Homo sapiens
  misc_feature: GYAE6OF02I9UPH.17.25.C03.1.454.CMB.1.raw
  modified_base (202)..(202): a, c, t, g, unknown or other
  misc_feature (202)..(202): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctcgtggtgggggtcagngtcaccatcacttgccgacaagtcacggtacgttaaaactatttaaagtggtatcagactaagtaaaccgtaggaaaccgccccaagtaccctcgtagtacttctcgtcggtcgacctactcccacgtcgtaggaccggtaaggttccggcccgtaccctaggtaccggtagttacgagggtcggacgtacggtaggtacgtacggtacggaatacggtttactttacctaaacttcctaaccgtaacctaccgtaacctacccttaccgttcccgtacgaacccttaggtacgggtaagttacttaggtaacgtactttaaaccttccgttaaaccgttccgttaacgaccgtaaagtaacgttaccgttaacgttcccccgttacctacgttaccgtttacgttaccggaccggtaaacggttacgtagttgaacggtacctaaaccggaacgtgtaccggtagtccggtactacctacttactccgttattaccg

SEQ ID NO: 209361 - DNA, 859 bp, Homo sapiens
  misc_feature: GYAE6OF02JZXWM.17.25.C03.1.454.CMB.1.raw
  modified_base (147)..(147): a, c, t, g, unknown or other
  misc_feature (147)..(147): n is a, c, g, or t
  modified_base (318)..(318): a, c, t, g, unknown or other
  misc_feature (318)..(318): n is a, c, g, or t
tcagcgtagactagcacgaccggtgctcgatttagtagtgtagatttgggtttggggactcaacaaccacatctgtcctctagagaaaccctgtgagcacagctcctcaccatggactggacctggaggctcctcttctggtggacngcagactacaagtcgcccgactccgaggtgcagctaggtgccaggttcgtggggctacggtagggtagaaggtacgcccgttcgggggtcccttagagggtaggaacggttccgtcccgtacggtacgtaacgggtcctttacgtacgggtactttaccaaccgttttccncgtatacggttacgtcctaaacggttgggacgtccggccgtaaggtcccgtacgtagaacccgtaacggtactcggtaggttaggtaacggtcgggtaacggtcggggtaaccctaaccccttaaggtaccgttagggtaccttaccggacgttaacgggtccttaccgttacccgaacccccgttacggtacccgttacccggggaacttacccggttaacctaccgacgttaaccgaccggtaacccgttaccgtacccctaaacgttaaaccgaaaccgccggtaaaccctaccgtaaccgttaggtaccgggttacgtacggggtaaaccggtaccgcgttaaacccgacgtaaccgtcgttaacccgggaaccttacggtaccggttaccgtactttaaccgggttcagggttcaaccgggtaccgtaccggtaccgttaccgtccggttacggacctaacccggcccgttaacgggaccggttaaccgggtccccgttttaaccgtcgggttaacccccgggtgtaacccggggg

SEQ ID NO: 209362 - DNA, 752 bp, Homo sapiens
  misc_feature: GYAE6OF02IFX6T.17.25.C03.1.454.CMB.1.raw
  modified_base (226)..(226): a, c, t, g, unknown or other
  misc_feature (226)..(226): n is a, c, g, or t
  modified_base (235)..(235): a, c, t, g, unknown or other
  misc_feature (235)..(235): n is a, c, g, or t
  modified_base (237)..(237): a, c, t, g, unknown or other
  misc_feature (237)..(237): n is a, c, g, or t
  modified_base (247)..(247): a, c, t, g, unknown or other
  misc_feature (247)..(247): n is a, c, g, or t
  modified_base (278)..(278): a, c, t, g, unknown or other
  misc_feature (278)..(278): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctgggaggatcctcttcttggtggcagcagctaacaagtcgcccactcccgaggtgcaggctggtgcagtccgtggggctggaggtgaagagcgtgggcctnagtgagtcncngcaggcttgngatcacgttactctatagtatcaagtgggtncgcgacggccgtgtacggaaccaacggcctaggacggtggagtggggagtacgggacctaaaccctaacgtagtcgggtagtaccgaacgtggttacgtcttccaacccgagttacccggttaccgggaacctaacggtaacctttacccgaacgttaaccgaacccgtaaaccgtaaacctaccccgtaaacccgtaaacgtaaaacccaaccgtaaccggtaaccccttaacggaatttacggggtaaacggtttacgggaaagggaacccgttcccgtaaggtacctaaaccgttcggtacgaaaccggtacccgaccggtaccgtttacctaacgtttctaggaccgacggtaacgtacccgtacccctaggaccggtttaaccggaccgggtaacgtaccccggtaccggcggaaccggttcccggggttacccttttacggtacccgggttacgggttaacccggggg

SEQ ID NO: 209363 - DNA, 663 bp, Homo sapiens
  misc_feature: GYAE6OF02G7H0P.17.25.C03.1.454.CMB.1.raw
  modified_base (527)..(527): a, c, t, g, unknown or other
  misc_feature (527)..(527): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcgagtgaaggtctcctgcaaggcttctggattctacgtttacctcctatagtatcaacgtggtgcgccaggccgctggacaacgacctggagtggagtgggagtgggaccgaaccctaacgaccgttggtcgtcaacgagtcgttccgttaccacccacttcccgtaccggggactaacgtaccttaccatcgaccacgaacctcctaccaataaaccacacgacctacgagtggtagttacggagggactccgagacctatcgtacggaaccgaccgtaccgggtacccgttacttaacgtttacgnggttaccggaccggtaaggtacccgacccgtaaccgggtacgttacccgggtaggacccggtacccgttacccgggacgttaccggggtacccggtttcccgttttaacggtaccgtttcccgggtaaccgggggg

SEQ ID NO: 209364 - DNA, 754 bp, Homo sapiens
  misc_feature: GYAE6OF02J1Q34.17.25.C03.1.454.CMB.1.raw
  modified_base (184)..(184): a, c, t, g, unknown or other
  misc_feature (184)..(184): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtncagtcgtgggctgaggtgaagacgcctggggcctcgagtgaaggtcctccgtgacgaaggtcttcgtggtacttcacgtttacctcctagtagtactactacgtgggtcgccggtcccgacggcccgtcgtcggaacctaacgacctggtaggtggagtggggagtggggaacccgtaaaccctaacgacggttggtcgtacgtacgagggttcttaccgttcccaacccgtacgttcccggtacccgggaactaacggtacccttaaccgagttacgaaccccgaacggtaaccccttccctaaccctaaactaaacaccgacggtacccttaaggagttacggtaaggttacggaacgggtactcccgtagaacctacgttacgtaacggaaccggtaccgtaaccgggttcccgttaacgttaaccgtttaccggttggtaaccggaccgggtaacgtacccggttcccgaacgggttccgttcccgggtaaacgtccggtaaccccgtagggacccgtacggtaccccgggttaccgtttttcggacccgtttcgggtacccgggg

SEQ ID NO: 209365 - DNA, 862 bp, Homo sapiens
  misc_feature: GYAE6OF02FYUP9.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacgaagtgcccactcccaggtgcagctggtgcagtcgtgggctgaggtgaagaagccgtgggcctcagtgaaggtcctccgtgacaagggtcttcgtaggtactttaccgtaccggttttacccctaccgttaagtaagtaacttacgtaaacctggggtcgtcgtacccgtagggcccgtccgtagggaaccaaaccggaaccgttaggaggtcggtaagtcgggggtaacgtcgggggaaccctaaacccgtaacgtaccgttaggtacggtaccaacgtacggttacgttaccgttacccaaccccgtacgttaccccggtaccggggtaaacgtaaccgttaaacccgttaaccgtaaccgtacccgtaaccccgtaaacccgtaaaaccccttcccttaaacccctaaaacgttaaaaaaccgaaccccgtaaaccggaccccgtttaaaccgtaacggttaacgggttaggtttaaacggaacgggtaaccggtaccgtaacgggaaacccttaggtaacccgtaacggaaacccggtaccgtaaccgggtaacccgttaaccgtttaacgttaacctggtaaccgacgggttaacgaccggtaacccggtaaccgtccggtaccgggttacgacccggtaccgttacgggacccgttacggttcccgtttaaccgtttccggtacgttcccgggtaacggg

SEQ ID NO: 209366 - DNA, 769 bp, Homo sapiens
  misc_feature: GYAE6OF02IYLGF.17.25.C03.1.454.CMB.1.raw
  modified_base (245)..(245): a, c, t, g, unknown or other
  misc_feature (245)..(245): n is a, c, g, or t
  modified_base (253)..(253): a, c, t, g, unknown or other
  misc_feature (253)..(253): n is a, c, g, or t
  modified_base (327)..(327): a, c, t, g, unknown or other
  misc_feature (327)..(327): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctcggtgcagtcgtgggctgaggtgaagaagcctggggcctcgagtgaaggtctcctgcaaggtctntggattcncgttttacctcctattagtactcaacgtgggttggccgccaggggcccgtcgtaggactaaccggaccttaggnggtacgggatcggggatggggaccgaaccctaacgtacgttacgggtgttaccaacgtacgttacggtctttaccgaaccccgtaatccccggttaccgggaacctacggtaaaccctttaccgtaacttacgggaacccctaaaccggtaaaccttccccgtttaaacccaaaacgtaaacccgtaaaccgaacggttacccctaaaccgtaaagtacggggttaaaccggtttaggaacgggtaacgttcccgtaagggtactaacgttacccgtgaaaccggtacccgtaaaccggggtccgtaacgtttaaccgtttacgtacggtagaccggtagtaccgtaccccgaccggttaacggtcccggttacgaccggttacccgtagggcctaccggttccgggttaaccctttcgggtaccgttttggaccccggggg

SEQ ID NO: 209367 - DNA, 710 bp, Homo sapiens
  misc_feature: GYAE6OF02FWLZR.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaaggcttctggattcacgtttacctcctatagtatcaacgtgggtgcgccaggccgctcggacaacgacctgagtggagtgggatggggaccgaaccctaacgacgttggtcgtacaacgtgttacggttcctttaccgacccctacgttcccgtacccggggaactacgtacccttaccagttaccggacccaacggaaccctccctaccgaaacttaaaaccacctaacgacccttaacgacgttacgggtaagttacggaaggtacgcccgttagaacctaagttcccgttacggaacccgtaacccggaccgggttaccccgttaacctttaacgtttaaccgtacggtttacgaccggttaacgtcccggttacccgaacggtaaccgttacccggggtacgtaaccggtcccgttaaccggcggtaccggtccggttacccgttttcgacccggtttcggtacccggggg

SEQ ID NO: 209368 - DNA, 709 bp, Homo sapiens
  misc_feature: GYAE6OF02H0D8Q.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagagccgtgggcctcagtgaggtctccgtgcgaggtcttcgtggtacttcgtaccgtttacctcctagtagtactacctaacgttgggtacgcgtccgacggccgtcgtacggaaccgaaccgaccgtggaggtggaacgtggggtagtcggggaccgtaaaccccgtaacgtacgttcgggttcgtaccgtaacgtaggtttcgttaccttaccgtaccctacgtcccgtaccgggaacctaaacggtaaaccttaccaacgtaccggaaccctaaccgtaacccttccctaaccaaactaaaccgaccgaccgtacctacgtagtacgggtagttacgggaggtaccgcgttacgactacgtctacggaccggaccgtaccggtccgttacttacgttctacggtagacggacgtcgtcccgaacggtcgttccggtacggacgtacccggtacggcgtaccgggtccgttaccggtttacggtcgtttaccgggtaccgggg

SEQ ID NO: 209369 - DNA, 717 bp, Homo sapiens
  misc_feature: GYAE6OF02IC5MD.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtctcctgcgaaggtcttcgtggatttccgtaccgtttacctccttatagtactctaacgttgggtacgtccgaccgacggtccgtccgtaggaacctaaccggtacccgtggacgttagggaggtggggaggttccggggaacccgtaaacccctaacgtacggttgggtcggtaccacgttacgtggttaccctttccaaccctacgttcccggtaccgggaactacggtaacccttacccgagttacccgtaacccgtaaccgtaaccgttacccctacctaaaccgtaaacctaacgaccgtacctatacgtacggtagttagcggtacgcctgactacgtacgtacggacctaccggccggtccttacgttacgttacgtggtacggacgacgtacccgtacccgagtaccggttcggtccgacggtaccccggtagccgacgggcccgtttccgtttacgtacccgttcgggtacccgggg

SEQ ID NO: 209370 - DNA, 662 bp, Homo sapiens
  misc_feature: GYAE6OF02IITR4.17.25.C03.1.454.CMB.1.raw
  modified_base (219)..(219): a, c, t, g, unknown or other
  misc_feature (219)..(219): n is a, c, g, or t
  modified_base (272)..(272): a, c, t, g, unknown or other
  misc_feature (272)..(272): n is a, c, g, or t
  modified_base (285)..(285): a, c, t, g, unknown or other
  misc_feature (285)..(285): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtgggcctnagtgaaggtctcctgacaaggcttcgtggacttcacgtttacctctatagtancctaagtgggtancgtccacggccgcgtacggaacaacggtaccctaggaggtcggagtggggatcggggaaccgaaaccccgtaacgtaacgtcgggtgtaccaacggtacgttcggttccttacctacccagtcccgttcgggaactacggtaacctaccgatcgaacccacgtaaccttcccaacgtaaactaaaccgactaacgccttaacgaagttacgggattcgggaacgacgtccctagtacacgttactacggaaccgacctacggtaccgttacttaacgttacgttacgcgacgtaagcccgttaccgacgtaccgttccggacggtaccgtcggtaaccgcggacggtccggtcccgtttagtccgttcgtacggggg

SEQ ID NO: 209371 - DNA, 650 bp, Homo sapiens
  misc_feature: GYAE6OF02IZFGV.17.25.C03.1.454.CMB.1.raw
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
  modified_base (316)..(316): a, c, t, g, unknown or other
  misc_feature (316)..(316): n is a, c, g, or t
  modified_base (318)..(318): a, c, t, g, unknown or other
  misc_feature (318)..(318): n is a, c, g, or t
  modified_base (340)..(340): a, c, t, g, unknown or other
  misc_feature (340)..(340): n is a, c, g, or t
  modified_base (370)..(370): a, c, t, g, unknown or other
  misc_feature (370)..(370): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagccgtggggcctcagtgaggtctcctgccaaggtcttcgtggtacttcgacgtttacctcctatagtactcaagtgggtncgcaggccgntggacacgacctggagtggngngggtagtcggacgtaaccctanacggtgtgtcacgtgtagtccttccgaccncgtccgtccggaacacgtaccttaccagtcaaccgtacgacctccaactaagtaaaccaccacgtacctacgtagtcggtaggttagaacgggtacaccgtcgtaactgtacctacggaaccgaccggtaaccgggtaccgttacttagttacccgtaggtaccggtacgaacgtaccgttaccccgaggttacccggtcggggtacgaaccggttcccgtaccgggaccgttacggtccggtttacccgtttacggttcccgtacggggttacccgggg

SEQ ID NO: 209372 - DNA, 781 bp, Homo sapiens
  misc_feature: GYAE6OF02F0PHU.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagcgtggtgcagtcgtgggctgaggtagaagaagccgtgggcctcaggtagaacggtcctccgtgcgaacggtcttcgtggtactttaccgtaaccgtttacccttacctattagtacttacaacgttgggtacgccgtccgagggccctccggtggaaccgaaaccgtaccgtaggtaggtaggacgtacgggagtacgggaccgtaaccccgtaacgtacgtcggtatccgacgtagtcgttcctccaacccgtactcccgtaccggggaactaccggtaccttaaccgtacgtaccggtaccccgtaaccgtaaacccttcccgtaaacccgtaaactaaaaccgtaacccgaacgtaccccgtaaacgtaacggtacggttacgggttaacggttaacgggagttacccccggtagtaacccgttagttacccgttaaccggaaccgggaacccgtaccgggttaccgttaccgttacgttaaccgttcggtacgtaccgacgtaccgaccctaggtaaccggtcggtacggtaccgtaccggtaccgtaccggtacggtccggtttaccgtttaccggttaccgtacgggttaccgggg

SEQ ID NO: 209373 - DNA, 649 bp, Homo sapiens
  misc_feature: GYAE6OF02IL50S.17.25.C03.1.454.CMB.1.raw
  modified_base (276)..(276): a, c, t, g, unknown or other
  misc_feature (276)..(276): n is a, c, g, or t
  modified_base (594)..(594): a, c, t, g, unknown or other
  misc_feature (594)..(594): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaggtctcctgcaagctctggattctactttacctctatagtatcaacgtggtncgccgaggccgcgtaggacaacgacctgagtggatgggagtcgggaccgaaccctaacacgttggtgtccaacgtaggttcgttccgtttaccaacccctacgttcccgtaccgggaacctaacggtaaccctttaaccgacgttaccgaacccgaaccgtaaacccgtccctaaccctaaactaaacccaacgtacgaccctaacgacgtacggtaggttacggagggactaccgttagaccatcgtagaacccggacaccgggtccttactacgttacgtgtacgacgtacgcgtcccgaacgtgtacccgggtanaccgacccgtacggccgacggtcccggttacctttacggtaccttggtaccgggg

SEQ ID NO: 209374 - DNA, 806 bp, Homo sapiens
  misc_feature: GYAE6OF02HRD4Q.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctgaggtgaagagccgtgggcctcagtgaaggtcctcgtgcaaggtcttcgtggtactttcgtaaccgttttacctaccttaagttagtactaccaacgttggggtacgacggccgagggcccgtacgtacgggaaccaaccggtaccgttaggtaaggtgggaacgtggggaacgtcggggaaccgtaaaaccccgtaacgtacggttagggtacgtaccgtacgtaacggttcgttaccgtttaccgaaccccgtaacgttccccggtaaccggggtaaactacgttaaaccctttacccgaagtacccgtaaacccgtaacggtaaacccctttacccgtaaaccctaaacgtaaaaaacccaccgtaacggtaacccttaacgtaacggtacggggttaacgttacgggaacgggtaaccggtaccgttaacgaccgtaacggttcgtaaccgggaaaccggtaacccggtaccggtaacccgttacgttaaaccgtttacggttcggtaaccgtacgggaccgttaccggtcccgaacggtcggtaccggtagaccgtaccgtcggacgacggtccgttaccgtttagaccgttcggtaccgggg

SEQ ID NO: 209375 - DNA, 705 bp, Homo sapiens
  misc_feature: GYAE6OF02IY1Z5.17.25.C03.1.454.CMB.1.raw
tcagcgtagactagcacgaccggtgctcgatttagtagtgtagatttgggtttgggggggagtcagtctcagtcaggacacagcatggacatgagggtccccgctcagctcctggggctcctgctactctggctcgagctgccagatgtgacatccagatgacccagtctccatcctccttgtctgcctcgtggtcgggggtcagagtcaccatcacttcgccggaacaacgtcgacggtaaccgttaaaacctatttaaattggtactcagcaaggaaaccgtaggaaaccgccccagaccctcgtagacttctcgtgggtcactactccactcgtacggacgtaacggtcggcccgttacctagtacggtacgggttacaggtacggtacgaggttcggtaacgttcggtacgggaacgtaagttaactttaccaacttccgtaccaccgtaactacccaactaccgtcgtacgaaccctacgtaggtaaggttacgttcgtataacctaacgttaccttaacgttaccgtactaccgaaacttaacggttacgtttaacctacccgtttccccttacgttaccgtttaccggtttacgggaacccggtaacggggtaacccttaaggtttcgaacgttaccgttaaaccgaaacgtaacgttggtacggtacgacgtaccttacgtaccgttcgtacgttcc

SEQ ID NO: 209376 - DNA, 616 bp, Homo sapiens
  misc_feature: GYAE6OF02H5455.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcagtgaggtctcctgcaaggcttcgtggattcacgttttacctcctatagtactcaacttgggtgcgccgaggccgcgtacggacaaccgcctggacgtggagtggggagtcgggaccgaaaccctaacgacgtggtgtacactagttcgtccttccacccctatcccgtaccgggactacggtacccttaccgatcgaacccaacgacctaccctaccaaactaaaccaacacgaccctaacgattacgggaggtttgaagggtacgcctagactactcgtagaccgccgacggtcccttacttagttactggcgacgacgacgtcccgacgtctcccgggtgaccgttcccgaccggcgacggccgttccgtttcgtacccgttggtcccgggg

SEQ ID NO: 209377 - DNA, 679 bp, Homo sapiens
  misc_feature: GYAE6OF02GI26X.17.25.C03.1.454.CMB.1.raw
  modified_base (281)..(281): a, c, t, g, unknown or other
  misc_feature (281)..(281): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcgaaggtcttctggattcacgtttacctctatagtatcaagtgggtncgccgacggccgctgggacaacgaccgtgacggtggatggggagtcggggaccgtaaacccctaacgacgttacgggttcgtaccgacgtaaggttcgttacctttaccgacccctattcccgtaccggggaactacgtaaccttacgatacgaccacgtaacctcctacctaataaaccacacgacctacacgtaggagttaggaggacgcgtagactacttacgcgaccggaccgtaccgggtaccgttacttaacgttaccgtggtacgacgtaacggtaccgtaccccgtaacggtacgttaccgggtacccgtaccccggtaaccgggtaccgtaaccgggtcccggtttaccggtttaccggtaccggtttccgggtaccggggtacccggg

SEQ ID NO: 209378 - DNA, 765 bp, Homo sapiens
  misc_feature: GYAE6OF02F74IW.17.25.C03.1.454.CMB.1.raw
  modified_base (464)..(464): a, c, t, g, unknown or other
  misc_feature (464)..(464): n is a, c, g, or t
  modified_base (481)..(481): a, c, t, g, unknown or other
  misc_feature (481)..(481): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctggggcctcagtgaaggtctccgtgcaaggcttctggattcgacgtttacctcctatacgtataccaacgtgggtgtcgccgaggccgtcgtaggaccaaccgcctggagtggtacgtggggatcggggaccgtaacccgtaaccacgttgggtcgtaccgactggttcgttcctttaccgacccgtactcccgtaccgggacacgtaccttaccgagtacgaccgtacgtaaccctccctaccaaacgtaaaccnccgtaacgtaccctaanagtcgggtagttaggaacggacgtacccgtagacacgttacggtacgaaccgtaccggaccgggtacccttacgttaacgttaaccggtcggttacggaccgggtaaccgttaccgggtacccccgtaaccgggtaaccggttccccgggggttaacggtaaccccgggttaccccggttaaaccccggggtacccccggttaacgggggtaccccccggggttttaacccggttttacccgggttaacccccgggtttttaccgggtaacccccggggggggg

SEQ ID NO: 209379 - DNA, 663 bp, Homo sapiens
  misc_feature: GYAE6OF02GK7QI.17.25.C03.1.454.CMB.1.raw
  modified_base (283)..(283): a, c, t, g, unknown or other
  misc_feature (283)..(283): n is a, c, g, or t
  modified_base (343)..(343): a, c, t, g, unknown or other
  misc_feature (343)..(343): n is a, c, g, or t
  modified_base (361)..(361): a, c, t, g, unknown or other
  misc_feature (361)..(361): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcccagctacaagtgcccactcccaggtgcagctggtgcagtctggggctgaggtgaagagccgtggggcctcagtgaaggtctcctgcaaggcttctggattcacgtttacctcctatagtatcaacgtgggtnccgccaggccgctcggacaacgacctggaggtggatggggatggggaccgaaaccctaanacgttgggtcgtaccganagtgttccttaccaccctactcccgtccggggactacgtaccttaccactcgacccaacgtaacctcctaccgaataaaccacacgtacctacagtacgggtagttggacggacgtcctacggaactacgtcgtaacggaccgaaccgtaccgggtcccgttaacttaacgtttcgtaggttcggaccgtaacggtacccggttccccgaacgggtccgttacccggggtacgaaccgtccccgttacgggacctaccggggttcccgttaccggtttcggtacccgttcgggtaccggggg

SEQ ID NO: 209380 - DNA, 548 bp, Homo sapiens
  misc_feature: GYAE6OF02FLMEW.17.25.C03.1.454.CMB.1.raw
  modified_base (326)..(326): a, c, t, g, unknown or other
  misc_feature (326)..(326): n is a, c, g, or t
  modified_base (333)..(333): a, c, t, g, unknown or other
  misc_feature (333)..(333): n is a, c, g, or t
  modified_base (338)..(338): a, c, t, g, unknown or other
  misc_feature (338)..(338): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctggggcctcagtgaaggtctcctgcaaggcttctggattcacgtttacctctatagtatcaactgggtgcgccaggccgctggacacgacctgagtggatgggatgggcaaccctaanactggtntcacngtgtcttcaccctatcctaccgggactacgacttaccatcgaccacgaacctcctaccaataaaccacacgaccctacacgtggtagttcgaaggacgtcctagactatctagacgaccgacggcctctacgttactgtgacgagtacgtccacgtacgtccggtagacgtcctacgggctacggccgtcgtttcgacgttcggtcgggg

SEQ ID NO: 209381 - DNA, 646 bp, Homo sapiens
  misc_feature: GYAE6OF02F6DIW.17.25.C03.1.454.CMB.1.raw
  modified_base (191)..(191): a, c, t, g, unknown or other
  misc_feature (191)..(191): n is a, c, g, or t
tcagcgtagactagcacgaccggtgctcgatttagtagtgtagatttgggtttggggggagtcagtctcagtcaggacacagcatggacatgagggtccccgctcagctcctggggctcctgctactctggctccgagctgccagatgtgacatccagatgacccagtctccatcctccctgtctcgcctntggtggggtcagagtcaccatcacttcgaccgactaagtcacggtaccgttaaaaaccttatttaaacttggtatacagcaacgaaacctaggaaaaccgaccccacgaccctccgtgacttccgtcgttaggtcacctactcccaacttcgtacgacgtaaggtcggtccgttacccacgtacgtacggttcgtaggtggtaacgtagtacggtatcgtaggactaggtactttacgatcgactaccactccactactctcgacacgtacgagtacttgcgatactacctatactcgtaacacgtaagtacttaccgttccgttaccctccgtaccttaccggtttacggccggtaacgggtaaccttaagtaggaacgtaaaccgttaacgtaaaccgtaacgttacgtaggtccgttacgaacctaccgtacctttaccgtccgtttacccg

SEQ ID NO: 209382 - DNA, 664 bp, Homo sapiens
  misc_feature: GYAE6OF02JQ1GA.17.25.C03.1.454.CMB.1.raw
  modified_base (151)..(151): a, c, t, g, unknown or other
  misc_feature (151)..(151): n is a, c, g, or t
  modified_base (529)..(529): a, c, t, g, unknown or other
  misc_feature (529)..(529): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcngctacaagtcgcccactccaggtgcagctggtgcagtcgtgggctgaggtgaagacgccgtggggcctcgagtgaaggtcctccgtgacgaggtcttcgtggtacttacctacggtttacctcctagttacgtatacgtaacggtggacgtccggccgacggtccggtacgtacggaccgtaaccgaccgtgtaggtacggacgtaggggtaccggaggggtacccaaacccgtttacgaacgttcgggttacgacgtacggagttacgtccttacaacccgtacgtccgtacggaactacgactaccgatacgaccaccgtacctacctacgtaaactaaaccgcctaagtcctaacgacgttaggaggttacggancggtaccgcgactacgtctaacgacgtaaccgtcggtccgtacttaacgacgtgtaccgcgtactacggtccacggtacgttccgcggtaacgtccgtacggcgtagccggttccgtttacgacgtcggtaccgg

SEQ ID NO: 209383 - DNA, 941 bp, Homo sapiens
  misc_feature: GYAE6OF02F7SOC.17.25.C03.1.454.CMB.1.raw
  modified_base (156)..(156): a, c, t, g, unknown or other
  misc_feature (156)..(156): n is a, c, g, or t
tcagcgtagactagcacgaccggtgctcgatttagtagtgtagatttgggtttggggtacgtcaacaaccacatctgtcctctagagaaaaccctagtgagcacagctcctcaccatggactggacctggaggatcctcttcttggtggcagcagntacaagtgcccactcccaggtgcagctggtgcagtcgtggggcgtggaggtagaaggaagccgtgggggtcctcgaacggttacggaaagggttcctccgtaggtaccgaaaggggtccttacgtgggtaactttcctaccggttttaaccctcgttaacgttaagttaacttaccgtaaacgttcgggggttacgccggtccggtaacgggccccgtacgtacggggaaacccaaaaccgggtcccgttaggaacggtttacgggagttagggggacgttagggggtacccgaaaacccgttacgtaaccggttgggtacgttaccgaacgtcggttaacgggttcctttaacccgaaccccgtacgtaccggttaccccggggaactacggttaaacccttaccgaacttacgaaaccccgtaaccggtaacctacccgttaccccaaaacgttaaaaccgtacccgtaaagtacccgtttaacgaacgttaaccggggttacggttaacgggtaacgggaaccggttacccgtacgtaaaccggttactaccggttaaccggtaaccggaaaccggtaccgggttaacccgggtttacgttaaccgttttaacggtacgtcgggtttaaccggaacggtttaacccgggcccgttaaaaccgggcggttaacccggggtcggttaaacccgggtaccccgtttaacgggggcccgtaaacgggttccccgggggtttaaccgttttccgggtttaacccggtttcccgggttaccggggggg

SEQ ID NO: 209384 - DNA, 585 bp, Homo sapiens
  misc_feature: GYAE6OF02I6LZM.17.25.C03.1.454.CMB.1.raw
  modified_base (286)..(286): a, c, t, g, unknown or other
  misc_feature (286)..(286): n is a, c, g, or t
  modified_base (445)..(445): a, c, t, g, unknown or other
  misc_feature (445)..(445): n is a, c, g, or t
  modified_base (526)..(526): a, c, t, g, unknown or other
  misc_feature (526)..(526): n is a, c, g, or t
  modified_base (554)..(554): a, c, t, g, unknown or other
  misc_feature (554)..(554): n is a, c, g, or t
  modified_base (564)..(564): a, c, t, g, unknown or other
  misc_feature (564)..(564): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgccccactcccaggtgcagctggtgcagtctggggctgaggtgaagaagccgtggggcctcagtgaaggtcctcctgcaaggcttcgtggtattcacgtttacctcctatagtatcaacgtgggtnccgccacggccgctggacaaccgacctggaggtggatggggacgtggggaccgtaaccctaacgacgttggtcgtaccgacgagttcggtccttacacccctatcccgtacggacacgtacccttacacgtacgaccacgaacctccaccaataaaccncacgaccctaagagtagggtacgttaggacggacgtccgtagacctagtccgtagaccggacgccggtactcttagttacngtcggcagaccgtccagggtctaccggncgcctaggcncgtccgtcttagcctggtcgg

SEQ ID NO: 209385 - DNA, 624 bp, Homo sapiens
  misc_feature: GYAE6OF02F2KLJ.17.25.C03.1.454.CMB.1.raw
  modified_base (245)..(245): a, c, t, g, unknown or other
  misc_feature (245)..(245): n is a, c, g, or t
  modified_base (279)..(279): a, c, t, g, unknown or other
  misc_feature (279)..(279): n is a, c, g, or t
  modified_base (288)..(288): a, c, t, g, unknown or other
  misc_feature (288)..(288): n is a, c, g, or t
  modified_base (313)..(313): a, c, t, g, unknown or other
  misc_feature (313)..(313): n is a, c, g, or t
  modified_base (358)..(358): a, c, t, g, unknown or other
  misc_feature (358)..(358): n is a, c, g, or t
  modified_base (379)..(379): a, c, t, g, unknown or other
  misc_feature (379)..(379): n is a, c, g, or t
tcagcgtagactagcacgaccggtgctcgatttagtagtgtagatttgggtttggggactcaacaaccacatctgtcctctagagaaaaaccctgtgagcacagctcctcaccatggactggacctggaggatcctcttcttggtggcagcagctacaagtgcccactcccaggtgcagctggtgcagtcgtgggctggaggtgaagagccgtgggcctcagtgaaggtctcctgcaggtcttcnggattcacgtttacctctaatgtatcaatgggtncgcagccgntggacacgtctgagtggagtgggangggaccgaacctaacgcgtggtcgtacacgtgtgtcttacacccntcccgcggaacagtacctacntcgacctaccgaactccctaccaaataaaccacaacgaccctaacgtagtacggtaagttcggaaacgggtactaccgttagacctaagttaccgtacggaaccgtaccgaccgggtacccgttacttacgttaacgttggtacgtcggaagtcccggtacccgacggtcgttacccgggtagaccggtacccgtacggaccgccggttcggttcccgttacggtccgtttaccgggtccggggg

SEQ ID NO: 209386 - DNA, 846 bp, Homo sapiens
  misc_feature: GYAE6OF02HADP1.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctgggaggatcctcttcttggtggcagcagctacagtgcccactcccaggtgcagctggtgcagtcgtggggctggaggtagaagacgcgtggggcctcgagtgacggtctctgacaggtcttcgtggtattcctacgtttacctcctattagtactacgaacgtgggtcgccgccgacggccgtacggtacgggaaccaaacccggtaccgttgggacggtaggggtaacggttacgggggtaaggtaccggggaacccgtaaaacccccgttaacggtaacccggtttcggggtaccggttaaccgtaaacgttacggtttcggttacccttaaaccccgtaaccccgttaaccggttaccccggttacccggggaaaacctaacgggtaaaccctttaacccgtaacggtacccgaaacccggaacccgttaaacccttccccggttaaaccctaaaacctaaaacccgtaaacccgaaccggtaacccttaaacgacggttaacgggtacggtttaacgggacggttaaccggccttacggaaacttaccggtacggttacccggaacggtaacccgtaccgggtaccgttaaccgttagttaccggtgtaacgggacgtaacggacccgtaccgtaacgtcccggttacccgggaggacccgtacgggaccgcgggtaccgtccggttaccgtttcggtacgtttaccgggaccgggg

SEQ ID NO: 209387 - DNA, 832 bp, Homo sapiens
  misc_feature: GYAE6OF02IOXZT.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatccctccctgtctcgcctcgtggtggggtcagagtcaaccatcacttcgaccggacaagtccacggtacttaaaaactagtttaaacgtggtaatcgagacaaacgtaaaccgtaggaaaacgccccgaagtaccctccgtagaactccgtcgtggtacgactaacgtccctaacgtcgtaggtaccggtaaacggttcggacccgtaccccgtaagttaccgggtacggtttacgaacgggttccggtaccgtaagggttacgggtaaacgttcgggtaacggggtaaactaacggtttaactttttaacccgaaacgtttccgttaaccgtaaacccgtaacgttaaaccccgtaaaacccgtacccgttttaccaaccgggtaaacccttaaaacccggtacgggttaaacggttacgttaacgggttacgtaaacccttaaaacgttacccgttttaaacgttaaccgttaacggtaacctaaacgtaaccggttaacgtttacccgtacccgttttaccccgacgttacccttttaaccgggtttaccggaccggttaaccgggaaccgttaaagttcggtaacgtaacgtaaccgtaaaacgtacgttacggtaccgtcgttaacggaccttaaccgtagttcccgtgttaacccg

SEQ ID NO: 209388 - DNA, 859 bp, Homo sapiens
  misc_feature: GYAE6OF02I5RLT.17.25.C03.1.454.CMB.1.raw
tcagcgtagactagcacgaccggtgctcgatttagtagtgtagatttgggtttggggactcaacaaccacatctgtcctctagagaaaaccctgtgagcacagctccctcaccatggactggacctgggaggatcctcttcttggtggcagcagctaacaagtcgcccactccccgaggtcgcgagcgtggtgcagtcgtggggctggagggtagaaggaacgccgtcggggacctcgaggtaggaacggtccgtcccgtagaccgtaaaggtccgttacgtcgggtacttacctaccggttttaacccttaccgtaattaagttactacgtaaccggtgggtacgccggtccgaccggtccgcgtacggtaccaaccggaccgtaggaggtacggtagtcgggtacggtacggggtacccaaacccgtaacgtacggtggtacgtacgtacgacgttcgtactaccgtaaccctacgtcccggtaccggtacgtaacggtaccttaacgacgttccgaacctaccggtaacccctcccgtaaacctaaacgtaaaccgtaccgtaccgtaaccgttaccgtaacgtacgggggtaattaaccgggtaacggacccggtaccgttaacgggaacccttaacggttccgttaaaccgggaacccggttaacccggtaacccggggtcccgtttaaaccgtttaccgttaaccggtggttaacccggtacgggtacccggttaccgaaccccgttacgggtcgggtaaacccgttccggggaacccgtacccggttacgggacccggttaccggaccggttttaacccttcgggttaacccgttcccggggtaacccgggg

SEQ ID NO: 209389 - DNA, 738 bp, Homo sapiens
  misc_feature: GYAE6OF02HN7H4.17.25.C03.1.454.CMB.1.raw
  modified_base (183)..(183): a, c, t, g, unknown or other
  misc_feature (183)..(183): n is a, c, g, or t
  modified_base (191)..(191): a, c, t, g, unknown or other
  misc_feature (191)..(191): n is a, c, g, or t
  modified_base (239)..(239): a, c, t, g, unknown or other
  misc_feature (239)..(239): n is a, c, g, or t
  modified_base (278)..(278): a, c, t, g, unknown or other
  misc_feature (278)..(278): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggngcagtcgnggggctggaggtgaagagccgtgggcctacgagtaggaaggtctccgngacgaacggtcttcgtggtaattcctaccgttttaaccnctaatagttactcgaacgtgggtcgccgacgtacggccgtcgtaggaaccaaacccgtacctaggaggttacggaggttaggggacgttcggggaaccccgtaaaccgtaaactacggttgggtacgtaccgacgtaacggtttcgttacccttaccgtaaccccgtacgttcccggtaaccggggtaactaaacggtaacctttaaccccgaagttcccggaaaccccgtaaccgttaaccctaccccgttaacccaaactaaaacccgaacgtacccggtacctaaaccgagttacggtaaggttaggaacggtagtaccgtagactacgtactacggacgaccgaccggtcgtacttacgttacgtgtacgacgacgtaccgtaccgacgtaccggtcggtaccgacgtaaccgccgggactacggccgtttaccgttagttaccgtggtaccgggg

SEQ ID NO: 209390 - DNA, 727 bp, Homo sapiens
  misc_feature: GYAE6OF02IPN4V.17.25.C03.1.454.CMB.1.raw
  modified_base (295)..(295): a, c, t, g, unknown or other
  misc_feature (295)..(295): n is a, c, g, or t
  modified_base (327)..(327): a, c, t, g, unknown or other
  misc_feature (327)..(327): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagcctggggcctcagtgaaggtctcctgcaggcttcgtggattcctacgtttacctcctatagtatcacgtgggtgtccgcgacgggccncgtcggacgaacgccgtaggagtggagtgggngtacgggaccgtaaacctacgacgttggtcgtacgaccgagttcgtccgttacccaccctacgtcccggttacccggggaactaaccggttaaccttaacccgtacgttaccgaaccctaacccggtacccctttaacccgtaccctaaaaacggttaaaacccaaccggaacctacccgtaacttaacggttagggtaacgttcgggtacggggtacacccggttcgaaacttcttacccgagaccggtaaccgtcgggtaccctttacgttacttaagtcggttacgacgtacggtacccgttcccgacggttaacttcccgggtagtaaccccggtccggtaccggtcgtacccgggtcgggttacccctttaggggtcccttccgggtaccggggg

SEQ ID NO: 209391 - DNA, 580 bp, Homo sapiens
  misc_feature: GYAE6OF02FOK6A.17.25.C03.1.454.CMB.1.raw
  modified_base (351)..(351): a, c, t, g, unknown or other
  misc_feature (351)..(351): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagctgggcctcagtgaaggtctccgtgcaaggtcttctggattcacgtttacctctatagtatcaacgtgggtgcgccgaggccgcgtggacacgacctggagtggatgggagtcgggccgaaccctaacgacgtggtcgtacganagtgtcttaccacccatccgccgggacacgtactccatcgaccacgaacctcctaccaagtaaaccacacgtacctacaacgtggtagttagaggcgacctggacacgttcagacccgacaccgggtccttactacttacgtgtcgacggagtcgtaccccgaggtacgtccggtagccgtacccgtaggcctacggtccggttacctttacgaccgttcggtaccggg

SEQ ID NO: 209392 - DNA, 519 bp, Homo sapiens
  misc_feature: GYAE6OF02GC1B5.17.25.C03.1.454.CMB.1.raw
  modified_base (279)..(279): a, c, t, g, unknown or other
  misc_feature (279)..(279): n is a, c, g, or t
  modified_base (330)..(330): a, c, t, g, unknown or other
  misc_feature (330)..(330): n is a, c, g, or t
  modified_base (400)..(400): a, c, t, g, unknown or other
  misc_feature (400)..(400): n is a, c, g, or t
  modified_base (495)..(495): a, c, t, g, unknown or other
  misc_feature (495)..(495): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtncgccaggccgctggacaacgacctgagtggatgggatgggcgaaccctaanactggtgtcacagtgtcttcacccatcctcgggacagacttaccatcgaccacgaactcctacataaacncagcctacatggagttgaggacgcctgacatctagacgacacggccgtctattactgtcgcgagacgtcccaggcgtccggtgacgcctacggcnggccgtctttcgacttcggcgggg

SEQ ID NO: 209393 - DNA, 652 bp, Homo sapiens
  misc_feature: GYAE6OF02H45W5.17.25.C03.1.454.CMB.1.raw
  modified_base (232)..(232): a, c, t, g, unknown or other
  misc_feature (232)..(232): n is a, c, g, or t
  modified_base (286)..(286): a, c, t, g, unknown or other
  misc_feature (286)..(286): n is a, c, g, or t
  modified_base (492)..(492): a, c, t, g, unknown or other
  misc_feature (492)..(492): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttctggtggcagcagctacaagtgcccactcccaggtgcagctggtgcagtcgtggggctgaggtgaagagccgtgggcctcagtgaaggtctccngtacaaggcttcgtggacttcgaccgtttactcctatagtactcaagtgggtcncgaccgtacggccgtcgtaggacctaacggaacctggaagtcgggagtcggggtatacggggaccctaaacccgttaacgacggttggttcgtaccgacgtagttcgtcttacccgaccctacgtcccgtcgggaactacgtaacctacctagtccgaaccaccgactacccgtaccaactaaaacctccgtaagtaccctaacgnggttaggtacgttaggaggacgccttagactatcgtacggaccgtacgcccggtaccgttacttattccggtgacgtacgacgtaccggtccggacgtcgttaccggcggaccgtccgacgtacgaccggtccgtaccgtttcgtaccgttggtaccggg

SEQ ID NO: 209394 - DNA, 786 bp, Homo sapiens
  misc_feature: GYAE6OF02I3QUK.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttggtggcagcagctacaagtgcccactcccgaggtgcagctggtgcagtcgtgggctgaggtgaagagcgtgggcctcgagtgagtctccgtgcgaaggtcttcgtggacttcctacgtttacctcctaatacgttatccgtaacgttggggtacgcgacctacgggcccgtcgtacggaaccgaaccgtaccgttaggacggtgggacggtaggggtagtaccggggtaccgaaaccccgtaacgtaccggttcgggtacgtaccgtacgtacggtttcgtacctttaacccgaccccgttacgttccccggttaacccggggaaactaaccggttaacccttaacccggtacgtaacccggtaacccgtaacccggtaaacccttaccccgttaaaccctaaaaccgtaaaacccgtaaccgtaaccgtaccgttaacgtaacgttacgggtaacggtttacggaacggtaccgtaccgtacgtaaccgtacgtacgtaacggacccgaacgtaacccggtaccgttaccgttaacgttacgtggtaccggtacgtaacggtccgtaaccgtacggtaccgttaccggagtaccgacgtaccggacgaccggtcgttaccgtttacgtaccgttaccgtcggg

SEQ ID NO: 209395 - DNA, 743 bp, Homo sapiens
  misc_feature: GYAE6OF02F56EA.17.25.C03.1.454.CMB.1.raw
  modified_base (151)..(151): a, c, t, g, unknown or other
  misc_feature (151)..(151): n is a, c, g, or t
  modified_base (705)..(705): a, c, t, g, unknown or other
  misc_feature (705)..(705): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcngctacaagtcgcccactcccaggtgcagctggtgcagtcgtgggctggagggtgaaagagccgtgggcctcgagtgaggtctctgcaggtctcgtggattcctacgtttacctctaagtagtactacaacgtgggtcgcgaccgacgggcccgcgtaggggaacctaaccggaccgtaggaggtcgggtaaggtggggggacggtcggggaacccgtaaaccccgttaaacgtaccggttagggtacggttaccgaaacgtacgggtttcgttacccttacccaaccccgtaacgttccccggtaccgggaacctacgtaacccgtttaaccaacgtacccggaaacccctaaccggtaaacccctccccgttaaacccaaaactaaaacccgtccgtaaaccgtacccttaacgtaacgtacggggttaaggttagggaacgggacggttcccgtaacgacttactcgtaacggaccgacccgtacgggtcccgttacttaactttaccgtcggtagaccggagtaccgtacccgagtccggtcgacggtacncccgtaggctcgggtccgtctttcggcttcgggtcggg

SEQ ID NO: 209396 - DNA, 699 bp, Homo sapiens
  misc_feature: GYAE6OF02IKDW4.17.25.C03.1.454.CMB.1.raw
  modified_base (541)..(541): a, c, t, g, unknown or other
  misc_feature (541)..(541): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagcgtgggcctcgagtgaaggtctccgtgcgaaggtccttcgtcggtatttccgtaccgttttaccttcctaagtagtactccgtaaacgtggggtgccgtacccgacgggcccgtccgtggaaccgtaaccggtaccctggtaacggtgggtagtcggggtagtaccgggaccgtaaaacccccttaacgaccggttgggtcgtaccaacgttagttcgtacccgtttaccaaccctacgttccccggtaccgggtaactaacggtaccttaccgtaacgtccgaaaccgtaaccgtaacctcccgtaccgtaactaaaccacgtacaccctanacgtaggtagttacggacggactccgtagtacagtccgtagaccgaccgtaccggtccgttacttacgttacgtgtcggacgtacgtaccgtcccgacggcgtccggtcgaccgcccgtaacggtcgacggtccggtccgttcgtcgtcggtaccggg

SEQ ID NO: 209397 - DNA, 668 bp, Homo sapiens
  misc_feature: GYAE6OF02H3BOH.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtcgcccactcccaggtgcagctggtgcagtcgtggggctggaggtagaaggaagccgtggggcctcgaggtggaaggtcctcctggacaaggtctttcgtggtacttcgtaccgttttacctaccgtatagttactacgtaacgttgggtacgccgccgacggcccgacgtacggaaccgaacgacgtggagtggtagtagggagtcgggaccgaacccgtaacgacgttggtctacgacgtagtcgtccttaccaccctcgtccgtaccgggacacgtacctacagcgaccacgtactccactaactaaaccacacgtacctaacgtagtaggtaggttaggaacggtacgtccgtacgactacgtcgtacggaaccgtaccgaccggtaccgttacttaagttcgtaggtacgtacgtacgtacgtacccgtacgtcggtccggtagaccggtaccgtacggcggtaccggtcccggttcgtttacggtaccggtttggaccgggg

SEQ ID NO: 209398 - DNA, 686 bp, Homo sapiens
  misc_feature: GYAE6OF02HDKVK.17.25.C03.1.454.CMB.1.raw
  modified_base (262)..(262): a, c, t, g, unknown or other
  misc_feature (262)..(262): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggggcctcagtgaaggtcctcctgcaaggcttctggattcacgtttaccncctatagtatcaactgggtgcgccaggccgctggacaacgacctggagtggatggggatcggggcgaaaccctaactacgtggtcgtacgacaggtgttccgttacacccacttcccgtcgggaaccaggtaaccctttaacccgaacttcggaacccaacgaaaccctccctaacccaacttaaaacaacctaacggaccccttaacgaacgtgggtaacggtttacggaagggtacggttccctaggactacttaccgttaggaaccggtacccgaacggggtcccgttaacttaacggtttaccttggtagaccggtaagtaccgtccccgtaacggaacggtttcccgggacggtacggcccgttaacggggcctacggggtcccgttacccttttagggtacccttgggtacccggggg

SEQ ID NO: 209399 - DNA, 771 bp, Homo sapiens
  misc_feature: GYAE6OF02HQP65.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtgggcctcagtgaaggtctccgtgacaaggcttcgtggtattctacgtttacctcctatagtatcaacgtgggtcgcgaccgaggcccgcgtggaaccaacggaccgtaggagtggagtgggagtcggggaccgaaaccctaacgacgtggtgtaccacgtagttcgttccttaccaacccgtacgtcccgtaccggggtaactacggtaacccttaccgaagtaccgaacccaaccgttaacctccccttaaacccaaaactaaaacccaccgtaacgtaccccttaacgtaaggttgggtaaacggtttcggaaacgggtacgtaccctaggaacctaacggttacccgaacgggtaaacccgtacccggtaacccggggtccccgtttaacgtttaaaccgttttacggttacgggtacggtaaccgggaacgggttacccggtaccccggtaacggttaccggttccccggggttaaggaccggttaccccggtacgggaccgtacgggtcccggtttaccgttttacgggtacccgtttcgggtacccggggg

SEQ ID NO: 209400 - DNA, 730 bp, Homo sapiens
  misc_feature: GYAE6OF02GESXB.17.25.C03.1.454.CMB.1.raw
  modified_base (473)..(473): a, c, t, g, unknown or other
  misc_feature (473)..(473): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagacgcgtggggctcagtgaaggtctcctgcaaggtcttcgtggattctacgtttacctcctaatacgtatccaacgtggggtcgccgccacgggcccgcgtcggaaccaaccggaccgtggaggtggagtagggagtcgggaccgtaacctaacgacgtggtcgtacgactgtcgttccttccaacccgtacgtcccgtaccggaactacgtaccttaaccgacgtaccgaaccctaaccgtaacctcccgtaacctaaagtaaaaccncgtaaccgtaccctaagagtaggacgtttggaacgacgtaccttagacctagtaccgtacggaaccgtaccggtaaccggtcccgtttacttaaacggtttccagggttaaccgaccggtaacggttacccctacccgggtaaaccggtcgggttaaccccgggtttagggaaaccccgtttcccgggtaaccggaccggtaaccgggttccccgggtttacttttacccgggtaccgtttcccggggacccggggg

SEQ ID NO: 209401 - DNA, 1198 bp, Homo sapiens
  misc_feature: GYAE6OF02IXAXG.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagttcgtgggctggaggtagaagaacggcctcggggcctacgtaggtaggtaacggtccgtccgttaggacctaacgggtccttacgtacggttactttaccgttaaccggttttacccttaccgttaagttacgttaaacgttaccgttaaaaccggttcgggggtttacgacccggtaccccgtaacggggttcccggtaacccggtacggggtaaacccgtaaaccccgggtaacccggttaacggggtaacggggtttacgggggtaacgggtttaacgggggtaacgggttccggggggtaaaacccccgttaaaacccccggttaaaacccggttaccggtttaacgggggttcggttaaccctaaccggttacggttttaccgggtttacccctttaacccgtaaacccccgtttaccggtttaccccggttaaccccgggggttaaaccctaacggttaaccccgtttaaaacccgtacccgtttaaacccggaaacccgttaaaccccgggtaaaacccctttttacccccgtaaacccccgtaaaaaccggttaaaaaacccctaaacccggtaacccggtttaaaccccgttaaaaaccctaacgggggttttaaccccgggggtttaaaaagggttttaacggggtttaaaaccccgggggacccggttaaccccggtttaacccggtaaacccggttttaacccgttaaaccccgggttttaacccggtaaaacccggggtaaacccccggggttaaaccccggggtttaacccccgtttttaaaccgggttttaaaccccggtttttaaaccggttcggggtttaaacccgggtaaccggttaacccggggttaacccccgggttaacccgttaaccccgggttaaacccgggtttaccccgggtaaacggggtaccccggtaaaccccggggtttacgggaaccccggttaaccgggttaacccccgggggttttaaccccggtttttacggggttaa

SEQ ID NO: 209402 - DNA, 832 bp, Homo sapiens
  misc_feature: GYAE6OF02HDA10.17.25.C03.1.454.CMB.1.raw
tcagcgtagactagcacgaccggtgctcgatttagtagtgtagatttgggtttggggactcaacaaccacatctgtacctctagagaaaaccctgtgagcacagctcctcaccatggactggacctggaggatcctcttcttggtggcagcagctacaagtcgcccactcccaggtgcagctggtgccagtccgtgggctggaggtagaagaagcccgtcggggacctcgaggtaggtaaacgggtcctcccgttaggaccgaaagggtcccttttacgtacggggtaacttttacccgttaaccggtttttacccctaccctttaaagttaacggttaactttaccgaaaccggtttgggggttcggccccggaccggaaacgggtccccggtacggttaccggggaaaccaaaacccgggccctagggaacgggttcgggtaagttcgggggaaagttcgggggaaacccctaaaaccccgtaaccgtaacgtcgggtacgtaacgaccgtaagggtttcttacccctttacccgacccgtaactcccggtccggggtaaactacgtacccgttactaacttcggaaaccctaaccgtaaccgtcctaacccgtaataaaccgaactccggaaccttaacgaacgtacggtaggttacggaacggagtcccgtaagtacctagtcccgtaggaacctaccgaccgggtaccgtaacttaccgttaagtcgacgtacgggaacgtaccgtacccgtacgtaccggttccgacgtaccggtcccgtaaccgtggaacggtccggtacgtttaccggtacttcgggtacgggg

SEQ ID NO: 209403 - DNA, 734 bp, Homo sapiens
  misc_feature: GYAE6OF02G7HAR.17.25.C03.1.454.CMB.1.raw
  modified_base (305)..(305): a, c, t, g, unknown or other
  misc_feature (305)..(305): n is a, c, g, or t
  modified_base (386)..(386): a, c, t, g, unknown or other
  misc_feature (386)..(386): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtacgaagaaggccgtggggcctcgagtagaaggtctccgtgcaaggtccttcgtggattcgtaacgttttacctccttatacgttactcgtaacgtgggtcncgccgacggccgtcgtcggaaccaaccgtacctaggacggtggacgtggggatgggaccgtaaacccgtacgacgttggtntaccgtaacgcgttcgttccgttacctacccacgtcccgtaccgggactacgtaccttaacgacgtacgaccgtaacgaacctccctaccgtaaataaacccgacgtaacgtaccctaacgtacgtacgggtacgtttaggaacggtcgtaccgacgtaacctacgttacacggtaacccgaaacggtcccggttacccgttaacgttaagtttaccgtacggtaccggacgtaacgtaccgttccccgaaggtacccggtaccgggtttacggacccgttacccgtaccgggtacttaacggggtccccggtttaccctttaggttacccggttcgggtacccgggg

SEQ ID NO: 209404 - DNA, 723 bp, Homo sapiens
  misc_feature: GYAE6OF02JTD18.17.25.C03.1.454.CMB.1.raw
  modified_base (185)..(185): a, c, t, g, unknown or other
  misc_feature (185)..(185): n is a, c, g, or t
  modified_base (260)..(260): a, c, t, g, unknown or other
  misc_feature (260)..(260): n is a, c, g, or t
  modified_base (470)..(470): a, c, t, g, unknown or other
  misc_feature (470)..(470): n is a, c, g, or t
tcagcgtagactagcacgaccggtgctcgatttagtagtgtagatttgggtttggggactcaacaaccacatctgtcctctagagaaaccctgtgagcacagctcctcaccatggactggacctggaggactcctcttcttggtggcagcagctacaagtgcccactcccaggtcgcagctggtncagtctgggactgaggtgaagagccgtgggctcagtgaggtctcctgacaaggcttctggattcacgtttacccnctaatagtactcaaccgtgggtacgcgacctaggccgtcgtacggaaccaacgtcctaggaggtcggaagtcggggaattcgggggaccaaacccctaagtcgtgggttactacgtacgagttcgtaccttcgaccctacttccgtaccgggacaacggtaccttaccgagttacgaccctaacgaaccgtccctacaacgtaaacccanaaccgtaccgttaacacggtacggtacggttacgaaagggtctaccgtacgtaaccaaacggtccgttaacggaacccggtaaccgtaaccgggtacccttacgttaaccgtttaccgtggttaagcccgggtaacgtcccgtttaccggaaccgtacgggtttacccggtaggaccgttacccgggttaacggaccgttaccggacccgggttacccttttccgggtaacccgttcgggttaaccccggggg

SEQ ID NO: 209405 - DNA, 689 bp, Homo sapiens
  misc_feature: GYAE6OF02HB9VT.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaacgccgtggggcctcgagtgaaggtctcctgcaaggtcttctggattcacgtttacctcctatagtatacaacgtgggtcgccgcctagggcccgtcgtacgggaaccaaaccgccgtaggaggtacggaggtggggtagtcgggggaccgtaaaccccttaacgacgttcgggtacgtaccgaacgtaggttcgttccgttaccgacccctacgttcccggtacccggggaactaaacggtacctttaaccgagttaccgaacccgtaaccgtaaccttacccgtacctaaactaaaaccgacctaacgacccttaacgagttacggtaggttacgtacgggaacgtccgtagtaactcgtacgtcgtaaccgaccgtaccgtccgtacttagtacctgtacgcgacgtcgaccgacggtctccggtagaccgtaccgtacggccgacgtccggttactttcgaccgttcggtaccgggg

SEQ ID NO: 209406 - DNA, 759 bp, Homo sapiens
  misc_feature: GYAE6OF02H60O0.17.25.C03.1.454.CMB.1.raw
  modified_base (178)..(178): a, c, t, g, unknown or other
  misc_feature (178)..(178): n is a, c, g, or t
  modified_base (244)..(244): a, c, t, g, unknown or other
  misc_feature (244)..(244): n is a, c, g, or t
  modified_base (302)..(302): a, c, t, g, unknown or other
  misc_feature (302)..(302): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtcgcccacctcccaggtncagctggtgcagtcgtggggctggaggtagaagaacgccgtgggcctacgaggtgaaggtctccgngacgaagtcttcgtggatttctaccgtttacctacttatagtactcgaacgttgggcnccgccgtacggccgtcgtacggaccaaccggtacctaggaggtaggagtacggggagtacgggaccgaaacccgtaacgtcgtacggtcgtacgacgtagttcgttaccttaccgaccctaacgtcccggtaccgggaacctaacgtacccttaaccacgttaccgaccgaaccgtaacccttcccctaaaccaaactaaaaccaccgtaacgtaccctaacgtaggttacccggtaaggttacggaacggtacgtacccgttaggacctaacgtaccgtacggaaccggtaccgtacccgggtaccgttaacgttaacgtttaccgtaggtaccgtaccggtacggtacccgttaccccgtaaccgggtccgttaacccggtagacccggttacccgaccggtccgaaccggtcccggtttaccgttttacgggttacccggttcgggtaccgggg

SEQ ID NO: 209407 - DNA, 872 bp, Homo sapiens
  misc_feature: GYAE6OF02HPDGY.17.25.C03.1.454.CMB.1.raw
  modified_base (203)..(203): a, c, t, g, unknown or other
  misc_feature (203)..(203): n is a, c, g, or t
  modified_base (235)..(235): a, c, t, g, unknown or other
  misc_feature (235)..(235): n is a, c, g, or t
  modified_base (287)..(287): a, c, t, g, unknown or other
  misc_feature (287)..(287): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggngaaagagcctggggcctcagtgaaggtctccngacaggtcttctggattctacgtttacctcctatagtactacaacgtgggtnccgcacggcccgacgtacggacaaccggacctaggtacggtaggtacgtgggggtaagtacggggaccgtaaaccccgtaacgtacgtagggtacgtaccgactacggtacgtaccgtttaccgaacccctacgtaccccggtaccggggaactaaccggtaaccctttaacccgacgtttaccggaaacccctaacggtaaaccccgtttacccctaaaccgtaaacgtaaaaccctaaccgtaacccggtacccttaaacgtaccgttaaaggggtaacgtttacggggaacgggtaaccgtacccgtttaacgaaccgttacgttaaccgtacgggtaaacccggtaccggtaacccgggttaccccggttaactttaaacggtttaaccccggttaggttaaccgaccggttaaccgggttaacccgttacccccgggtaaacgggttaacccggttacccggggtaacggggtaacccggtaccccggttaaaccggggtacccgtaacccggggtaccccgggttttaaccccggttttaacgggttaccccgggtttacggttaaccccggggggggg

SEQ ID NO: 209408 - DNA, 673 bp, Homo sapiens
  misc_feature: GYAE6OF02IMSBM.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatctcttcttggtggcagcagctacaagtgccccactcccaggtgcagctggtgcagtcgtggggctgaggtgaagagccgtgggcctcagtgaaggtctcctgcaggcttcgtggacttcgtaccgtttacctcctattagtatacaacgtgggtgcgccgacgggcccgcgttagggaaccaaccggacctggtaggtggagtggggagtcggggaaccgtaacccgtaactacgtggtgtaccacgtagttcgtcttaccacctcgtacccgtacgggaccaacgtaccttaacgactacgaacccgtaaccgtaacccttcccctaccgtaaacctaaaccaaccgtaaccgtaccctaactagtacgggtaggttacggaggacgtcgtgaccgtactcgtagacccggacgaccggtaccgttacgttacgttacgtacggtcgaccggtagtaccgtacctaaccggtcgttaccggtgaccggttacccgtacggccgtacggtccggtcccgtttcgtaccgttcggtccgggg

SEQ ID NO: 209409 - DNA, 643 bp, Homo sapiens
  misc_feature: GYAE6OF02JAJTP.17.25.C03.1.454.CMB.1.raw
  modified_base (247)..(247): a, c, t, g, unknown or other
  misc_feature (247)..(247): n is a, c, g, or t
  modified_base (273)..(273): a, c, t, g, unknown or other
  misc_feature (273)..(273): n is a, c, g, or t
  modified_base (384)..(384): a, c, t, g, unknown or other
  misc_feature (384)..(384): n is a, c, g, or t
  modified_base (446)..(446): a, c, t, g, unknown or other
  misc_feature (446)..(446): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtagaagagccgtggggcctcagtgaaggtctcctgacaggcttcgngattcacgtttacctcctatagtacncaacgtgggtcgcgccaggccgactcggaccaaccgtcctaggagtcgggagtgggagtgggaccgtaaacccgtaacacgtgtcgtacacgtagtctcttaccgaccctntcccggtacgggacacgtaccttacgactcgaaccacgtaacctccctaccaacgtaaaccncaacgacctaacacgtaggtagttcggaaggtacgccgtagactagtaccgtacgaacgaccgtaccggtcgttacttaacgttcgtacgtcggacgtacgaccggttaccaacggtcggttaccggacgtaacccggtccgttaacgggctaacggggtcccgttaccgtttacggacccgtttcgggacccgggg

SEQ ID NO: 209410 - DNA, 746 bp, Homo sapiens
  misc_feature: GYAE6OF02HWM85.17.25.C03.1.454.CMB.1.raw
  modified_base (260)..(260): a, c, t, g, unknown or other
  misc_feature (260)..(260): n is a, c, g, or t
  modified_base (592)..(592): a, c, t, g, unknown or other
  misc_feature (592)..(592): n is a, c, g, or t
  modified_base (634)..(634): a, c, t, g, unknown or other
  misc_feature (634)..(634): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctgggaggactcctcttcgttggtggcagcagctacaagtcgcccactcccaggtgcaggctggtgcaatcgtggggctggaggtgaagcgccgtgggtcctcggtggagggtctccgtgactaagggtcctttcgngggaggcctaccgtttacgacggtacgtaaccttaagttacggttttaccgaaggttttcgggggcgtaccgggaacccgggggtccccttacggttacgggaaccgtaacgggtcccgttttagggacgggtttagggacgtttagggggaaaggtaccgttcccggttcccgttaagtccgttaggaacctacgaaaccgttaaaccgtcgaccgaataacggtacgttaccgagggactaacgaccgtacacgaacgtaccgacggtaaactaacgtaaccgaacaactagttactacgaggactacgtagaacgtacgtccgtgtacncgtcgtacgggacgtaccggacggtacctttacgtaccttgngttccggaagtaggtacttaagtaccttaagtacccgtagttcccgtactttaacccgttttaacgaccctttcgtcggtaccttcccgggaggtacccacggttaccccgg

SEQ ID NO: 209411 - DNA, 577 bp, Homo sapiens
  misc_feature: GYAE6OF02GF1JD.17.25.C03.1.454.CMB.1.raw
  modified_base (306)..(306): a, c, t, g, unknown or other
  misc_feature (306)..(306): n is a, c, g, or t
  modified_base (408)..(408): a, c, t, g, unknown or other
  misc_feature (408)..(408): n is a, c, g, or t
  modified_base (431)..(431): a, c, t, g, unknown or other
  misc_feature (431)..(431): n is a, c, g, or t
  modified_base (481)..(481): a, c, t, g, unknown or other
  misc_feature (481)..(481): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtagcgccaggccgctggacacgacctgngtggatgggatgggccgaaaccctacactggtgtccacgtagtgtctcacccatcccgtccgggacagacttaccatcgaccacgaactcctacaataaacncagcctacatcggagttgaggancctagacctatcgtgaaccgacaccgggtcccgttacttaagtttaccgngttacgcggtaagccggttaccccacggtacttccgggtagacgtcccctaagggcctaggtcccgggtacctttggaccctttggtacccggggg

SEQ ID NO: 209412 - DNA, 724 bp, Homo sapiens
  misc_feature: GYAE6OF02GMM37.17.25.C03.1.454.CMB.1.raw
  modified_base (287)..(287): a, c, t, g, unknown or other
  misc_feature (287)..(287): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctcgagctgccagatgtgacatccagatcgacccagtctccatccctccctgtctgcctcgtgtgggggtcagagtcaccatcacttcgaccggacagtcagtcggtacgttaaaaacttatttaagttggtatcagacaagaaacctaggaaaacncccagacctcgtgatcctcgtggtcgtacacgtcctacgtctacgcggtaacggtcggtccgtacctagtcggtaacggttcgaacggtcggacgtaggtaggacgttcggacgggtaacgtagttactttaacgaacttacctaccgaacctaccttaccaaccttacctactacggaacccttaacggtacggtaacgttagttacggtactaacgttaaccttaccgttaacgttactacgttaaacgaaaccgttaagttaaccggtttacccttacccggttacccccgttacgttaaccctttacggttttaccggaaccgggtaacggggtaaccttaagggttaaccgtaagtaaccgtaaacggtaaaccgttaacggtacggtacggtaccgtaacggtaccctaaccgttacgttaccggtttccg

SEQ ID NO: 209413 - DNA, 685 bp, Homo sapiens
  misc_feature: GYAE6OF02JLXCN.17.25.C03.1.454.CMB.1.raw
  modified_base (164)..(164): a, c, t, g, unknown or other
  misc_feature (164)..(164): n is a, c, g, or t
  modified_base (373)..(373): a, c, t, g, unknown or other
  misc_feature (373)..(373): n is a, c, g, or t
  modified_base (674)..(674): a, c, t, g, unknown or other
  misc_feature (674)..(674): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctgggaggatcctcttcgttggtggcagcagctacaagtcncccactcccaggtgcagctggtgcagtcgtgggctggaggtgaacgacgcgtgggcctcgagtcgaaggtctccgtgacgaaggtcttcgtggattcctacgtttacctctatagttctacgaagttggggtcgcgccgagggcccgtgtacggacaaccgaccgtaggtaggtcggagtagggtagtcgggaaccgtaaaccgtaacncggtaggtccgtacgtacgtacgttcgtctaccgacctcgtcccggtcggactaacgtaccttacgacgtacgacccgtacgaccctacaaccgaactaacccgatacgacctacgaggttagggtaacgttggaccgagtcccgtagtaaccgctaccgacgtaccgaaccggtccgttaaccgttaccgttaacttcgtaggtccgtagaccgtccgttaacccgacgttacgggtccggttaacggaccgttaccgggcggttacccacggggttccttcccggtttaagttcccggnggtacccgggg

SEQ ID NO: 209414 - DNA, 866 bp, Homo sapiens
  misc_feature: GYAE6OF02F63EV.17.25.C03.1.454.CMB.1.raw
tcagcgtagactagcacgaccggtgctcgatttagtagtgtagatttgggtttgggggtacgtcgaacaaccaacatctgtcctctagagaaaaccctagtgagcacagctcctcaccatgactggacctggaggatcctcttcttcgtggtcagcagctacgaagtcgcccactcccaggtgcacgctggtgcgagtcgtggggctgagggtgaaggaagtcgtcggggcctcgagtacgaggtactcctgcgtaagccgttatgggattaccgtacgttttaccctccgttactaacgttaatcgtaacgtcggggtcgtaccggtccaacgggcccgtacggttacggaaccgtaaccggtaacccgtggtaacgggtacggtaacgtacggggtagtacggggaccgaaacccggttaacgaacggttccgggttaggaccgtaacgtaggggttcacggtttacccaacccgtaacgtttccggtaccccggggtagaaaacccgttacctttaacccggaataccgttaaacccgaaccgtttaaaccggttccccttaaccgaaacttaaaccttaaacccggagttaaacccccttagaacggttaaccgggtacgttaaagtacgggtacgaacccggttcaaaacgtcggttaccgaacggcggttaaaacgcccggggttcctaaccttttaaacgtaaccgttggaaaccgggctaaccccgggggtactttaaccccgggaccttttacggggaacccggtttacgaaccgttacccggggaacccggtaaccgggttcggtaccccggggttaccccttttaaggtttaccccgggaggggttaccccgggg

SEQ ID NO: 209415 - DNA, 616 bp, Homo sapiens
  misc_feature: GYAE6OF02FUCNL.17.25.C03.1.454.CMB.1.raw
  modified_base (292)..(292): a, c, t, g, unknown or other
  misc_feature (292)..(292): n is a, c, g, or t
  modified_base (305)..(305): a, c, t, g, unknown or other
  misc_feature (305)..(305): n is a, c, g, or t
  modified_base (466)..(466): a, c, t, g, unknown or other
  misc_feature (466)..(466): n is a, c, g, or t
  modified_base (484)..(484): a, c, t, g, unknown or other
  misc_feature (484)..(484): n is a, c, g, or t
tcagcgtagactagcacgaccggtgctcgatttagtagtgtagatttgggtttgggggactcaacaaccaacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcctggggcctcgagtggaacggtctccgtgcgaaggtcttctggattcgacgtttacctctatagtatcgaacgtgggtancgcctaggccgtntacggaacaacgacctggagtggatgggagtcggaccgaaccgtaacgacgtgggtactcgacgtagtcgttcttaccaccctagttcccgtaccggggactaacgtacttaccaatcgaacctacgaacctccctacaaactaaaccgacacgtcctaanagtaggtagttggaacgngtccagactacgtcgtacgaccgactaccgggtctacttaacttcgtagtcggcgaagtccgtacccgaggtacctccgggtagcggttaccgacggctacggcccgttctttacggacgttcgtaccgggg

SEQ ID NO: 209416 - DNA, 675 bp, Homo sapiens
  misc_feature: GYAE6OF02HW1N6.17.25.C03.1.454.CMB.1.raw
  modified_base (443)..(443): a, c, t, g, unknown or other
  misc_feature (443)..(443): n is a, c, g, or t
  modified_base (550)..(550): a, c, t, g, unknown or other
  misc_feature (550)..(550): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcgagtagaaggtctcctgcaggcttctggattcacgtttacctcctatagtatcaactgggtgcgccaggccgctggacaacgacctggagtggagtggggatcggggaccgaaccctaacgacgtggtgtcgacagtcgttcttccaacccagtcccgtccgggaacacgtaccttaaccagtacgacccaacgaacccttccctaaccgaaactaaaacccncgaaacgtccctaaacacgttagggtaacgtttgggaacggtacggcctacgacctaagttccgtaggacccgaaccgtaccgggcccgttacttacggttttaccnggttaccgggaccgtagtacccgggttaccccaacccgggttagtcccggggttagaccgtacccggttaccggacgtacgggtcccggttcccgttttaacggcccggtttcggtaccgggggg

SEQ ID NO: 209417 - DNA, 788 bp, Homo sapiens
  misc_feature: GYAE6OF02IHFDI.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcgagtgaaggtctccgtgacgaaggtcttcgaggtattctacgtttacctcctatagtatcaacgtgggtcgcgccgaggccgctggaaccaacgacctggagtaggacgtggggaagtcggggaccgaaaaccctagaacgttggtacgtacgagagtttcgtcctttaccaacccgtagtacccggttacccggggaactaaccggtaaccctttaaccgagttacccggaaccctaaacccggtaaccctttaccccgtaaaccaaaactaaaaacccgaaccgtacggtaaccccttaaacgtaaggttaacgggtacggtttaaggaaaccgggttaacgacccgttaccgaaaccgttattacccggttaacggaacccggtaccgtaacccgggtacccggttacttaaaccgtttaacgttgtaacgggtaccgtaaacggacccggttaccccgaacggtaacctacccgggggtataacccgggtacccgtaaccggggtccgtaacgggtcccgggtttacccgtttaggtacccggtttcccgggaaccggggggg

SEQ ID NO: 209418 - DNA, 596 bp, Homo sapiens
  misc_feature: GYAE6OF02FO4YN.17.25.C03.1.454.CMB.1.raw
  modified_base (281)..(281): a, c, t, g, unknown or other
  misc_feature (281)..(281): n is a, c, g, or t
  modified_base (537)..(537): a, c, t, g, unknown or other
  misc_feature (537)..(537): n is a, c, g, or t
  modified_base (559)..(559): a, c, t, g, unknown or other
  misc_feature (559)..(559): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggcctcagtgaaggtctctgcaaggcttctggattctacgtttacctcctatagtatacaacgtggtcncggcccaggccgtctggaccaacgacctggaggtggatggggagtggggaccgtaacccctaaagtcgtgggttacgttactagtcgttcttccgacccacgtcccgtccggaacacgtacgttaccattacgaaccacgaccctccaccaactaaaccacacgacctactactaggtagtcgacggtacgccgtagactatcctagacgaccgaccggtcctacgttactacgtgtacgcgagtacgaccctacncgtcggtagaccgccgtaccgngacgccggttaccttggaccgttcggtacggtaccgg

SEQ ID NO: 209419 - DNA, 759 bp, Homo sapiens
  misc_feature: GYAE6OF02IC98W.17.25.C03.1.454.CMB.1.raw
  modified_base (184)..(184): a, c, t, g, unknown or other
  misc_feature (184)..(184): n is a, c, g, or t
  modified_base (291)..(291): a, c, t, g, unknown or other
  misc_feature (291)..(291): n is a, c, g, or t
  modified_base (340)..(340): a, c, t, g, unknown or other
  misc_feature (340)..(340): n is a, c, g, or t
  modified_base (650)..(650): a, c, t, g, unknown or other
  misc_feature (650)..(650): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtncagtcgtggggctgaggtgaagagccgtgggcctcaggtgaaggtctcctagcgaaggcttcgtggacttctaccgtttacctccgtatagtatacgaacttggggntccgccgaggtccgcgttcggaaccgaaacgtacccgtaggagtagggngttacgggtaagtacggggaacctaaaaccccgtaaacgtaaccgttgggtacgtaacccgtacgtacggttacgttcccgttaaccctaaccctacgtccccggtaacccggggtaactaaccgtaaccccgtttaacccgaacgttacccggaaccctaaacggtaacccctacccctttaacccaaaaccttaaaaccaaccgtaaccgtacccttaaaccgacgttagggtaaccggttcggtaaggacgtacccgtagacctaagtccgtaacgtacgaactccgggtaccttgtaaaccttagngtacgacggtagacccggttaacccaggtaccctttaccggagggaaccgttacccgtaaggccggtacggtcccgggttacgttttactaccggttcggtacccgggg

SEQ ID NO: 209420 - DNA, 675 bp, Homo sapiens
  misc_feature: GYAE6OF02H2HOA.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtgacagcagctacaagtgccccactcccaggtgcagctggtgcaggtcgtggggctggaggtagaagaacgccgtggggcctcgagtgaaggtctccgtgacaaggtcttcgtggtacttacctaaccgttttaccctccttaataggtactactaacgtgggtcgccgccgaacggccgcgtggaaccaaccgacctggacggtaggagtggggagtcgggaacccgtaaaccgtaacacgtggtcgtacacgtaggttcgttccttaccaaccccgtattccccggtaccgggaactaacgtacctttaaccgagtaccgaacccaacgtaaccctccgtaaccaaataaaccacgactaccacgagtcggtaagtgaaggtcacctagacctatcgtacggaccaaccgtaccggtcgtaacttcttaaccgtgtacgaggtaactccggtacccaggaacggttccggtaggaaccgtaccgacggacgtaccggtccgttccgtttacgtacggttccggtacgggg

SEQ ID NO: 209421 - DNA, 573 bp, Homo sapiens
  misc_feature: GYAE6OF02GUYFF.17.25.C03.1.454.CMB.1.raw
  modified_base (246)..(246): a, c, t, g, unknown or other
  misc_feature (246)..(246): n is a, c, g, or t
  modified_base (280)..(280): a, c, t, g, unknown or other
  misc_feature (280)..(280): n is a, c, g, or t
  modified_base (360)..(360): a, c, t, g, unknown or other
  misc_feature (360)..(360): n is a, c, g, or t
  modified_base (426)..(426): a, c, t, g, unknown or other
  misc_feature (426)..(426): n is a, c, g, or t
  modified_base (486)..(486): a, c, t, g, unknown or other
  misc_feature (486)..(486): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaaggtctcctgcaaggcttcnggagcaccttcacgcgatatagttacagttgggngcggacgggcctcgtggacaaggccttggagtggaagtggggaaggtacgtcgtaccctagtcgttgacacaccaaatcncatacgaacgttccagggcagacctcacacgtaaccgacgtaacaaactaacgaacaacaacttancgtacggatacgtacgaagacgcctagtcatctagacgaccgacggtacttacgtacttntaggcgacgacgtagtacttctaacgtactacgtacgtccttacccgtttacgaccttccgttagtcctttggtccggtactacggg

SEQ ID NO: 209422 - DNA, 648 bp, Homo sapiens
  misc_feature: GYAE6OF02F5EWW.17.25.C03.1.454.CMB.1.raw
  modified_base (279)..(279): a, c, t, g, unknown or other
  misc_feature (279)..(279): n is a, c, g, or t
  modified_base (290)..(290): a, c, t, g, unknown or other
  misc_feature (290)..(290): n is a, c, g, or t
  modified_base (331)..(331): a, c, t, g, unknown or other
  misc_feature (331)..(331): n is a, c, g, or t
  modified_base (357)..(357): a, c, t, g, unknown or other
  misc_feature (357)..(357): n is a, c, g, or t
  modified_base (570)..(570): a, c, t, g, unknown or other
  misc_feature (570)..(570): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaggtctcctgcaaggcttctggattctacgtttacctctatagtatcaacgtgggtncgccaggccgntggacaacgcctgagtggatgggatgggcgaaaaaaccctnactggtagtcacagtgtcttcacccntccgcgggacagacttaccagtcaccacgtaacctcccgtacaaactaaaccacgacgtaccctacgacgtcgggtaagttaggaacggaacgtcccgttagaaccgtactcggtaacggaaccgtacgtaaccgggtccgttaccttaacggttacttacgggtacggcgtaaaggtacccggtcccccgtaaggtaccggtccggggttanaacccggttacccgtaaccggggtacacgggggtttccccggtaccgtttttcgggaccggttttccggaccgggggg

SEQ ID NO: 209423 - DNA, 1085 bp, Homo sapiens
  misc_feature: GYAE6OF02H2SI8.17.25.C03.1.454.CMB.1.raw
tcagcgtagactagcacgaccggtgctcgatttagtagtgtagatttgggtttgggagtcagtctcagtcaggacacagcaactggacatgagggtccccgctccagcctccgtggggctcctgctactctggctccgagctgccgagatgtacgactatcccagactacggacccagtcctccactccctccctgtctcggtccttggtgggtacgggggtacaggtacgtccgaacctactccgtacgttcggacccggtaactaaggtaccgaaccgggtaacttttaaaaccttaagttttaaaacgttcgggtaaccttaccgtaacggtaaccgtaaaacggtaaaacccgttaacgggaaaaaccggtcccccgtaaacggtacccccttaccgtacggtaccgttacccgttaggtacggttaccgaccttaacgttcccgtaaccggttcggtaaccggtacgggttaacgggacccgggtaccccgttaacccgtacggttccgggttaaggttacccggtaagggttccggggttaaccgtaagggtttaccgggaacccgttttccggggaaacggggtacccgtaaaacgggttttaaccttttaacccgaaaccgtttcccggtaaaccccggtaaacctttacccgtaacccccggtaacccttaaaccccgttaccgggtaacccgtaaacccgttaacccgggttagggttaaaacccgggtttaagtttcgggtaaaccggtaacccggttttaaaccttaccggttaaaccccttaacgggttaaaccgaaaccccgtttaaacgggtaaacccgggttttaacccgtttacccccggtaaccccggtttacccccggttaaccgtttaaccggttttttacccggggaaccgggtaaaacccccgggttaaggggggttaaaacccccttaaaggggttttcccgaaacccgggttaaccttaaaccccgggggtaaactacccggggtttaccgggacggtcccgttaaaccgggtacccccgttaacgttacccgttttccgggttaaacccggtttccccgg

SEQ ID NO: 209424 - DNA, 729 bp, Homo sapiens
  misc_feature: GYAE6OF02FL1WH.17.25.C03.1.454.CMB.1.raw
  modified_base (278)..(278): a, c, t, g, unknown or other
  misc_feature (278)..(278): n is a, c, g, or t
tcagcgtagactagcacgaccggtgctcgatttagtagtgtagatttgggtttggggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacgttaaaactattaaattggtatcagcagtaaacctggaaaacnccccagacctcctgaactctcgtaggtcgcagtcccactcgtagcgtaagtggcctaccatcggtaggtttaccaggtggcgagtagactcgtacggggactagtactttacgaaacttccgtactaacccattacccaaccgtaccgttctcggacctaacccgttaggaacggttctttaggtacgtaacctaacgtttaccgttaaccgttacgttaccgttaaccgaaaccgtacgggttaaacgtttaccgtaacccggtttttcccccgtaccgtaccgttttaaccgttttaccgggtaacccggtaacgggggttaaacccctaaagggttttacggaacgggtaaacctttaaacccgggtaaaaaccgtaccggttaggttaacccgggtacgttaaccggcccgttaaacccgtacttttaccggtttccggtttaaccc

SEQ ID NO: 209425 - DNA, 787 bp, Homo sapiens
  misc_feature: GYAE6OF02HKZ1V.17.25.C03.1.454.CMB.1.raw
tcagcgtagactagcacgaccggtgctcgatttagtagtgtagatttgggtttgggggaggtcagtctcagtcaggacacagcatggacatgaggtccccgctcagctcctggggctcctgctactctggctccgagctgccagtatgtgacattccagatgacccagtcctccatccctcctgtcgtgccttcgtgggtggggtcaggacgtcacctagtctaccgttggacccgactaacggtccgtaaccgggtaaccgtttaaaaaccttaagttttaaaagtttcggttaagttacgaacgacctaacgaaaacccgttaggaaaaaccgccccgtaacgtacccttccgtagtacttccgttacgttcgggtacgacctacgtacccaaccttacggtacggacgggtaaacggttccgggtaccgttacccgtaacgtttacgggtaggttttacggaacgggttaggacgttaagggtaggttaacgtacggttacgggaaacttacggttaactttaccgtaaacttaccgttaccgaaccgtacgtaaccctaccctaaccgttccgtacgaccctaacgtaggacgttaacgtttcggaagtacctaacttactttactacgttctaaccaacgtaacgttacgttacctaccgttaccctacgtaccgtttacggttaccggaacgtaaccgggtaactacggttcgtaacgtaacgtaaccgaaacggttacgtggtacgtacgtcgaaccgtagtaccgtacgttaccgttac

SEQ ID NO: 209426 - DNA, 561 bp, Homo sapiens
  misc_feature: GYAE6OF02GI3SB.17.25.C03.1.454.CMB.1.raw
  modified_base (129)..(129): a, c, t, g, unknown or other
  misc_feature (129)..(129): n is a, c, g, or t
  modified_base (291)..(291): a, c, t, g, unknown or other
  misc_feature (291)..(291): n is a, c, g, or t
  modified_base (319)..(319): a, c, t, g, unknown or other
  misc_feature (319)..(319): n is a, c, g, or t
  modified_base (337)..(337): a, c, t, g, unknown or other
  misc_feature (337)..(337): n is a, c, g, or t
  modified_base (417)..(417): a, c, t, g, unknown or other
  misc_feature (417)..(417): n is a, c, g, or t
  modified_base (431)..(431): a, c, t, g, unknown or other
  misc_feature (431)..(431): n is a, c, g, or t
  modified_base (437)..(437): a, c, t, g, unknown or other
  misc_feature (437)..(437): n is a, c, g, or t
  modified_base (456)..(456): a, c, t, g, unknown or other
  misc_feature (456)..(456): n is a, c, g, or t
  modified_base (491)..(491): a, c, t, g, unknown or other
  misc_feature (491)..(491): n is a, c, g, or t
tcagcgtagactagcacgaccggtgctcgatttagtagtgtagatttggtttggggacgtcaacaaccacatactgtcctctagagaaaccctgtgagcaccagctcctcaccatggactggacctggnggatcctcttcttggtggcagcagctacaagtgcccactcccaggtgcagctggtgcagtctgggctgaggtgaagaagcctggggcctcagtgaggtctcctgcaaggcttctggattcacgtttacctcctatagtatcaactgggtgacgccaggccgngtgggcaacgaccgtgagtcggatgggntggggacaaccccgtaanaccgttggtctacgacgacggttgttccttaccacccgatccgtacccgggactacgtacttaccatcgaccacgtaacncctacataacacanccctanatggattggagtacgcctnactatcgagacacgacgctctattactcgtagacngtaccaccaggactccggtgtaccgccgtaacggtcacggtccgtccctttaaggcctttccggacgggg

SEQ ID NO: 209427 - DNA, 674 bp, Homo sapiens
  misc_feature: GYAE6OF02IY9RE.17.25.C03.1.454.CMB.1.raw
  modified_base (285)..(285): a, c, t, g, unknown or other
  misc_feature (285)..(285): n is a, c, g, or t
  modified_base (290)..(290): a, c, t, g, unknown or other
  misc_feature (290)..(290): n is a, c, g, or t
  modified_base (494)..(494): a, c, t, g, unknown or other
  misc_feature (494)..(494): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagccgtggggcctcgagtgaaggtctccgtgcgaaggcttctggattctacgtttacctctatagtatcgaactgggtncgcgnggccgctggacaacgaccgtgagtggagtggagtgggaccgaacctaacacgtggtcgtacacgtagtcgtccttaccgacccgtagtcccgtcgggtaaccacggtacccttaaccgagtaccggaacccaccggtaaacccttccctaaccgtaaactaaaccaccgtaccgaccctactagtcggtaggttacgaggtacnccgtacgactacgtcgtagaccgtaccgccgggtacgttacttaacgttaccggtgtacgaccggtacgtaccgtacccggtaaccggcggttacccgggtacggaaccggtcccgtaaccccggggagtacccgggttaccggttcccgtttaggtaccccggttgggtaccccggggg

SEQ ID NO: 209428 - DNA, 643 bp, Homo sapiens
  misc_feature: GYAE6OF02IOUQ8.17.25.C03.1.454.CMB.1.raw
  modified_base (282)..(282): a, c, t, g, unknown or other
  misc_feature (282)..(282): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagaagccgtggggcctcgagtggaacggtctcctgacgaaggtcttctggtattctacgtttacctcctatacgttanctaaacgtgggtcgcgccgaggcccgctcggacaaccgacctggaggtggagtggggagtacggggaccaaaccctaacgtacgttggcgtcacgagttcgtctccaaccctatcccggtccggaactacgtacttaccgaagtcgaaccctacgtaacctccctaccaaactaaaccacgtaacgtaccaacgtacgtaggtaagttcggaacggtacgtccgtagaaccatcgacggaaccgaacgaccgtacggtcttaaagttcgtagtacgacgaacgtacgacccgtagtacgtccggtagaaccgtccgtaacggcgtacggtccggttacttacggtccgttacgggtacggg

SEQ ID NO: 209429 - DNA, 784 bp, Homo sapiens
  misc_feature: GYAE6OF02IO02D.17.25.C03.1.454.CMB.1.raw
tcagcgtagactagcacgaccggtgctcgatttagtagtgtagatttggggtttgggagtcagtctcagtcaggacacagcatggacatgagggtccccgctcagctcctggggctcctgctactctggctccgagctgccagatgtgacatccagatgacccagtctccatcctccctgtctgcctcgtggtgggggtcagagtcaccatcacttcggaccggacaagtccgacggtaacgtttaaaaccttattttaaagtaggttatacgaagacaaacggtaaaacctagggaaaaaccgccccaagtaccttccgtagtacttccgtcgtaggtacgactacctacctaacttccgtaggacggtaaggtccgggtaccgtaccccgtagtaccggtacggttctaaggggtcggaccgtaggggttacggaacttacgggtaaggggtaactaacggttacttttaaaccgaaactttccgtaacctaacccaacttacccgtaaaccccttaacgtccgtaaccgtaaaccgttaaacccgtaggggttaaacggttattacgggtaacgtaaccttaaacgttaccctttaacgtaaccgttaactaaccgtaaagttaacggtttaaccgttaacccgttacccgtttaccccgtacgtaccgttttaaccgggtttaccggaacgggtaacgggtaacctaggtacggaactaagtaaccgtaacggtaatcgggtacgaccgtacggactaacccgtattccgttacgttacc

SEQ ID NO: 209430 - DNA, 716 bp, Homo sapiens
  misc_feature: GYAE6OF02IR89N.17.25.C03.1.454.CMB.1.raw
  modified_base (100)..(100): a, c, t, g, unknown or other
  misc_feature (100)..(100): n is a, c, g, or t
  modified_base (482)..(482): a, c, t, g, unknown or other
  misc_feature (482)..(482): n is a, c, g, or t
  modified_base (560)..(560): a, c, t, g, unknown or other
  misc_feature (560)..(560): n is a, c, g, or t
  modified_base (704)..(704): a, c, t, g, unknown or other
  misc_feature (704)..(704): n is a, c, g, or t
tcagcgtagactagcacgaccggtgctcgatttagtagtgtagatttgggtttgggagtcagtctcagtcaggacacagcatggacatgagggtccccgntcagcctcgtgggctcctgctactcgtggcctcggagctcgccgagagtgtgaactactaccgagtactcgaccctagtcctcctactccctcctgtcgtccgtcctcggtgggtggggtacaggtactaccactactcctacgtcgaccggtaacaacgtccgaaccggtaactttaaaaccttaagtttaagtacggtactacgagtaccgaaacggtaaaccgtaacggaaaccccgccctaacgtacccttcgtacgtacttccgtacggtggtcactaccctccactcggtcggaacgtacggtccgtacccgtacctggtacggtgtacgaggtgaacggtgacgtatcggagatacgttacttacgactcaccanactacccgtaacctgtaccacgttaccgaacgtaggtacgtaacgttcgacttacgtaaccttcttaccgttaccgtntaaaccggaagttaccgttaccttaccgtacccgtttaccccgtacttacgtttacccggtaggaacccgggttaacgggtaaccttaaggtcgtaacgtaacctaacggtacgtacgttgaaccgtcgaccgtaccacggttntacgtcttaccg

SEQ ID NO: 209431 - DNA, 758 bp, Homo sapiens
  misc_feature: GYAE6OF02F0IO2.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcgtggacttctaccgtttacctcctatagtactcaactgggtgcgccaggccgctggacacgacctggagtgagtgggagtcgggaccgtaaccctaagacgttgggtactccagtgttcgtcctttaccaccctactcccgtacgggaactacggtacctttaccgacgttcgaacccacgtaaccgttaccctaccgaaacttaaaaccaccgtacgtaaccccgttaactaacggttacgggtaaggtttacggaacgggttaaccggacccgtttacggaaaccttaacgttaccggttaacgaacccgggttaacccgacccggggttaccccgttacgtttaaccgtttacgtacgggttaccgaaccgggtaacggttacccgttccccgaaaccgggttcccggtttacccgggtaggtaacccgtaccccggttaaacggggccgtaaacccgggtcccgggtttaacccgtttccggttaccggtttacccgggtacccggggggg

SEQ ID NO: 209432 - DNA, 672 bp, Homo sapiens
  misc_feature: GYAE6OF02F930M.17.25.C03.1.454.CMB.1.raw
  modified_base (226)..(226): a, c, t, g, unknown or other
  misc_feature (226)..(226): n is a, c, g, or t
  modified_base (233)..(233): a, c, t, g, unknown or other
  misc_feature (233)..(233): n is a, c, g, or t
  modified_base (269)..(269): a, c, t, g, unknown or other
  misc_feature (269)..(269): n is a, c, g, or t
  modified_base (283)..(283): a, c, t, g, unknown or other
  misc_feature (283)..(283): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagcgtggtgcagtcgtggggctggaggtgaagagccgtgggcctcaggtnaaggtcncctgacaggtccttctggtattcctacggtttaccnccttatacgtactnaacgtgggtgcgccgtaggccgctagggaccaaccgccgttaggacggtggtacgtggggagttcgggacctaaccctaacgtcgtgggtacgtcacgtgtcgttacttcaccctagtcccgaccgggtacacgtaccttacgactacgaccaccgtaacctaccctacgaaactaaccaccgtacctccgtaactacgtagggtacgttaggaacggtacgtccgtaacggtactacggttccgtaacgggaacccgtaccggacccgggttacccttattacccggtttaagtcgttaaggccgaagtacccgacccgtaggaccgttcggtacgaccgtaccgtacgcgtaacggtccttatttacccgggtactccgggtacggg

SEQ ID NO: 209433 - DNA, 852 bp, Homo sapiens
  misc_feature: GYAE6OF02FP3J2.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctgggctcctgctactctggctccgagctgccagatgtagacactccagatgacccagtcctccactccctccgtgtctacgcctgtggtcggggtacaggacgtccaacctatacctacgttcggacccggaactaacgtaccgtaacgggtaaaccgttttaaaaacctttaagttttaaaacgtttaggttaacaccgtaacggaccgtaaaacggtaaaaacccgttaacgggaaaaacccgtcccccgtaacggttaaccccttcccgttaggtaaccttcccggttaccggttagggtaacctaccgtaaccttacccctaccgtttaccggttcggaaaccggtaacgggtttacccgggtaccccgttacccgtaaggttaaccgggttaacgggtttcgaaacgggtttcggaccgttaaagggtacggtacttacgggtaacgggaaaccttaagttacttttacaaacgtttacctaccgaccttacgtacccaacctacgtactacgacctaccgtaggtacgtatttggacgactaaaccgtttacctaaaccgttgtaacggtaccctaaagaacgtttaccgttaacccgttaccgttaccccgttaccgttaaccgtttaccgtttaaccgggacggtaaacggtaacgttaacgtagaacgttaacaaaccgtaaacgttacgtaggtacgacttaccgactaacctattacggttcttaacccgg

SEQ ID NO: 209434 - DNA, 685 bp, Homo sapiens
  misc_feature: GYAE6OF02FZVV9.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctccttatagtatcaatgggtgcgccaggccgctggacaacgacctggagtggatgggagtgggccgaaaccctaacacgtgggtgtcacgagtcgtccttacaccccatcccgtaccggggactagtaaccttacccagtcgaccaaccgaactccctaccaacttaaaaccacacgtaccctaacacgtacgggtaagttaggaacggggtacgccccgttagaacctagttaccgttacggaaccggtacccggaacccgggtcccgtttacttaaacgtttaacgtcggtacgggaccgtaagggaccgttaccccgtaaccggtacgttccccgggggtacgaccggtaccccgttaacggggccgtaccgggtcccgggtttacccttttacgggacccgttttccgggtacccggggggg

SEQ ID NO: 209435 - DNA, 752 bp, Homo sapiens
  misc_feature: GYAE6OF02F7YY8.17.25.C03.1.454.CMB.1.raw
  modified_base (724)..(724): a, c, t, g, unknown or other
  misc_feature (724)..(724): n is a, c, g, or t
tcagcgtagactagcacgaccggtgctcgatttagtagtgtagatttgggtttggggactcgaacaaccacatctgtcctctagagaaaccctgtgagcacagctcctcaccagtcgactggacctggagggactccttcttcgttgggtagccagcagctacaagtcgccctactcccgaggtgccagtcgtggtcgactacgtggttgggcttggaggtagacgacgcgtgggaccttcgaggtacggaagtctccgtagactaaggtcttacgtggtactacccgtaccggtttacctaccgttaagttacgtaacgttacctaaccggttcgggttaacgcccgaccggtaacggtccccggtttaataccgggggaaacccttaaccggacccgttagggtaaaccggtcgggttacggttacgggaacgtttaccggggaaacccggttaaacccctaacgggtcggtttacgggtacgtttaccgaggttaacggttcgtttacccggttaacctaccccgttaacggtacccccggttacgggaaccgtacttaacccgttaaccgacgtacggacctaaccgtacgtaccctacgactaacacgtacgacttacgtgtacgtagtagacggatcgtactacgtagcgtacgaccgtacgaccggttcctacgtactcgtgtacgacgtagcaccgtgtacgcggcgacgtaccgngacgtcgtcggtacttcgactcggtacg

SEQ ID NO: 209436 - DNA, 740 bp, Homo sapiens
  misc_feature: GYAE6OF02I1O2I.17.25.C03.1.454.CMB.1.raw
  modified_base (150)..(150): a, c, t, g, unknown or other
  misc_feature (150)..(150): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagnagctacaagtgcccactcccaggtgcagctggtgcagtcgtgggctggaggtgaagagccgtggggcctcgagtaggaaggtcctccgtgacgacggtcttcgtggtacttcctacgtttaccctccgtatacgttatcctaacgtgggtcgaccgccgtacggtccgcgtacggacaacgtaccgtaggaggtcggtagtagggagtcgggacctaaccgtaacgacgtggtacgtcacgtgtcgtcttccgacctacgttcccgtacggacgtacgtaaccttaccgacgttaccgaaccctaaccgtaaccctccctaaacaaccgttaaaaccaccgtaaccgtacctaacctaaggttcgggtaagttacgggaaggtaccgtaccgtacggtaacctaggttacccaacggtaacggtacccgtacccgggttacccggttaaccttacgttttaaccgtcggttacggacggtacggtccgtaaccccgaacggttaccggtccgggttacggaacccggttaccgtaaccggtacggtcggttacccgttcggtttaacggtcccggtttcgggacccgggg

SEQ ID NO: 209437 - DNA, 641 bp, Homo sapiens
  misc_feature: GYAE6OF02GHVIN.17.25.C03.1.454.CMB.1.raw
  modified_base (261)..(261): a, c, t, g, unknown or other
  misc_feature (261)..(261): n is a, c, g, or t
  modified_base (281)..(281): a, c, t, g, unknown or other
  misc_feature (281)..(281): n is a, c, g, or t
  modified_base (347)..(347): a, c, t, g, unknown or other
  misc_feature (347)..(347): n is a, c, g, or t
  modified_base (555)..(555): a, c, t, g, unknown or other
  misc_feature (555)..(555): n is a, c, g, or t
  modified_base (584)..(584): a, c, t, g, unknown or other
  misc_feature (584)..(584): n is a, c, g, or t
tcagcgtagactagcacgaccggtgctcgatttagtagtgtagatttgggtttggggactcaacaaccacatctgtccctctagagaaaaccctgtgagcacagctcctcaccatggactggacctggaggatcctcttcttggtggcagcagctacaagtgcccactcccaggtgcagctggtgcagtctggggctgaggtgaagagcctggggcctcgagtgaaggtctcctgcaaggcttctggattcacgtttaccncctatagtatcaactgggtnccgccaggccgctggaccaacgacctggagtggagtgggatgggccgaaaccctacgacttgggtntacacgtagtcgtccttaccaacccctacgttccctaccggggaacctacggtacccttaccacgtacgacccacggaaccttaccccgtaccaaacgttaaacccacgacgtaccctaacacgtagggagttacggaggtacgaccttgacctagtctacggaccgaacgtaccgggtccctattaacgtttccgtaggtggcgtanaccggtacccgtacggcgttccggggtanaccggtacctagggtccacggtcccggtccttttacggtaccgttgggtaccggggg

SEQ ID NO: 209438 - DNA, 749 bp, Homo sapiens
  misc_feature: GYAE6OF02IPIDI.17.25.C03.1.454.CMB.1.raw
  modified_base (252)..(252): a, c, t, g, unknown or other
  misc_feature (252)..(252): n is a, c, g, or t
tcagcgtagactagcacgaccggtgctcgatttagtagtgtagatttgggtttggggactcaacaaccacatctgtcctctagagaaaacccctgtgagcacagctcctcaccatcggactggacctggaggatcctcttcttggtggcagcagctacaagtgcccactcccaggtgcagctggtgcagtcgtggggctggaggtgaagagccgtggggcctcaggtgaaggtcctcctgcgaaggtcttgnggattctacgtttacctctatagtatcaagtggtcgcgccgaggccgtcgtacggaaccaacggaccgtaggacggtgggaacgtggggagtcgggaaccgtaaccctaacgacgtggtagacacgtagttcgtacttccacctacgtcccggtaccgggactaacggtaccttaaccgtactaccggaaccctaaccggtaacccttaccccgtaacctaaaccttaaaacccgaccgtaccgtaacccttaacgtaacgttacggttaggttaacgggacggtaccgtaccgttacgaacccgttacgtaccgtaacggaaccccggacgtaacccgggaccgtttaccgttaaacgtttacgttcggttacgggacgtaccggaccgttaccccgtaacggccggttaaccgggtacggtacggtacccggtaacgggtaccgtacgggtacccgggtttaccgtacggtttaccggttccgggtaaccggggg

SEQ ID NO: 209439 - DNA, 793 bp, Homo sapiens
  misc_feature: GYAE6OF02HP2TB.17.25.C03.1.454.CMB.1.raw
tcagcgtagactagcacgaccggtgctcgatttagtagtgtagatttgggtttgggagtcagtctcagtcaggacacagcatggacatgagggtccccgctcagctccgtggggctcctgctactctggctccgagctgccagatgtgacactccagactcgacccagtcctcctactcccttcccgtgtctcgtcctcgtggtgggggtcaggtacgtccaccatcaccgttcggaccggacaacgtcgaaccggttacgttaaaaccttagtttaaaagttcggtaactacgaacgtactaaacggtaaaaccgtaacggaaaaaccgtcccccgaagtaccccgttcctagtacctccgttacgtgggtacaccgtactaccctaaccgtcgtacggaccgaaggttccggtacccggtacccaaggttaccggtaaggttacgaggtacgggacgtagggtaggaacgttcgggtaagggaacgtaacggttactttaaccgaacttccgtaaccgaacctactacccgtaaccctacttcggtacctaacgtaaccgttacggaagttacgttcgtacgtaaccttaacgtacctttacgtaaacgttacgtaacgaacgttaaacgttaccgtttaaccgtcccgttaaccgtccgtttaaccgttagttaccggaaccggtaacgggttaaaccgtaggtacgtaacggtaaacctaaccgtaaacggtaacttggtaccgtaccggttacgaacccgttaaccgtctttccggtaaccttacccg

SEQ ID NO: 209440 - DNA, 649 bp, Homo sapiens
  misc_feature: GYAE6OF02G4G2D.17.25.C03.1.454.CMB.1.raw
  modified_base (442)..(442): a, c, t, g, unknown or other
  misc_feature (442)..(442): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctcgagtgaaggtctcctgcaaggcttcgtggacttcgacgtttacctcctatagtatcaactgggtgcgccgaggccgcgtggaccaacgacctggaggtggagtgggagtcgggaccgaacccgttaacacgtggtcgtacacgtagtcgttctaccaccctacgtccgtaccggaacacgtaccttaccgagtcgaaccgacgaacttcccgaccaactaaaccncaacgtacctaacaacgtggtagttacggaacggtacgtctacgactatcgacgaacgccgtaacggtcccgttacttaacgtttacgacgtacgacgtaacggaccgttaccccgtaacggtaaccgttccgggaagaaccggtacccggtacggaccgtaccggcccggttacccgtttcgtaccggtttccgggtacccggggg

SEQ ID NO: 209441 - DNA, 761 bp, Homo sapiens
  misc_feature: GYAE6OF02JUWKQ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagacgccgtgggcctcagtgaagtctctgcaggtcttcgtggtacttctacgtttcctctatagtatcaagtgggtcgcgccgaggcccgtcgtacggaacctaaccgaccgttaggaggttcggacgttggggtagtcggggacccgaaaacccgttacgtacgtcggttgtaccgaacgtaggttacgttacccttccgtaacccctacgtcccggttaccggggaactaacggtaccctttacccagtacgacccgaacgtacctacccgtaactaaacgtaaacccacgtacgtacccgtaactagtacggtaacggttcggaacgggtaccgtcccgtagaccgtagtccgtaagtaccgaccgtacccggtccttaacgtttaccgttacgtcggtaccgtacgggaaccgttccgtaaccccggttaacggtaacccgggtttccgggtaacgtacccgggttaacccgtaaccgggggtaaccctccggggttaaccggttttccccgtttaacggggttacccgtttaccggggtaacccggggggg

SEQ ID NO: 209442 - DNA, 764 bp, Homo sapiens
  misc_feature: GYAE6OF02JE2E7.17.25.C03.1.454.CMB.1.raw
  modified_base (732)..(732): a, c, t, g, unknown or other
  misc_feature (732)..(732): n is a, c, g, or t
tcagcgtagactagcacgaccggtgctcgatttagtagtgtagatttgggtttggggactcaacaaccacatctgtcctctagagaaaaccctggtgagcacagctcctcaccatggactggacctggaggactcctcttcttggtggcagcagctacaagtgccccactcccaggtgcagctggtgcagtctggggctgaggtgaagagccgtgggcctcgagtgaaggtctccgtgacaaggccttacgaggattctacgtttacctcctatagtactactaaacgttggggtacgcgtacccgagggtcccgtaccgttacggggacctaaaacggtaccccgttaggaacggttacgggtagtaccggggtaagtacgggggtacccgtaaaacccccgttaaacgtaaccgtacgggtttcggtaaccaacgtaaccggtttcgttacccttttacccgaaccccgttaacgttccccggtaaccggggtacccgtaacggttaaaccctttaccccggaaactttagggaaccccctaaaggttaaaccctccccgttaaccaaacgttaaacccgaacctaacggacccttaaaccgaccgttacgggtaagttcgggtaaaggacgacccgtagtaccaacgtcgtagaccgacaccgtccgtacgtaacttcgtacgtcgcgtacgtacgtacccaggtaacctcggataccgacgtaccggngtaccgccggtccttaacgtcgtcgtacgggg

SEQ ID NO: 209443 - DNA, 619 bp, Homo sapiens
  misc_feature: GYAE6OF02HROUS.17.25.C03.1.454.CMB.1.raw
  modified_base (281)..(281): a, c, t, g, unknown or other
  misc_feature (281)..(281): n is a, c, g, or t
  modified_base (293)..(293): a, c, t, g, unknown or other
  misc_feature (293)..(293): n is a, c, g, or t
  modified_base (318)..(318): a, c, t, g, unknown or other
  misc_feature (318)..(318): n is a, c, g, or t
  modified_base (349)..(349): a, c, t, g, unknown or other
  misc_feature (349)..(349): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtcctccatcctccctgtctgcctcgtggtgggggtcagagtcaccatcacttcgaccggacaagtcgacggtacttaaaacctatttaaattggtatcagcagaaacctggaaaacncccagacctctnactctcgtggtgctactccactcgngacgaagtcggcctccagttcggaggttacnggtggacaggtggtactcgtacgggactagttacttacaactcctacaacctactacccacctacgtcctacgtacctaaaccgtaggaagtactttacgacgtactaactccgttaacctacgtactaacgaacgtacgttaacgttaccgttacccgttcccgtacgtacccgttacggtttaccggaaccggtaacggaacgtaggtacgaacgtaacgtaaccgaaacgtacgtaggtcgtactacgacctactcttcgtcttacc

SEQ ID NO: 209444 - DNA, 734 bp, Homo sapiens
  misc_feature: GYAE6OF02FRHFO.17.25.C03.1.454.CMB.1.raw
  modified_base (220)..(220): a, c, t, g, unknown or other
  misc_feature (220)..(220): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctgaggtgaagagccgtggggccncgagtgaaggtcctccgtgacgtaaggcttcgtggtacttctacgtttacctctatagtactacaacgtgggcgcgaccgacggccgtcgtacgggaaccaaaccggtccgtaggtagggtcgggtaaggtgggggaacgtcgggggtaacccgtaaacccgtaaacgtaccggttgggttccgttaccaacgtcgttgtcccttaccacccctcgttacccgtaccccggggaactaacggtacccttacgacgtaccgaacccgtaaccgaacccgtccctaacctaactaaaccgacaaccgtacctacacgtaggtacgttggacgtacgtccgagtccgtataccgtacggaccgacggtaccgtccgttacgtacgtttccgtcggttacgtacggaccgttaccgtaccccggtacgaccggttaccggtacggtaccgtcccggtaacgggcccgtaccggggtcccgttccgggttttacggtacccggttcgggtaacccgggg

SEQ ID NO: 209445 - DNA, 597 bp, Homo sapiens
  misc_feature: GYAE6OF02IEYZ7.17.25.C03.1.454.CMB.1.raw
  modified_base (162)..(162): a, c, t, g, unknown or other
  misc_feature (162)..(162): n is a, c, g, or t
  modified_base (205)..(205): a, c, t, g, unknown or other
  misc_feature (205)..(205): n is a, c, g, or t
  modified_base (212)..(212): a, c, t, g, unknown or other
  misc_feature (212)..(212): n is a, c, g, or t
  modified_base (288)..(288): a, c, t, g, unknown or other
  misc_feature (288)..(288): n is a, c, g, or t
  modified_base (306)..(306): a, c, t, g, unknown or other
  misc_feature (306)..(306): n is a, c, g, or t
  modified_base (316)..(316): a, c, t, g, unknown or other
  misc_feature (316)..(316): n is a, c, g, or t
  modified_base (323)..(323): a, c, t, g, unknown or other
  misc_feature (323)..(323): n is a, c, g, or t
  modified_base (332)..(332): a, c, t, g, unknown or other
  misc_feature (332)..(332): n is a, c, g, or t
  modified_base (354)..(354): a, c, t, g, unknown or other
  misc_feature (354)..(354): n is a, c, g, or t
  modified_base (363)..(363): a, c, t, g, unknown or other
  misc_feature (363)..(363): n is a, c, g, or t
  modified_base (386)..(386): a, c, t, g, unknown or other
  misc_feature (386)..(386): n is a, c, g, or t
  modified_base (392)..(392): a, c, t, g, unknown or other
  misc_feature (392)..(392): n is a, c, g, or t
  modified_base (457)..(457): a, c, t, g, unknown or other
  misc_feature (457)..(457): n is a, c, g, or t
  modified_base (482)..(482): a, c, t, g, unknown or other
  misc_feature (482)..(482): n is a, c, g, or t
  modified_base (487)..(487): a, c, t, g, unknown or other
  misc_feature (487)..(487): n is a, c, g, or t
  modified_base (509)..(509): a, c, t, g, unknown or other
  misc_feature (509)..(509): n is a, c, g, or t
  modified_base (568)..(568): a, c, t, g, unknown or other
  misc_feature (568)..(568): n is a, c, g, or t
tcagcgtagactagcacgaccggtgctcgatttagtagtgtagatttgggtttgggggactcaacaaccacatctgtctctagagaaaaccctgtgagcacagctcctcaccatgactggacctggaggatcctcttcgttggtggacagcagctacaagtncccacgcccaggttcaggttggtgcagactggggctgacggtncagaacncgtggcatcagtgactgtctacctgcctaaggccaagtggatatagtctacaacaaactagtgaatagaattcggntcgacacggccccggaanacgggctggnggtgggngggtggtcngcgttcttggaacggaacggtnacgtagtancgacaaccgaagtatgggaaagnaaggancgtaagaacttaccaaccggtaacccaaacccccgtcgaaactaacgacgtctaacgattacganacgtgaaacctgtacctgaagcgtnacganaccgaccgtcgacttacgtacngttaccgacgactaaggttgtttaccgtgtacgtaacgttacggttaaccaagttttanaacgtacgtattacccggtattaaccggg

SEQ ID NO: 209446 - DNA, 789 bp, Homo sapiens
  misc_feature: GYAE6OF02GWOCR.17.25.C03.1.454.CMB.1.raw
  modified_base (615)..(615): a, c, t, g, unknown or other
  misc_feature (615)..(615): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatctcttcttggtgcagcagctacaagtgcccactcccaggtgcagctggtgcagtcgtggggctggaggtagaagaacggccgtggggcctcgagtgtaacggtcctcgtacgacgaaggtctttcgtggtactttccgtaccgttttacctccgttaattaacgttactactaacggttgggtcggccgtaccgtacggcccgtaccgtacgggaacctaaccggaccgttggaaggttggaaggtggggtacgttacggggaccgaaacccgtaacgtacggttggtacgtacaaccggtaggtttccttacccgttaccaacccctacgtcccggttaaccgggtacctaacggttaaccttaacccgacgtttaaccgaacccgtaaccgtaaaccccttcccgaaaccttaaacaaaaccgaccgtaaccgtaacctaacgtagggtacgtaagggttacggaacgggtaccttaccgngtaaacgtcgtaccgtaacgggacccgaccgggttacccgtcggtttaaccttaacgtttcgtagtcggacgtacgcccggtaccctacggttaacgtccgggtaacgaccggtacccgacggaccggtacgggttcccgttaccggttttacggtccgttacgggtcccgggg

SEQ ID NO: 209447 - DNA, 713 bp, Homo sapiens
  misc_feature: GYAE6OF02F3YHR.17.25.C03.1.454.CMB.1.raw
  modified_base (185)..(185): a, c, t, g, unknown or other
  misc_feature (185)..(185): n is a, c, g, or t
  modified_base (248)..(248): a, c, t, g, unknown or other
  misc_feature (248)..(248): n is a, c, g, or t
  modified_base (265)..(265): a, c, t, g, unknown or other
  misc_feature (265)..(265): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccacctcccaggtgcagctggtncgagtcgtgggctggaggtagaagagccgtgggcctcgagtgaggtctcctgacaggtcttgngtacttcacgtttaccnctatatatcaacgtggtcgcgccgaggccgtgtacggacacggcctaggacggtggagtgggtacgtcgggaacccgtaaacctaacgtacggttggtctacgacgtaggttcgttacccttaccgaacccctcgtcccggtaccgggaactaccgtaacccttaccgaactaccgtaacccgaaccttaacccttccctaaacgtaaactaaacccgaccctaccgtaccctaaagtcggtaaggtacgttaagggacacggtccctaggtacctacgtcgtaacggacgttccggtacccgttcgttacttaaccgttcgtaggacgttacgaccggtacccacccgttaacggtcccggttcgggtaacgcccgttacccggtaacgggccgttaaccgggttcccgtttaacggtttaccggaccggttacgggtacccggggg

SEQ ID NO: 209448 - DNA, 752 bp, Homo sapiens
  misc_feature: GYAE6OF02I497R.17.25.C03.1.454.CMB.1.raw
  modified_base (167)..(167): a, c, t, g, unknown or other
  misc_feature (167)..(167): n is a, c, g, or t
  modified_base (302)..(302): a, c, t, g, unknown or other
  misc_feature (302)..(302): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtcnccactcctccctgtctgcctctggtgggggtcagagtcaccatcacttcgaccggacaagtcaacggaacgttaaaaaccttatttaaacgttggtatacagacaacgaaacctaggaaacgccccagacctccngatctctggtcgctatccactcgtacgacgaacggttacggccgttaccaagtcggaacgggtttacaagggtcggacgtaggtacggtacgtcggttacgggaactaaggttaacttttacgaaattcccgttaccgaaacctacgtaaccctaaaccctaacctccgtacggtaaaccctaaaccgtacgggtaaacgggttaatttacgggtaaccgtacttaaacggttacccttaacgtaacgttagtaaccctaaacggtacgttaacgtttaccgtaaccgtttcccctaccggttaaccgttaccgggttttacccggaacccggtaacggggtaaacccttaaaggttcggtaaacgtaacgtaaaccgtaaaacccggtattaacgggtaccggttaacgtcggtaacctaacgtttaccgttacgttaccgtttacccg

SEQ ID NO: 209449 - DNA, 953 bp, Homo sapiens
  misc_feature: GYAE6OF02I4GX1.17.25.C03.1.454.CMB.1.raw
  modified_base (237)..(237): a, c, t, g, unknown or other
  misc_feature (237)..(237): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctaacaagtgccccactcccaggtgcagctggtgcagtcgtgggctggaggtgaagaagccgtggggcctcagtgaaggtctccngacaaggcttcgtggattctacgtttacctcctataagtatacgaacgtgggtgccggaccgtaacgggcccgacgttacgggaacctaaaccggacccgttaggaacggttacggggaagtttcgggggaagttacgggggaaccccgtaaaaccccgtaaaaccgtaccggttacggggtagtaacccgaaaccgtaagggtttcggtttaccctttacccgaacccccgtaacgtttcccccggttaacccgggggaacctaaaacgggttaaaccccgttttaaaaccccgaaggtttaacccgggtaaaccccgtaaacccggtaaaaaccccgtttcccccgttaaaacccccgaaaacgttaaaaaaccccgtaaacctaaaccgtaaccccgttaaaccgtaaacggttacggggtaacggttttaacgggaaaccgggggtaccgtaaccccgtttacgaaaccgtaaaccgtttaccgttaaccgggaaacccggtaaacccggaccccggggtaacccgttttacccgttttaaagttaaccgttacgggttacggaacccggttaacggtaacccgggttaacccccgtaaacgggtaaccggttacccggggtaacgggtaacggtaccccggttaaccgggccgttaaaccggggtcccggttacccgtttttacggacccggttttcggtaacccgggggg

SEQ ID NO: 209450 - DNA, 816 bp, Homo sapiens
  misc_feature: GYAE6OF02ILENC.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtcgcccactcccaggtgcagctggtgcagtcgtgggctggaggtgaagaagccgtggggcctcgaggtgaaggtctccgtgacgaaggtcttcgtggacttctaccgtttacctccttatagtatcaacgtgggtcgaccgccagggtcccgcgtacggaaccaacggacctaggaggttagggagtggggacgttacgggggacccaaaccccgtaaacgacgttgggttagtccaacgtacgttcgttaccttacccgaacccctacgtcccggttcccggggaactaacgtaacctttacccgaagtccgaacccgaaaccggaacccttaccctaccctaaaacgtaaaccaaccgtaacgacccttaacaacggttcggtaaggtttagggaacggtaccggtacccgttaacggaacctacttaccgtaacggtaacccggtaacccgacccggggtacccgttaccgtttaaacgtttaacccggttacggtaccggtaaccgggtaacggaacccgtttaacccccggtaccgggtaaaccggttcccggggtaacgtaacccggggttccccgttaacgggaacccgtaccggggtccccggtttacccggttttacggttacccggtttacgggtaccccgggggg

SEQ ID NO: 209451 - DNA, 806 bp, Homo sapiens
  misc_feature: GYAE6OF02JQZYC.17.25.C03.1.454.CMB.1.raw
tcagcgtagactagcacgaccggtgctcgatttagtagtgtagatttgggtttgggactcaacaaccacatctgtcctctagagaaaaccctgtgagcacagctccctcaccagtggacgtcggaccgtggaggatcctctttcgttggtggcagcgagtactccgttacccccggtggaacgtcccgacggtacgccaggtcgtcggtagtcgccggtcgtgggtacgtaggtaacggtacggtaacggtaagggtacccgtaccgggacgtacgtacgtacgtacgtacgtacgtacgtacgtacgttacgtacgtacgttaccgttaccgttaccgttaccttacgttacgtacgtacgttaccgtacgtacggtaccgccgtcggacgtaccgtacgacgaacgtaacttaaccgttaacgttagaccggttaaccggtaacctacgtacgtaccggttaccgtacgtacgaacggtacccggttacgtaccgtacgtcccggtaccgtaccgtaccgtaccgtaccgtaaccgtaaccgtaccgtaccgtaaccgtaaccgtaaccgaccgtaccgtaacgaacgtacgtacgtacggtaccggttaaccgtaacttaaccgtacgtacgaaccgtaccgtaccgtacgtaccgtacgtacgtacccgttaccgttacgtaccgtacgtacgtacgtacgtaccgtacgtacgaaccgtacgtccggaccgttaccgtacgtaccgtggtactggtacgtccgtacggtaccgtaccggtaccgaccgtacgtacgtaccg

SEQ ID NO: 209452 - DNA, 898 bp, Homo sapiens
  misc_feature: GYAE6OF02I9GIA.17.25.C03.1.454.CMB.1.raw
  modified_base (65)..(65): a, c, t, g, unknown or other
  misc_feature (65)..(65): n is a, c, g, or t
  modified_base (293)..(293): a, c, t, g, unknown or other
  misc_feature (293)..(293): n is a, c, g, or t
  modified_base (356)..(356): a, c, t, g, unknown or other
  misc_feature (356)..(356): n is a, c, g, or t
tcagcgtagactagcacgaccggtgctcgattttagtagtgtagatttgggtttggggactcaanaaccacatctgtcctctagagaaaaccctgtgagcacagcctcctcaccagtcgtacgtcgtacgtggacgacctccttctttcgttgggtcgacgacgcgacgtacctaacgtagtccgaccctacccgtaccgaggtcgaccgacgtcgttggcgacgtcgtccggtcgggtactgggaggtacgaagacgtccggtcgggtcctagaggtacggtacgtcctcgngtacgacgttcttcgagtaccttacgttaccgttacctcgtatagtacacgtaggttcggacnccggtacgacgggtccctagacggaaccgaccggttacgagggtacggtagacgggttacgggacggtacccggaaaccgttaaacccctaagtcgggttcggtactaaccgtaccggtagttttccgttacccctacgtaaaccccgtcggttacccggtaaccggaaattaaacccggttaacctaccgtaacgtacccgaaaaccgttaacctacccttaccccggtaaagtaaacctaaccccggtaatacccgttaacccgtaaaggttagggttaacccggtaaggttaacgggtaccggtaacgttcccgtaaacgtaccgtaacgtttacccggaaccggtaaccgtaacccggttcccgtaaaccgtttctttaaccgttaccggttggtaaccgggtaacgtaacccggtttacccgtacccggtaaacgggtttccggttaaaccgggcgtaaaccccggtcgggttaaccgacccgggttaacggttccccgttttaccgaccggttttaccgggcccgggttaacgggg

SEQ ID NO: 209453 - DNA, 753 bp, Homo sapiens
  misc_feature: GYAE6OF02IAONI.17.25.C03.1.454.CMB.1.raw
  modified_base (262)..(262): a, c, t, g, unknown or other
  misc_feature (262)..(262): n is a, c, g, or t
  modified_base (280)..(280): a, c, t, g, unknown or other
  misc_feature (280)..(280): n is a, c, g, or t
  modified_base (419)..(419): a, c, t, g, unknown or other
  misc_feature (419)..(419): n is a, c, g, or t
  modified_base (510)..(510): a, c, t, g, unknown or other
  misc_feature (510)..(510): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggatcctctttcttggtggcagcagctacaagtgcccactcccaggtgcagctggtgcagtctggggctgaggtgaagaagcctggggcctcagtgaaggtctcctgcaaggcttctggattcacgtttaccnctatagtatcaactggtncgccaggccgctgacaacgacctgacgtggatcggggaatcggggacgtaaaaccccgtaactaccgtaggggtttctaccgaacctaggttcggttacctttaccgaaccccctaagtccccgttaccccgggggaanaaaccgggtacctttaacccggatttcggaaacccgaaccgtaaaccttcccgtttaccccaaattaaaaaccaccgaacgtacccttaanaaagttcgggaaagttcgggaaacggaccgggcccttacgaaaccagtttacccgttacggaaccgaaaccgaccggggtaccctttacccgttaattaaccggttcggttaccgaccggttaacggaccggttaccccctaacgggtaaccgttccccgggttaggaaacccggtcccgttaacgggacccggaacggccgggtttacccccgttttgaccgttttccgggtacccgggggg

SEQ ID NO: 209454 - DNA, 603 bp, Homo sapiens
  misc_feature: GYAE6OF02JFL0P.17.25.C03.1.454.CMB.1.raw
  modified_base (190)..(190): a, c, t, g, unknown or other
  misc_feature (190)..(190): n is a, c, g, or t
  modified_base (232)..(232): a, c, t, g, unknown or other
  misc_feature (232)..(232): n is a, c, g, or t
  modified_base (319)..(319): a, c, t, g, unknown or other
  misc_feature (319)..(319): n is a, c, g, or t
  modified_base (478)..(478): a, c, t, g, unknown or other
  misc_feature (478)..(478): n is a, c, g, or t
  modified_base (481)..(481): a, c, t, g, unknown or other
  misc_feature (481)..(481): n is a, c, g, or t
  modified_base (491)..(491): a, c, t, g, unknown or other
  misc_feature (491)..(491): n is a, c, g, or t
  modified_base (517)..(517): a, c, t, g, unknown or other
  misc_feature (517)..(517): n is a, c, g, or t
  modified_base (524)..(524): a, c, t, g, unknown or other
  misc_feature (524)..(524): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcnggggctgaggtgaagaagccgtggggcctcaggtgaaggtcncctgcaggctcgtgattcaccgtttacctcctatagtatcaagtgggtcgcgccgacggcgcgtggaccaacgacctgaggtggagngggagtcggggaccgtaacccgtacaagttgggtacgtacacgagtttcgtccttaccacccacgttcccgtccgggaactacggtaccttaccagtacgaccgaactaacctcccgtaacaactaaacaccacgctaactacgtagaggttagaggcnccngtacattcgngacgacacgggccttacttagttacnggttacncgacggtctacccgagtccgtaccggtaggaccgccgtacggccgcggtccggtacgttcgtacccgtttggaccgggg

SEQ ID NO: 209455 - DNA, 842 bp, Homo sapiens
  misc_feature: GYAE6OF02G3JY6.17.25.C03.1.454.CMB.1.raw
  modified_base (244)..(244): a, c, t, g, unknown or other
  misc_feature (244)..(244): n is a, c, g, or t
tcagcgtagactagcacgaccggtgctcgatttagtagtgtagatttgggtttggggactcaacaaccacatctgtcctctagagaaaccctgtgagcacagctcctcaccatggactggacctggaggatcctcttctggtggcagcagctacagtgccactcccagtgcagctggtgcagtcgtgggctgacggtgaagaagcctggggcctcagtagaaggtctcctggcaacggtcttcncgggtacttcgtaccgtttacctcgtaactagtactacgaaccgttgggtcgtccgtaccgaggtcccggtcgtacggaaccaaccggtaaccttggaacggttgggtaaccgttggggtaacgtcggggtaacccgtaaaccccgttaacgtaccggttacgggtacggttacccgaacgttacgggttaccgttaccgttaccccgaaccccgtacggttccccgtacccgggggtaacctaccggtaacctttaccccgtaatttaccggaacccgtaacgtaaccccttaccgtaccgacgttaaaccgacctaacgtaccggtacccttaacgtacgttagggtaaccgtttacggtaacgggaccgtacccgtacggtaaccttacgtccgtttaacgggaccgtaacccgtaccgggttaccgttaaccgtttacgttacccggttgggttaacccggccggtaaccgggttcccttacccccgaaagggttacccggttacccgggtaacggttacccggtaccccgttaaacgggcccccgtaagggttccccgggttaccgttttaccggaaccggttttcccggggg

SEQ ID NO: 209456 - DNA, 708 bp, Homo sapiens
  misc_feature: GYAE6OF02F8HGV.17.25.C03.1.454.CMB.1.raw
  modified_base (260)..(260): a, c, t, g, unknown or other
  misc_feature (260)..(260): n is a, c, g, or t
  modified_base (280)..(280): a, c, t, g, unknown or other
  misc_feature (280)..(280): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcgagtgaaggtctcctgcaaggcttctggattcacgtttaccnctatagtatacacgtgggtncgccagccgctgacaacgacctgagtgagtgggagtcgggaccaaacccttacgaccgttgggtacgtaccacgtacgttcgttaccttacccgaaccctacgtcccgtaccggggaacacgtaaccttaccatacgaccacgaacctaccctcctaaactaaaccacgacgtaccctaacctaagtgggtaggttacggaacgtacgtcccgtaggtaacctacgttacgttaccgaaccggaccgaccgggttacccggtttacctttaacgtttaccggtacgtacgggtaccgtaacgtacccgttaccccgaaccggtacggttacccgggttacggtaaaccggtaccccgggttaaccgggccgtaaccgggttccccgggttacctttttcccggggttacctttcggggtacccggggg

SEQ ID NO: 209457 - DNA, 816 bp, Homo sapiens
  misc_feature: GYAE6OF02H10HY.17.25.C03.1.454.CMB.1.raw
  modified_base (154)..(154): a, c, t, g, unknown or other
  misc_feature (154)..(154): n is a, c, g, or t
  modified_base (198)..(198): a, c, t, g, unknown or other
  misc_feature (198)..(198): n is a, c, g, or t
tcagcgtagactagcacgaccggtgctcgatttagtagtgtagattgggtttggggactcaacaaccacatctgtcctctagagaaaaccctgtgagcacagctcctcaccagtggactcggaccgtggagacttcctcttcgttggtggcagnagtctaacgaagtccgaccctacctccgaggtcgcagcgtggtnacgacggtggtgggctaggaggtagaagacgccgtcgggcctcgaggtagtacgtctccgtgacgacgtcttcgtaggtacttccgttaccgtttaccttaccgttaagtcgttaactacgtaacggttgggtacgccgtacggacggtccgcgtaacggaaccaacggtaccgtaaggtcggtaggacggtaggggtcgtaccggggaacctaaacccgtaagtcggtacggtacggtaccgaacgttcgttccgttaccgttacccgaccccgtacgttccccgggtacggaaccttaaccgtaacccgttacgaacgtaccgtaaacccaccgttacctacccttaaaccgtaaactaaacccgactaccgaaccgtaacgtaaggttaccgggttagttaacgggacggtacccgtcggtaacgtacaccggtacctaaaccgggaccgtaacccgacccgggttacccgttaaccgttacgttcggacgttacggacgttaccgacccggttaccggtaccgttacgggtacccggtcgaacccggttcccgaaccggtcggtaccgggttacccgtttaccggttttcgaccgggtttccgggtacccgggg

SEQ ID NO: 209458 - DNA, 703 bp, Homo sapiens
  misc_feature: GYAE6OF02G8VN9.17.25.C03.1.454.CMB.1.raw
  modified_base (242)..(242): a, c, t, g, unknown or other
  misc_feature (242)..(242): n is a, c, g, or t
  modified_base (258)..(258): a, c, t, g, unknown or other
  misc_feature (258)..(258): n is a, c, g, or t
  modified_base (273)..(273): a, c, t, g, unknown or other
  misc_feature (273)..(273): n is a, c, g, or t
  modified_base (283)..(283): a, c, t, g, unknown or other
  misc_feature (283)..(283): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctcagtgaaggtctcctgcaaggcttcnggattcacgtttaccnctatgtatcaatggncgcaggccgntggacacgacctgacgtggatgggatggggaccaaccctaagcgttggtagtcaacgacgttgtcgttccaccctactcccgtacccggggacaacgtaaccgttaccaacgtcgaacccaccgaaacgttccctacccaaacgttaaaccaaccgtaaacggtacccttaactacggttacggtaacggtttacggaacgggttaaccgcccgttaacgggaacctaagttccgttaacgaaccggtaacccgtacccgggtacccggttaaccgtttaaccgtttaccggtacgtacgtaaccgtaccgggtaccgttaccccggaaccgtaaccgttcccgggaggtaccggtacccttaaccgggacctacgggtcccgggtacccttttacgggacccgtttccgggtaccgggg

SEQ ID NO: 209459 - DNA, 606 bp, Homo sapiens
  misc_feature: GYAE6OF02HDCHW.17.25.C03.1.454.CMB.1.raw
  modified_base (282)..(282): a, c, t, g, unknown or other
  misc_feature (282)..(282): n is a, c, g, or t
  modified_base (293)..(293): a, c, t, g, unknown or other
  misc_feature (293)..(293): n is a, c, g, or t
  modified_base (327)..(327): a, c, t, g, unknown or other
  misc_feature (327)..(327): n is a, c, g, or t
  modified_base (408)..(408): a, c, t, g, unknown or other
  misc_feature (408)..(408): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagccgtggggcctcgagtgaaggtctcctgcaaggtcttctggattcacgtttacctcctatagtatcaacgtgggtncgccaggccgntggacacgcctgagtgatgggatgggcaacctanacgtggtgtcagagtgtcttccacccatcccgtacggacacgtaccttacatcgaccaccgacctccgtaccactaaaccncacgcctagacgtggattaggaggactccgtagacctattcgacgaccgaaccgccgtcccgttacttaacgttactggttacgcgaacgtccgtacccgtaacggaccgttcccgggtagacccggtacccgttacccggggactaaccgggtcccgggttacccgttttcggtacccgttccgggtacccgggggg

SEQ ID NO: 209460 - DNA, 785 bp, Homo sapiens
  misc_feature: GYAE6OF02I1AOS.17.25.C03.1.454.CMB.1.raw
  modified_base (251)..(251): a, c, t, g, unknown or other
  misc_feature (251)..(251): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcgttggtggcagcagctacagtcgcccactcccaggtgcagcgtggtgcagtcgtgggctggaggtgaagagccgtgggcctgagtgaacggtctcctgacgagtcttacgnggtacttcaccgtttacctaccgtattagtaactcgaacgtgggtcaccgccgaacgggtcccgtagtacgggaacctaaccggtaccgtaggtacggtaagggtcggttaggggaacggttacgggggtaacctaaaccccgttaaacggaccggttacggggttctaccggtaacgtacggtttacggtcctttacccggaacccccgtacggtttaccccggtacccggggtaaaccgtaacgttaacccgtttaaccgtacggttaacccgaacccgaaacccggttaaacccttcccccgttaaacgaaaaccttaaacccgaaaccgtacgtacccgttaaccgtaacgtacgggaacgtttacgggaacgtacgacccgttacgaccgtacttaccggtacgaccgtaacggttacccgtcgttaacgttaacttacggtgtaaccggtacgtaccggacttcccgaagttccggaccgtcgacgtaccgtcggaccgcggtccgtaccgtttcgcggtacgccggg

SEQ ID NO: 209461 - DNA, 630 bp, Homo sapiens
  misc_feature: GYAE6OF02GBKEW.17.25.C03.1.454.CMB.1.raw
  modified_base (273)..(273): a, c, t, g, unknown or other
  misc_feature (273)..(273): n is a, c, g, or t
  modified_base (440)..(440): a, c, t, g, unknown or other
  misc_feature (440)..(440): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctctgcaggctctggattcacgttacctctatagtatcactgggtncgccagccgctggacaacgactgagtggagtgggatggggacgaaaccctaacgacgttgggtgtacacgtagtgtccttccacccctactcccgtaccggggacacggtaccttaccagtacgacccaacgtaacctccctaccaataaacacaacgtaccctaanacgtggagttaggaacggagtacctagaactacttactacggaacggaccgaccggtcccgttacttaacttaccgtaggtcgacgggtacgaccggtacccgacggtaccgtccgggtacggaacggtacccgtagggcccgtacgggcccggttaccgttttacggtacccgttccggtaccgggggg

SEQ ID NO: 209462 - DNA, 700 bp, Homo sapiens
  misc_feature: GYAE6OF02JU9US.17.25.C03.1.454.CMB.1.raw
  modified_base (303)..(303): a, c, t, g, unknown or other
  misc_feature (303)..(303): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtgcccactcccaggtgcagctggtgcagtcgtgggctgaggtgaagagccgtgggctcagtgaggtctcctgcagcttctggattctaccgtttacctccgtatagtatcacgtgggtgcgccagccgctcggacacgctggngtggagtgggacgtcgggaccgtaacctaacgccgtagggtcgtacacgacggtttcgttccttacccgtaccctaccgttcccggttaccccggggaactaacgtaaccgttaacccagtaccgaacccgtaaccgaacccgtttaccccaccctaaataaaaccccgtcgacccgttaaacctacccgttaaaggtcgggttacggttaggaacggtacgccgtacaaccgtatcggttaaccgcgaacccggacggtacccgttacttagttaccgtggtcgacggtaacgtacgtcccaaacggtccggttaccggttcaccgggttaaccgtcgggtaccgaacgggttccccggttaggttttccgaccggttttaccggtacccgggggg

SEQ ID NO: 209463 - DNA, 704 bp, Homo sapiens
  misc_feature: GYAE6OF02GFTLU.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtagaaggtcctccgtgacgaaggtcttcgtggtattcctacgtttacctcctatagtactacaacgtgggtgcgccgaggccgcgtggaccaacgacctggaggtcggagtggggacgtcgggaccaaacccgtacgtacggttggtcgttaccgaacgtaggttcgttccgttaccgaaccctacgttcccggtaccgggactacggtacccttaccacgtacgaacccaccgtaacctcccgtaaccaacgtaaaccacgaacgtaccctaacgcgtagggtagttaggaacgtcggtcctagtacctactccgtaggtaaccgaccggtaacccggtccttaacgttacgttaacgtcggtacggacgtacggtacccgtccccggaacggtcgttaccggggtacgacccggacccgttagggaccgacgggttaccggttcccttttacgggaccgtttcggggtacccggggg

SEQ ID NO: 209464 - DNA, 676 bp, Homo sapiens
  misc_feature: GYAE6OF02IVEIO.17.25.C03.1.454.CMB.1.raw
  modified_base (186)..(186): a, c, t, g, unknown or other
  misc_feature (186)..(186): n is a, c, g, or t
  modified_base (483)..(483): a, c, t, g, unknown or other
  misc_feature (483)..(483): n is a, c, g, or t
  modified_base (517)..(517): a, c, t, g, unknown or other
  misc_feature (517)..(517): n is a, c, g, or t
  modified_base (555)..(555): a, c, t, g, unknown or other
  misc_feature (555)..(555): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtcgcccactcccaggtgcagcgtggngcagtcgtggggctggaggtgaagagcgtgggcctcgagtggaaggtctcctgcgaacggtcttcgtggtacttccgtaaccgttttacctaccgtattaaggtactacgtaaccggtgggtcgccggccgacggtccgtcgtacggaaccgaaccgtaccgtaggtacggtacggtaagtggggacggttcgggaaccgtaaacccgtaacgtaaccggtggttcggacgtacgtacggtttcgtacttacccgaacctccggtacccgttaccgggactaacgtaccgttaaccngtaccgacaaccgtactaccgactaaactaaacncgtacgacctaatacgtacggagtacggagtacgacgngtacacgtcgacgacaaccgtccgtacttcgtaacttcgtgaacggcgacgacgttcgaacgtcggtaccggttcgaacggttccgcggcgacggtccgtacgttcgtactgggtaccggg

SEQ ID NO: 209465 - DNA, 733 bp, Homo sapiens
  misc_feature: GYAE6OF02IEN54.17.25.C03.1.454.CMB.1.raw
  modified_base (500)..(500): a, c, t, g, unknown or other
  misc_feature (500)..(500): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtagcagtcgtggggctggaggtgaagaagtccgtaggggccttgagtgaaggtctccgtagcgaacggtcttacgtaggtactttacgtaaccgttttacctaccgttaatacgttactaccgtaacggttggggttacgccgaccgtaacgggcccgtacgttcgggaaaaccgaaccggtaacccgtagggtacggtacgggtaacggtggggggtaacttaccgggggacccgtaaaacccccgtaacgaccggtttagggtactaccgtaacggtagtccgttacttcccaaccctacggtccgtacccggganaaccgtacttaccgatcgaacccaacgtaacctacctaccgtaataaaccacgtaacaccgtactagtacggtagttacgaaggacgtaccgtacgactactacgtacgacgtacaccgggtccgtacgttagtactacgtacgtacgacgtactcccgtaacggtcgtaccggtgtaacccggaccgttaggcctacgggtcgttaccctttagaccgttccggtaccgggg

SEQ ID NO: 209466 - DNA, 780 bp, Homo sapiens
  misc_feature: GYAE6OF02HWPRP.17.25.C03.1.454.CMB.1.raw
  modified_base (246)..(246): a, c, t, g, unknown or other
  misc_feature (246)..(246): n is a, c, g, or t
  modified_base (294)..(294): a, c, t, g, unknown or other
  misc_feature (294)..(294): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacagtgcccactcccaggtgcagctggtgcagtcgtggggctggaggtgaagaagccgtggggcctcaggtgaaggtctcctgcaaggcttntggattctaccgttttaccaccttatacgtatacaacgttcggggtanccggacgacggcccgacgtaggaaccaaacggtccgtaggtaggttaggacgggtggggagtacgggggacccgtaaaccctaacgtacgttagggtcgttaccacgtagtttcggttaccttccctaacccctacgttaccccggtaccggggtaacctaacggttaaccccttaaccgtaagtcccggaaaccctaaaccggtaaacccgttcccctaaccctaaaacgttaaaaaccccaacgtaaccgtaaccccgttaacgaacggttacgggtaacggtttacgggacgggtaaccgtacctaagggaccttaacgtacgttaaggaacccggaacgtaccccgggtaccttacgtttaacttacgtggtaccgtaacgacgtacccgtcccgaaggtccgtaccgggtacggtaaccgtacccgttaccggacgtccggccggttaaccgttttccggtaccgtttccggtaccggggg

SEQ ID NO: 209467 - DNA, 665 bp, Homo sapiens
  misc_feature: GYAE6OF02IF65B.17.25.C03.1.454.CMB.1.raw
  modified_base (246)..(246): a, c, t, g, unknown or other
  misc_feature (246)..(246): n is a, c, g, or t
  modified_base (286)..(286): a, c, t, g, unknown or other
  misc_feature (286)..(286): n is a, c, g, or t
tcagcgtagactagcacgaccggtgctcgatttagtagtgtagatttgggtttggggactcaacaaccacatctgtcctctagagaaaaaccctgtgagcacagctcctcaccatggactggacctggaggatcctcttcttggtggcagcagctaacaagtgcccactcccaggtgcagctggtgcagtcgtggggtctgaggtgaagaagccgtggggcctcgagtgaaggtctcctgcacggnttcgtggattctacgtttacctctatagtatcaagtggtncgccgacggcgcgtacggaaccaaccgacctggagtcggagtgggagtcgggaccgaaacccgtaacaccgtggtacgtcaacgtagtagtccttaccaccctagtcccgtacgggaactacgaccttaacgatacgaccaacgaaccttccaacctaactaaaaccgaacacgacctacgtaacgtgggtagttacggagtacgccgtaagacctaagtcgtacgaacgaccgacggtaccttacttaacgttaaccgtgtacggacgtaaccggacgtaccccgtagtaaccggtaaccggttacggaaccgttacccgaacggccgttaacggtcccgggttaccgtttacggttaccgttacgggtaacccgggg

SEQ ID NO: 209468 - DNA, 719 bp, Homo sapiens
  misc_feature: GYAE6OF02JBOWQ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagcctggggcctcagtgaaggtctcctgcaaggtcttctggattcacgtttacctcctatagtatcaacgtgggtgcgccaggccgctggaccaacgacctgaggtggagtgggatcggggaccgaaaccctaacgaccgttgggtcgtaccaacgtaggtgttccttaccgaacccctaacgttcccgtacccgggggaactaacggtaacctttaacccgaatcgaacccaacgaaacccttcccttaaccaaacttaaaaccaccgaacgtaccctaacgaacgttagggtaagttacggaacgggtacgtacccgtagtaaccacttccgtaaggacccggtaaccgaccggggtacccgttccgttaaagttttacccggtagttaccgggacgtaacgggtacccgtcccctaacggtaaccgttcccggggtaggaaccggtcccgttaaccgggaccgtacggtcccgggttacccttttccggaccgtttcggtacccgggggg

SEQ ID NO: 209469 - DNA, 665 bp, Homo sapiens
  misc_feature: GYAE6OF02F69VR.17.25.C03.1.454.CMB.1.raw
  modified_base (248)..(248): a, c, t, g, unknown or other
  misc_feature (248)..(248): n is a, c, g, or t
  modified_base (406)..(406): a, c, t, g, unknown or other
  misc_feature (406)..(406): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagccgtggggcctcaggtgaaggtctccgtgaccaaggcttntggattcacgtttacctctatagtactcgaaacgttgggtcgcgtaccagggccgacgttggaccaaaccggaccttacggagtgggatggggagtgggaccgaaccctaacacgtggtgtacacgagttgtcttacgaccctatcccgtcgggaacngtaaccttaccgaacgtcaacccgtaccgtaaccgtccctaccgaaacttaaaccacctaacgaccctaacgatacgggtagttacggaggttaacgcctaacgactacgtacgtagaccgtaagtacccgggtccgttacttaacgttaccgtaggttcgaaccggagtaccgtacccgacggtaacgtccggtcgtaacgcccgttacggaccgacggttccgggttcctttaggtacccgttcggtaacccggggg

SEQ ID NO: 209470 - DNA, 780 bp, Homo sapiens
  misc_feature: GYAE6OF02FVHN6.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtcgcccactcccaggtgcagctggtgcagtcgtgggctggaggtgaagaagtccgtcggggcctcgaggtgaacggtctccgtgacgaacggtcttcgtaggtatttccgtaccgtttacctacgttaatagtactacgtaacgtgggtcgcgccgacggccgcgtacggaacctaacgaccgtggaggtgggagtggggacgtacgggaaccgtaaacccgtaacgtacggttcggtacgtaccgaacgtacggttcgttacccttaccgaacccgtacgttccccggtaaccggggaactaaccgttaacccgtttaaccgacgttaccggaacccgtaaccgttaacccgtacccttaaccgtaaaactaaacccgaacgtaaccgtaccctaaacgtacggtacgggttacggttacggaaacgggtacgtcccgtaaggtacctacggttacgttaaccggggaaaccctaccgggtaccgggtacctttacggttaacttacgcggttacggaccgtaacggtacccgtaccggtacgacgggttccggtacgaacccgtccggtacggacgtcggtaccggttccgtttacgggaccgtttcgggaaccgggg

SEQ ID NO: 209471 - DNA, 774 bp, Homo sapiens
  misc_feature: GYAE6OF02G4KSP.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtctgggctgaggtgaagagccgtgggcctcagtgaaggtcctcctgcaaggcttcgtggattctacgtttacctcctagtagtactcaacgtgggtcgcgtccacggcccgtcgtacggaaccaaaccggaccgttaggaacggttgggaacgtaggggtacgtacgggggaaccgtaaaccccgttaaacgtccgttagggtaccgtaccgtaaccgtacggtttcgttaccttaccgaacccctacgttcccgttacccggggaacctacggtaacccttaccgtaacgttaccggaaccctaaccggtaaacccttccccttaaaccgaaacttaaaaacccgaccgttacgtacccttaacgagttacgggtaacgtttacggaacgggtaccgttacctacggaaccttacgtccggtacgtaacccggaccgtaccgggtcccgtttacttaacgtttaccggtggtacggaccgtaacgtaccgtacccgaacggtccggttaccgggtcgaacgtaccccgttaacggaccgtacggtcccggttaccctttacggtaccggtttccggtaccggggg

SEQ ID NO: 209472 - DNA, 561 bp, Homo sapiens
  misc_feature: GYAE6OF02I10KW.17.25.C03.1.454.CMB.1.raw
  modified_base (280)..(280): a, c, t, g, unknown or other
  misc_feature (280)..(280): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcgagtgaaggtctcctgcaggcttctggattcacgtttacctcctatagtatcaactgggtncgccaggccgctggacaacgcctgagtggagtgggactgggaccgaaccctaacgactggtgacacgagtcgtcttcacccactccgccgggacacgtacttaccatcgaccacgacctcctaccaataaaccacacgacctacagtacggtagttaggagacgtccgtagacacgttcgagaccgacgacggccgttactattctgcgacgagtcgtccgagtcgtccggtgaccgtccgtacggactcggtccgttcccgttagtccgttcgtccgggg

SEQ ID NO: 209473 - DNA, 675 bp, Homo sapiens
  misc_feature: GYAE6OF02HK4KF.17.25.C03.1.454.CMB.1.raw
  modified_base (458)..(458): a, c, t, g, unknown or other
  misc_feature (458)..(458): n is a, c, g, or t
  modified_base (608)..(608): a, c, t, g, unknown or other
  misc_feature (608)..(608): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctaacaagtcgcccactcccaggtgcagctggtgcagtctggggctgaggtgaagaagctggggcctcgagtggaaggtctccgtgacaggcttcgtggattctacgtttacctcctatagtatccgaacgtgggtacgccgccgacggccgcgtacggacacgacctggagtaggagtagggacgtcgggaccaaacccgtaacgacgtcggtcgtacagtacgttcgtccttccaccctacgtccgtaccggacacgtacctaccgatcgaccaaccgccttacccgtacaaaacgttaaaccncgaaccgtacctaacgacgttaaggggattacgggacgacgaccttagaactaccgttgacggtaacccgacgtacccgggtaaccgtttcttaacgtaccgttaggacgtaccgaaggttaccccgccgtaccggtaacgtccgggtanacgttacccccggaggaccgtacgggtcccggtttaaccttttcggaccgttcgggaaccccggggg

SEQ ID NO: 209474 - DNA, 842 bp, Homo sapiens
  misc_feature: GYAE6OF02FY44G.17.25.C03.1.454.CMB.1.raw
  modified_base (175)..(175): a, c, t, g, unknown or other
  misc_feature (175)..(175): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtncagctggtgcagtctgggctggaggtgaagaagccgtcggggcctcgagtgaaggtcctccgtgacgaaggtccttcgtggacttccgtaccgttttacctcctattacgtatacctacgtaggggtcaccgccgtaacggcccgtacgtacggggaaccttaaccggaacccgttggaacggttacgggtaaggtacgggggtacggtacgggggtacccgaaaaccccgttaaacgtaccggtgggtactacgacgtaggttccgttccgttaccaaccccgtacttccccggaaccgggataacgttaaccctactaccgtacgaacccgtaaccgtaaccttccccaactaaacgaaacctaccgacgaccccttaagacgttaggggttacgttacggaaggtacgaccgttacggaacttagttacccggtacgaacccgtacccggaacccgggttaacccggttcttttaaaccggtttacctaccggggtttaaccgaacgggttaccggtaacccccgtacccggtaacccgggttaacggtaccccgggttaaggtaacccggttaaccccggtaccccgggtaactcccgggggtttaaccccggtacccggttttttaccggtaacccggttccgggggtttaaccccgggggg

SEQ ID NO: 209475 - DNA, 661 bp, Homo sapiens
  misc_feature: GYAE6OF02I6L2O.17.25.C03.1.454.CMB.1.raw
  modified_base (271)..(271): a, c, t, g, unknown or other
  misc_feature (271)..(271): n is a, c, g, or t
  modified_base (296)..(296): a, c, t, g, unknown or other
  misc_feature (296)..(296): n is a, c, g, or t
  modified_base (372)..(372): a, c, t, g, unknown or other
  misc_feature (372)..(372): n is a, c, g, or t
  modified_base (434)..(434): a, c, t, g, unknown or other
  misc_feature (434)..(434): n is a, c, g, or t
  modified_base (637)..(637): a, c, t, g, unknown or other
  misc_feature (637)..(637): n is a, c, g, or t
tcagcgtagactagcacgaccggtgctcgatttagtagtgtagatttgggtttggggactcaacaaccacatctgtcctctagagaaaaccctgtgaagcacagctcctcaccatggactggacctggaggatctcttctggtgcagcagctacaagtgcccatcccaggtgcagctaggtgcagtctggggctgaggtgaagagcctgggcctcgagtgaaggtctccgtgaccgaaggtccttcgtaggactttacaccggttttaccnccttagtacgtattcaacgtgggtnaccgccgacggcccgtacgttcggaacctaacggaccgttggacgtacggatggggattgggacctaacccgtacncggtgtacgtcgtaactgtcggtcctaccgacccacttcccggacggacacgtaccttaccngtccgacctaacgtacctacctaccaaataaccgactacgacctacgtagtacggtaggttcgaacggtacgtcctacggacctaacgtcgtacggaacctaccggaccgtaccgttactaagttaccgtaccgttaagaccgacgtacgtacccgtacggtaccgtcggtacgaccgtacccgtacggcgacggtcccggtntttccgaacgttccggtaccgggg

SEQ ID NO: 209476 - DNA, 695 bp, Homo sapiens
  misc_feature: GYAE6OF02IVTZC.17.25.C03.1.454.CMB.1.raw
  modified_base (240)..(240): a, c, t, g, unknown or other
  misc_feature (240)..(240): n is a, c, g, or t
  modified_base (258)..(258): a, c, t, g, unknown or other
  misc_feature (258)..(258): n is a, c, g, or t
  modified_base (301)..(301): a, c, t, g, unknown or other
  misc_feature (301)..(301): n is a, c, g, or t
tcagcgtagactagcacgaccggtgctcgatttagtagtgtagatttgggtttggggactcaacaaccacatctgtcctctagagaaaaccctgtgagcacagctcctcaccatcggactggacctggaggatcctcttcttggtggcagcagtctacaagtgcccactcccaggtgcagctggtgcagtcgtgggctgaggtgaagaacgccgtggggcctcgaggttgaacggttccnccgtgccgaaggtccttntggacttcgtaccgtttacctcgtataagtatacacgtggtancgtccgaggcctcgtacggacctaacgccgttagaggttcggaagtcgggtagtcgggacccaacccgtaacgtaccgtaggtcgtaactacgagtttcgtacccttccacccgtacttcccggtacgggaacacggttaacttacccgaagtacccgacccgaaccgtaaccctaccctaaccgtaaacctaaacccgaccgtaccgtacctaacgtaagttacggacggtttaacgaacggtacgtaccgtacgtacctactacgtacgaccgaacgtacccgtccgttacgttacgttcgtacgtcgtaccgacgtacgtacccgtacgtaccggtcgttacgccggtaccgtacgcgtacggtccgtacttccgtacgtccggtaaccgg

SEQ ID NO: 209477 - DNA, 763 bp, Homo sapiens
  misc_feature: GYAE6OF02GXT19.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcaggtcgtggggctggaggtgaagagccgtggggcctcgagtgaggtcctcctgcaggtcttcgtggtattcacgtttacctcctatagtatcgtaacgtgggtcgccgccgagggcccgtcgtacggaaccgaaccggtaccgtaggacggtcgggagttcgggggtagtcgggggaacccgtaaaccccgttaacgtaccgttcggggtacgtaccgaccgtaagggttccttaccgtttaccgaccccgtactcccggtacccgggaactaacgggtacccttacccgactaggaacccccgtaagtaacccttcccgtaaaccgaaacttaaaacccgacctaacgaccccgttaaactacggtacgggtaaggtttacgggaacggtaaccgtccgtaacgtacctacgttaccgaccggtaaaccgaccggtacccggtaccgtttacgttacgttacggtggtaaccgtacgacggttacccgacccgtaacggtccggtaccggtcggaccgtacccggtacggcgaccgggtcccgtttaccgttacggttaccgttccgggtaccgggg

SEQ ID NO: 209478 - DNA, 607 bp, Homo sapiens
  misc_feature: GYAE6OF02G4BL4.17.25.C03.1.454.CMB.1.raw
  modified_base (282)..(282): a, c, t, g, unknown or other
  misc_feature (282)..(282): n is a, c, g, or t
  modified_base (434)..(434): a, c, t, g, unknown or other
  misc_feature (434)..(434): n is a, c, g, or t
  modified_base (444)..(444): a, c, t, g, unknown or other
  misc_feature (444)..(444): n is a, c, g, or t
  modified_base (470)..(470): a, c, t, g, unknown or other
  misc_feature (470)..(470): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcgagtgaaggtctcctgcaaggcttctggattctacgtttacctctatagtatcaacgtgggtcncgccaggccgctggacaacgcctgacggtggagtgggatcggggacctaaacccgtaacgacgtggtcgtacacgtagtcgtccttaccaccctagtcccgtaccggggactacgtacttaccatcgaccacgtaacctccacaataaaccncacgcctaanagtacgggtagttaggagactcctanactgtcgtggaccgtacgccgggtactcttaattccgtgtcgcgtacgtaccgccctaaggcgttccgggagaacccggtaccggttaacggccgtaacggtcccggttacttttacggaccggtttcggccggggg

SEQ ID NO: 209479 - DNA, 592 bp, Homo sapiens
  misc_feature: GYAE6OF02GSQKK.17.25.C03.1.454.CMB.1.raw
  modified_base (242)..(242): a, c, t, g, unknown or other
  misc_feature (242)..(242): n is a, c, g, or t
  modified_base (421)..(421): a, c, t, g, unknown or other
  misc_feature (421)..(421): n is a, c, g, or t
  modified_base (438)..(438): a, c, t, g, unknown or other
  misc_feature (438)..(438): n is a, c, g, or t
  modified_base (483)..(483): a, c, t, g, unknown or other
  misc_feature (483)..(483): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttntggattcacgtttacctctatagtatcaactgggtgcgccgaggccgctggaccaacgacctggagtgggatggggatggggaccaaacctaacacgtgggtcgtcacgagtgtcttcacccatccgtccgggacagaccttacatcgaccacgaacctccacactaaacacagcctanagtggtagttgaggacnccgtagacatcgacggacgaccgaccggccgttcttaactttcgngttacgacgtaggtaccgtcccgacggtacgtacccgggttagaccggtacccgtacgggaccgtacgggtccgggttacccttttggaccgtttacgggtcccggggg

SEQ ID NO: 209480 - DNA, 704 bp, Homo sapiens
  misc_feature: GYAE6OF02FSJRY.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcgaggtagaacggtctccgtgcaaggcttctggacttctaccgtttacctccgttatagtatcaacgtgggtgccgccgacggccgctgggaccaacgaccgtgaggtggagtggggagtcgggaccgaaaccctaacgacgttaggtcgtacgacgtagtcgttccttaccaccctcgtcccgtcgggaaccgtacggtaaccttaccgacgtacgaacccgaccgtaaaccctccccgtaaccaaactaaaacccacgtaaccgaccgttaacaggtacggtaggttcggaacggtacgaccgtacgaactacgtcgtacggaccgaccgaccgggtaccttacgtttaacgttccgtaggtcggtaccgagttacccgtacccgaacggtaccggttacccgggtacgacccggttaccgtaccgggaccgtccgggttaccggttcccggtttacggttaccggttccggtacccggggg

SEQ ID NO: 209481 - DNA, 678 bp, Homo sapiens
  misc_feature: GYAE6OF02G5588.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcagtggaaggtctcctgcaaggcttctggattctaccgttttacctcctatagtatcaaactgggtgccgccaggcccgctggaccaacgacctggaggtggagtggggatcggggccgtaaccctaacgactgggtacgtacacgagttgtaccttccaccctacttccgtaccggggacacgtaccttaccgaatcgacccaacgtacctccctacccaaataaaccacaacgtaccctaacgtacgtagggtacgttgggaacggacgacccgttacgaaccgattaccgtacggaaccggacccgtaacccgggtccccgtttacgtactttaaccgttcggtaggtccggaaggtacccgttacccgaccggttaacggtcccgggtaggaccgtaccgttaccggcgtacggtacccggttcgttttaccgggtacgttccggtaccggggg

SEQ ID NO: 209482 - DNA, 919 bp, Homo sapiens
  misc_feature: GYAE6OF02IGLZI.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgacagctggtgcagtcgtggggctgaggtgaagagccgtgggcctcgagtgaaggtctccgtgcaaggtcttcgtggtactttcgaccgttttacctccttaattagtaacgtccaacgttggggttacgcgtacccgtacgggtcccgtacgttacgggaaccgtaacccggtaccgttagggaacggttacggggtaaggtagggggtacgtacggggggtaaccccgtaaaaccccccgttaaaacgtaaccgggttcggggttaaccggttacccgtaaaccgggttagggttttaccgggttccctttaacccccgtaaacccccgtaacccgttaccccgggtttaaccccgggggaaacccttaaacgttaaaccccgttttaaccccgtaaacggttaaccccggtaaccccgtaaaacccggttaaacccccttaccccggttaaacccctaaaaacgtaaaacccctaacccggttaaccgtaaccccttaaccgaacgtttacggggtaaacgtttaccgggaacggtaccgtaccgtaacggtacctaccgttccgacgggaaccgacccggtaaccgggttcccttaacgttaactttaaccgtcggtacgtccggtaaaggtccccgtacccggtaaggtcccggtaccggtacggacccgttacccgtaaccggtccggaccggttcccggttaccggttttaccgaccggtttacgggtacccggggg

SEQ ID NO: 209483 - DNA, 773 bp, Homo sapiens
  misc_feature: GYAE6OF02IUPR0.17.25.C03.1.454.CMB.1.raw
tcagcgtagactagcacgaccggtgctcgatttagtagtgtagatttgggtttggggactcaacgaaccacatctgtcctctagaagaaaaccctgtgagcacagctcctcaccatggactggacctggaggactcctcttcttggtggcagcagctacaagtcgcccactcccaggtgccagctggtgcagtcgtggggctggaggtgaaagacgtccgtgggcctcgagtagaacggtctcctgacgaaggtctcgtgtatttaccgtacgttttcctactagttaagtactacgtaacggtgggtacgccggaccgtacgggccctacgttaccgggaaacctaaaccggtaccgtaaggtaagggttacggggtaggtacggggtaacgttcggggaaaccccgtaaacccgttaaccgacggttcgggtaacgtacctaacggtacggttacccgttccgttaacccgaaccccttcggttccccggtaaaccggggtactaacccggttaaccttacccgaacgttaccgaacccgaaaccgtaccccttaaccctaccgaaaaccgtaaaccaaccgtacgtaacccttaacgtagtacgggtagttacgggtacggaccttcgacgtacctacgttcgtaacggacgtacccgaccgttacctacttcgttaacgtcggacgtaccgtacgccttaccgaggtacggttccgagtaccgaccggacgttacgccgttcggtacgtttacgtccggttcggccggg

SEQ ID NO: 209484 - DNA, 803 bp, Homo sapiens
  misc_feature: GYAE6OF02HERLV.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttgggtggcagcagctacaagtcgcccactcccaggtgcagctggtgcagtcgtggggctggaggtgaagaacgccgtggggcctcgagtgaggtcctcctgcgaaggtcttcgtaggtacttctaccgtttacctctatagtactacaacgtgggtcgccgccgacggccgtccgtacggacgaaccgaccgtcggaggtggtaggtcggggtacgtcggggtaccgtaaacccgtaaccgtacgtacggtcggtactacgtacggttcgttccttaccgtaaccctaccgtcccggtaccgggaaccgtacctaaccggggggttaacctacgtaccggtaaccgtaacccgtaaacccgtaccccgttaacctaaacctaaacccgaacgtaccgtaacccgttaccgtaacggtaacggtacgggtttacggaacgggttacgaccggttaccgtaaccgtacgttaccgttacgggtaaacccggtaccggtaacccgggtacccgtttaacccgtttacgtttaaccggtcgtaacgggtacgtacgggtaccgtacccgtaacccggtaacggttccgggtacggtaccggtacccgtaccgggaccgtaccgggtaccggttaccggtttcgttacccggttccgggtacccgggg

SEQ ID NO: 209485 - DNA, 702 bp, Homo sapiens
  misc_feature: GYAE6OF02HHDYN.17.25.C03.1.454.CMB.1.raw
  modified_base (657)..(657): a, c, t, g, unknown or other
  misc_feature (657)..(657): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagcgtggtgcagtcgtggggctggaggtgaagagccgtgggcctcgagtgaaggtcctccgtgacgaaggtcttcgtggacttacgtaccgtttacctaccttatagtactacaagtgggtcgccgacccgacgggtcccgacgtacggaaccaaccggtaccgtaggacggttgggaacggttggggaacgtacgggaacccgtaaccccgtaaacgtacgttcgggtacggtacctaacgtagttcgttaccttacccgaaccctacgttcccggtaccggaactaacgtaacccttaccgattccgaaccaaccgtaacctcccgtaaaccaaacgtaacaacctacgtaacctagtacgtagggtagttacgggaagtaccgcgtacgtactacgtacgtacgaccgtaaccgccggtaccgttacttaacgttcggtacgtcggacgtacgtaccgtaccgacggtgtacccggngtaaccgccgtaggcgacggtccgttaccgttgaccgttggtcgg

SEQ ID NO: 209486 - DNA, 810 bp, Homo sapiens
  misc_feature: GYAE6OF02HM34S.17.25.C03.1.454.CMB.1.raw
tcagcgtagactagcacgaccggtgctcgatttagtagtgtagatttgggtttggggacgtcaacaaccacatctgtcctctagagaaaaccctgtgagcacagctcctcaccatgactggacctggaggatcctcttcttggtggcagcagctacagtgccactcccagtgcagctggtgcagtcgtgggctgaggtgaagagccgtgggcctcgagtgaaggtctcctgcaaggtcttacgtggtattaccgtaccgttttacctcctaattaagtaacttccaaacgttgggtcgcgtaccccgtaggccccgtcgtacggaacccgtaaaccggtacccgttaagggtaccggtggggaacggttacggggggaacgtttaccggggggaaccctaaaacccccggttaaaacgttaacccggttcgggttacgttaaccgaacccgtagggttacccgtttacctttacccggaaccccttaaccgttcccggtaacccggggtaaccaacgttaacccgtttaacccaagttaccgtaaccctaaacggtaaaccccttcccctaaccgtaaactaaacccgaaacgaccgtacccgtaagtacgttaagggaccgtttaagacggtacaccgttagaacctagtaccgtacgaaccgacccgtaccggtacccgttactaacgtttaaccgtggtaccggagtaccggaccgtaacccgtacggtacgttcccggtagacccgtacccggtacgtaccgacgggtcccggttaccttttcggacccggtttcggtacccgggg

SEQ ID NO: 209487 - DNA, 805 bp, Homo sapiens
  misc_feature: GYAE6OF02J2VXU.17.25.C03.1.454.CMB.1.raw
  modified_base (176)..(176): a, c, t, g, unknown or other
  misc_feature (176)..(176): n is a, c, g, or t
  modified_base (185)..(185): a, c, t, g, unknown or other
  misc_feature (185)..(185): n is a, c, g, or t
  modified_base (285)..(285): a, c, t, g, unknown or other
  misc_feature (285)..(285): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctaacaagtgcccactcccaggtncagctggtncagtcgtggggctagaggtcgaagacgccgtgggcctcaggttgaacggttcctccgtgaccaagggtcctttcgaggtacttccgtaaccgttttaccnccttaagtagtacttaccgaacggttgggtcgtccgccggaacggtcccgtaacgtacgggaaccaaaccggtaaccgtggtaacgggttcgggaacgtcgggggtaacgttccggggggaacccgtaaaaccccttaaaaggtccggttagggttacgtaccgacgttaagggtttccgttaccgtttacccaccccgtaacgtttcccggaaccgggtaactaaccggttaacttacccgagttaccgaaccccgtaaccgtaacccgttccctaaaccgtaaacggtaaaacccacgtaacgtcccgtaaacgtaagtacggtaggttacggaggtaacctcgttacgacgtacgtccgtaggtaaccgaccggtccggcctttacgttaacgttaacggtcggacgtacgggtacctaccggtacctaaccggtacgtttcggacgtaccggtttcccgaacgggtcctacggttccggttacccgtttacgggtaccggttccggttaaccgggg

SEQ ID NO: 209488 - DNA, 731 bp, Homo sapiens
  misc_feature: GYAE6OF02JSFFF.17.25.C03.1.454.CMB.1.raw
  modified_base (194)..(194): a, c, t, g, unknown or other
  misc_feature (194)..(194): n is a, c, g, or t
  modified_base (302)..(302): a, c, t, g, unknown or other
  misc_feature (302)..(302): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctaacaagtcgcccactcccgaggtgcagctggtgcagtcgngggctgaggtgaagacgccgtgggacctcgaggtgaggtcctccgtgacaggtctcgtggtacttcgtaccgtttaacctcctagtacgttacacgtaacgtggggtnccggaccgacgggccgtacgtaggaacaaccgtaccgtggtaacggtgggtagtacggggagtcggggaaccgaaccgtaacgtacggtggtactcgacgtacgttcgtaccttccgaacccgtcgtaccggtaccgggactaacggtaacctaccgtagtaccgaacccgtaaccgtaacctacccgtaacctaaacgttaaaaccacgtaaccgacccttaaacgtacggtaagggtacggttaacggaacgtacgtacctacgactacgtacgtcggaaccaaccggtccggtacgttaccgtaagtttaccgacggtacgacgaacgccggtacccgaacggtccgtaaccgggttccgaaccgttaccggtaacgacccggtacggtcccgttaccgttacggttaccggtcgggtacccgggg

SEQ ID NO: 209489 - DNA, 596 bp, Homo sapiens
  misc_feature: GYAE6OF02IBCIQ.17.25.C03.1.454.CMB.1.raw
  modified_base (279)..(279): a, c, t, g, unknown or other
  misc_feature (279)..(279): n is a, c, g, or t
  modified_base (285)..(285): a, c, t, g, unknown or other
  misc_feature (285)..(285): n is a, c, g, or t
  modified_base (331)..(331): a, c, t, g, unknown or other
  misc_feature (331)..(331): n is a, c, g, or t
tcagcgtagactagcacgaccggtgctcgatttagtagtgtagatttgggtttggggactcaacaaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagcgtgggcctcagtgaaggtctcctgcgaggcttcgtggattctacgtttacctctatgtatcaacgtggtncgccgngcgctggaacacgacctgagtggagtgggactgggacaaccgtacncgtaggtcgtacacgtgttcgtcttaccaccgtactcccgtccggacacgtaccttacacgtacgaacctacgaacctccgtaccaaataaaccgacacgtacctaacgtagtggagttacggagtaacgcgtagactatgtacgaacgacgaccggtaccgtacttacgttacgtgtcgacgagtacgtacccgaacgtcgtcccggtaggtaccgtccgtacggcgtacggtaccggttccctttggaccgttggtaccgggg

SEQ ID NO: 209490 - DNA, 799 bp, Homo sapiens
  misc_feature: GYAE6OF02HYBD8.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtcgcagctggtgcagtcgtggggctgaggtgaagagccgtggggcctcgagtggaggtcctcgtagacgaaggtcttcgtaggtactttccgtaaccggttttacctaccttaagttacgttactaccgtaacggttggggtcgtcccggccgaccgggtcccgtacgttaacggaacccgtaaccgtaccgtaggtaggttcggaacggtcgggggtagccggggtaacctaaaccccgtaagtaccgggttggtcgtaaccgtacggtaggttccgtacctttcccgaacccgttaccgtcccggttaccgggactaacgtaacctttaccgactacgaaaccctaccgtaaccctaccctaaaccgtaaacctaaacccgacgtaaccgtaaccgttaacgaacgttacgggtacggttaacggaacggtaccgtaccggttaacaacgtccgttaaccgtaccggaaaccgtaccgtccccgggttaacgttacctttaaagtttccgaggttaccgacgtaacggtcccgtaacccgacggtaccgtcgggtaccgtaaccgcccgttacggaccgttaccggccgtttaccgtaccggtacccgttggggtacccgggg

SEQ ID NO: 209491 - DNA, 733 bp, Homo sapiens
  misc_feature: GYAE6OF02GUHF0.17.25.C03.1.454.CMB.1.raw
  modified_base (285)..(285): a, c, t, g, unknown or other
  misc_feature (285)..(285): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgccttctggtgggggtcagacgtcaccatccacttgccggacaagtcgacggtacgttaaaacctatttaaattggtatcgagcaagaacctaggaaaacnccccagacctctgtactcttcgtggtcgcctactcccactctggacgtaggttcggcctcccatccggtagttcaggttggctaggtgactcgtgggacagtattacaacttcctaccgaacctacttacccgaaccctacttcgtaccgtacctaaccgtggtaacgggtactttagggacttaacctaaacgttacccttaaaccgttacgtttaccgtaaccgttaaaactaccggttaaaacgttttacccgttacccgttttacccccgttaaccgttaccgttttaaaccggtttacccgggaacccgggttaaacggggttaaacccttaaacgggttcggaaacggtaaaccgtttaacccgaaaaacggggttacttacggggtacgttaccgttacgggaaccctaaccgttaccggtttcccgttagttttaccccc

SEQ ID NO: 209492 - DNA, 866 bp, Homo sapiens
  misc_feature: GYAE6OF02J0AJE.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagccgtgggcctcagtgacggtcctctgacgtacggcttctggatttccgaccgtttacctctagtagtactccaacgttgggtcgccgtaccgacggcccgtcggtacggaacccgtaaaccgtcctacgggtaggtcggggtacgtcgggggtaagtcccggggtaacccgtaaaacccccgtttaaggaccggttagggttaccggttaacccgaacggttacggtttacggttccccttaacccgtaaccccgtacgtttacccccgggtacggggttaaaccgtaaccggtttaaccccgtttacccggaagtttacccggaaacccccgtaacccggtaaaacccccttttccccaaacccgttaaaacccgtaaaaccccgaaactaaccccggttaccccgttaaacgacgggtttaaacgggtacgggttaaccgggaaccggttaacgggtaccttaccggacgttaccgtacgttaccggggaaccctacccggtaccgggttcccttaacgtttaaccgttcctcgggtagaaccggtaccggttaccgaccggtaaccgtccgggtacccgggttagtaccccgggaccgttagggcccgtacgggttaccccgttggttttaaccggttccgttcgggtaccggggg

SEQ ID NO: 209493 - DNA, 739 bp, Homo sapiens
  misc_feature: GYAE6OF02HS7CQ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcgagtgaaggtctcctgcaaggtcttcgtggtattcgtaccgttttacctccttaatagtaactctaacgtgggtgccgccgacggcccgcgtaggaccaaccgaccgtgagttggagtggggagtcggggaccgtaaacccgtaacgacgtcgggtcgtacgactacggtcgttacttccgaacccctagtcccgtaccgggaactacgtaccttaccaatccgaaccaaccgtaactccctaccaaactaaaccacaacgtaccctaacgagtacgggtaacgtttaggaacggtacgtccctacggtaacacgttactacgggaaaccgtaaccggtaacccgggtacccgttaccttaacgtttaaccgtacggttcgggaaccgtaacggtaccgttaccccctaacggtaccgggttacccgggtacggaaccgggttacccccgttaacgggaccggtaccgggtacccgggtttacccgttttacggtacccgttttaccgggacccggggg

SEQ ID NO: 209494 - DNA, 736 bp, Homo sapiens
  misc_feature: GYAE6OF02HJSJZ.17.25.C03.1.454.CMB.1.raw
  modified_base (321)..(321): a, c, t, g, unknown or other
  misc_feature (321)..(321): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatccctccctgtctcgcctcgtggtgggggtcagacgtcaccatcacgttgccggaacagtcgacggtacgttaaaaccttattttaaagttggtactacagcaagtaaacctaggaaaacgccccagacctcgtgacttacgtctggtnccactacccacttcgtcggacgtagtaccggccgtacccctagtcggtaggttccgaggtcgggactaggtcggtacgttcggtagggtaacctaaggttacttttacgaacttacccgtccaacctacgtacccctacctaaccttcgtaaccgacccgtaacgtagggtaacggttagtttcggtccgtaaccttaaagttacccttaccgttaacgtccgttaaccgtaaacgtaaaccgttaccggtttaaccctcccgtttacccccgaggttacccttttaacccgggtttagggaccccgggttaaaggggtaacccgttaaggttacggtaacgtaccggtaaaccgaacggtaaccgttgggtaccgtagtaccgtacctaccgtttacttacgttactttacccg

SEQ ID NO: 209495 - DNA, 810 bp, Homo sapiens
  misc_feature: GYAE6OF02HS052.17.25.C03.1.454.CMB.1.raw
  modified_base (410)..(410): a, c, t, g, unknown or other
  misc_feature (410)..(410): n is a, c, g, or t
  modified_base (464)..(464): a, c, t, g, unknown or other
  misc_feature (464)..(464): n is a, c, g, or t
  modified_base (801)..(801): a, c, t, g, unknown or other
  misc_feature (801)..(801): n is a, c, g, or t
tcagcgtagactagcacgaccggtgctcgatttagtagtgtagatttgggtttggggggagtcagtctcagtcaggacacagcatggacatgacgggtccccgctcagctctggggctcctgctactctgctccgagctacgcagatgtgacactccagactgacccagtcctccactcccgtaccctgtcctacgtccctacggtggtacggggtcaagtacgtacacctactacgtacgttccggaccggtaactaacgtacctaacgggtaaccttttaaaaacccttaagttttaaaacgttggtaactagaaaccgtcgaaacgtaaacctacggggaaaaccacccccgagtacccgtcctagtaacgtctacggtacgtcggacctactaccctattaccggnggtaaccgaggttacccgggtaccaccccgttaagtccggggttacgtttaacngggtaaccgtcgtaagggtacgtaagtcggtaacgtaacgttagttaaccgttacacgttacctaacgtaaccctacgtaaactaccgtttaaacctccgtaaccgtaccgtaaacggtcgtaagttcggacgttactaaccgtaattacctaccggtacaacggttaaccgtaagttaacgttacttaacccggtaccttttcccgacggtttacctaccgggtttacgaccgggttaaacgggaatttacccggtgggtaacctaaacgggttaacccaaaggtaaacttcgggttaccaccggttactaccccggttaataccccggttagttnttaaacccg

SEQ ID NO: 209496 - DNA, 949 bp, Homo sapiens
  misc_feature: GYAE6OF02ITF9H.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcacatggactggacctggacggatcctacttcgttggtggcagcagctacaagtgccactccaggtgcagcgtcggtgctagtcgtggggactggtaggtagaaggaacgccgtggggacctgtacgtagaaacggtctccgttggacgtaagggtccttaacgtcgggtactttccgtaaccgttttaccctaccgttataaggttactacgtaaccgtgggtacgcgaccgaacggcccgtacgtacggtaactaaccggtaacccgtaggtaacggtgggtaacgtcggggaacggtacgggggaaacctaacccgtaaactaccggttggtaccgttacaacgaacgtttcgtacccgttaaccgaaccccgttacgtaccccggttaaccgggaaacgtaccccgttaaaccggtttaaccaaccgtttaacccggtaacccgtaacccggttaaaaaccccgtttcccctaaacccgtaaaaccggtttaaaaacccaaaacccgttaacccgtaacccgtttaaacggaaccgggtttaacgggtaacgggttttaacgggaacgggtaaccggtacccgttaacgggtaaacctcgttaaaccgtaagggtaaccccgtaaagggtacccgggttacccggttacctttaaaacgtttaaccccgttagggaacccggtagttacccgggaaccggttacccgtaaccgggtacccggttaacccgggtacgggtaacccggtcccggtttaaacccgggtacgggtaaccccgggttaccgggtttacccggtttaacgggttaccccggtttaacccggggttacgggggg

SEQ ID NO: 209497 - DNA, 658 bp, Homo sapiens
  misc_feature: GYAE6OF02FFTT1.17.25.C03.1.454.CMB.1.raw
  modified_base (290)..(290): a, c, t, g, unknown or other
  misc_feature (290)..(290): n is a, c, g, or t
  modified_base (350)..(350): a, c, t, g, unknown or other
  misc_feature (350)..(350): n is a, c, g, or t
  modified_base (358)..(358): a, c, t, g, unknown or other
  misc_feature (358)..(358): n is a, c, g, or t
tcagcgtagactagcacgaccggtgctcgatttagtagtgtagatttgggtttggggactcaacaaccacatctgtcctctagagaaaccctgtgagcacagctcctcaccatggactggacctggaggatcctctcttggtggcagcagctacaagtgcccactcccaggtgcagctggtgcagtctgggctgaggtgaagaagcctggggcctcgaggtgaaggtcctccgtgcaaggtccttacgtggattccacgtttaccctcctaatagattcaacgtgggtcnccgccaggcccgtctggaccaacgtcctgaacgtggatcgggatgggaccgaaccctaanacgttggntcgactgtcgtccttcacccgtatcccgaccgggactacgtaccgtaccctaagtcgaacccaccgtaactccccgtacaaactaaaccaccgtacgacccgttaacagtagggtacgttggaacgtcgcctagacctacttacgtacggaccgaccgtacgggtcccgttaagtaaccttacgtacggtagaccgtaacgtaccgtacccgacggtaactcccgggtaagccgttaacccggtacggtaccgaccggttaccggttacccgtttacggccgtttaccggtacccggggg

SEQ ID NO: 209498 - DNA, 996 bp, Homo sapiens
  misc_feature: GYAE6OF02F2KYX.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtgcccactcccaggtgcagcgtggtgcagtcgtggggctgaggtgaagagccgtggggcctgagtgaacggtctccgtgacgaaggtcctttcgtggactttccgtaaccggttttaccctccttaagttacgttacgtacctaaacgttcgggggttcgcccggcccgaaggggtccccgtacggttacgggaaccgtaaccggtacccgttacggaaggttcgggaagtttcggggggaacgttacgggggtaaccccgtaaaaccccgttaaacgaccggtttacggggtacggtttacccgaaccggttacggttcggttaccccgttttacccgaacccccgtaagtttacccccggtaccgggggtaaaccctaaccgggttaacccctttaacccggaacgtttaccggaaacccccgtaacccgttaaacccgtttaccccctaaaccgtaaaacccgtttaaaaaccaacccggtaaaccggtccccttaaaacggtaaccggttacgggggttaaaccggttttacgggaaacggggttaacccgttaccccggttaaggtaacccgttaaacgtttcccggttaaacggggaaaccccggttacccggaccccggggtttaacccgttacccgttttaaacgttttacccggtaccggttaacggttaacccgggacgggttaacccggtaccccccgtaagggtacccggttacccgggggttaccgaacccggttcccccgggtaacgggtacccgttaacccggggtcccgggtttaaccccgtttttcgggtaaccccgttcccggggttacccggggggg

SEQ ID NO: 209499 - DNA, 808 bp, Homo sapiens
  misc_feature: GYAE6OF02GF15P.17.25.C03.1.454.CMB.1.raw
  modified_base (244)..(244): a, c, t, g, unknown or other
  misc_feature (244)..(244): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtagaagaagccgtcggggccttcgagtggaaggtcctccgngcgaaggtcttcgtggtattcgtaccgtttacctcttatagtactctaacgtgggtcgcgccgacggccgacgtacggaacctaaccggaccgtaggaggtgggagttggggagtcggggaccgtaaacccctaacgacgttgggtacgtacgtacgtaggttcgttacctttaccaacccgtacgttacccgtacccgggtaacgtaaccgttaacccgtttaaccgaacgttaccggaaaccccgtaaccggtaaaccccttccccgtaaacctaaacgtaaaaccctaaccgtaaaccgacccgttaacgtacggtagggtaacgttacggacgggtaacctccgtaacgtacctacggtctaacgggaacccgaccggtaaccgggttacccttacgttaacgtttaccgtaggttcgaacggtaccgtcccgttaacccgtaaacgggttcccggttaccgggttaacgggaacccgttaccccggttaacgggtacccgtaccggggttacccgtttcccggtttacggtttaccccggttccgggtaacccgggggg

SEQ ID NO: 209500 - DNA, 696 bp, Homo sapiens
  misc_feature: GYAE6OF02JKMLJ.17.25.C03.1.454.CMB.1.raw
  modified_base (208)..(208): a, c, t, g, unknown or other
  misc_feature (208)..(208): n is a, c, g, or t
  modified_base (379)..(379): a, c, t, g, unknown or other
  misc_feature (379)..(379): n is a, c, g, or t
tcagcgtagactagcacgaccggtgctcgatttagtagtgtagatttgggtttgggagtcagtctcagtcaggacacagcatggacatgagggtccccgctcagctcctgggctcctgctactctggctcgagctgccagatgtgacatccaagatcgacccagtctccactccctccctgtctcgccttcgtggtcgggggtcaagngtccaccagtctacttgccggaacacgtcgacggtacgttaaaaccttatttaagttggtattcagcacgaaacgtaggaaaacacccgaagaccctctacgtactacttcgtggtacgactactacctactctcgaccgtaggtacggcctaccacgtacgtacggtacngtacgagtcggtagtctcgtagggactagttacttagtaaacttccgtactaaccgacgtaacctaccctaactacgtacctaacctaaccgtacgggtaaacggttacgtttaacggtacgttactaaaccgttacctaaccttacgttatacctaacgtaaaggtacgttaaccgtaccgtttacccgttaccgtacgttaccgtttacggaccgtaacggggtaacctaacggttacgtaacgtcgtaaacgttaaacgaaccggtgttacgggtccctaggacccttaccgtaaccttcgtaccgtttaaccg

SEQ ID NO: 209501 - DNA, 670 bp, Homo sapiens
  misc_feature: GYAE6OF02H10L9.17.25.C03.1.454.CMB.1.raw
  modified_base (155)..(155): a, c, t, g, unknown or other
  misc_feature (155)..(155): n is a, c, g, or t
  modified_base (175)..(175): a, c, t, g, unknown or other
  misc_feature (175)..(175): n is a, c, g, or t
  modified_base (186)..(186): a, c, t, g, unknown or other
  misc_feature (186)..(186): n is a, c, g, or t
  modified_base (218)..(218): a, c, t, g, unknown or other
  misc_feature (218)..(218): n is a, c, g, or t
  modified_base (230)..(230): a, c, t, g, unknown or other
  misc_feature (230)..(230): n is a, c, g, or t
  modified_base (278)..(278): a, c, t, g, unknown or other
  misc_feature (278)..(278): n is a, c, g, or t
  modified_base (330)..(330): a, c, t, g, unknown or other
  misc_feature (330)..(330): n is a, c, g, or t
  modified_base (651)..(651): a, c, t, g, unknown or other
  misc_feature (651)..(651): n is a, c, g, or t
tcagcgtagactagcacgaccggtgctcgatttagtagtgtagatttgggtttgggactcaacaaccacatctgtcctctagagaaaaccctgtgagcacagctcctcaccatggactggacctggaggctcctcttcgttggtgcagcagctanagtcgcccactcccgaggtncagctggtgcngtgtgggctggagtgaagacgccgtgggcctnagtagagtctcngacaggtcttcgagtctctacgtttcctctagtgtactcacgtggtcnccgacgcggccgagtacggaacaccggtaccgtggacggtaggaggtagggngacgggaacctaaacccgtaatcggtggtactacgtacgtcggttacgttcctaccgtaccctacggtcccggtaccggaactaaccgtacctttaccacgtacccgaacctaaccgtacctacccgtaactaaaccgaaacaccgtactaacccgtagtaacggttagggaacgttacgggtaagcgtacccttagaactcgtaacgaccgtaacgacccgtcgttaacgtaccttaagtccgtagcgttaccgaccgtacgtacccgtagacggttccggactaaccggttccggacgacgtcggttcccttcggtttntaccggtcgggtaaccggg

SEQ ID NO: 209502 - DNA, 711 bp, Homo sapiens
  misc_feature: GYAE6OF02FNW70.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctgggtgcagtcgtggggctggaggtgaagaagccgtggggcctcgaggtgaacggtcctcgtcgcgaaggtcttcgtggtattccgtacgtttaccctctatagttactacgtaacgtgggtcgccgccgacggcccgtcgtcggaacgaaccggtaccgttggacggtggagtggggagtcggggaccgaaccctaacgacgtagggtcgtacaacggtagtcgttccttccaccctaacgttcccggacgggaacctacggtaaccttaaccgacgtaccggaaccgaaccgtaacctaccttaccaaataaacccgtacaaccgtacctaacgtagacgggttaagttacggaacggacgtacccgtaaggacctaaagttccgacggttaacgacggacccgttcggtacctttacgttacgtcgtcggaacgacgtaccggttacccaggttaccgtccgggtaccgacggtacccgtagggccctaggtcccgggttactttcgggttaccgttcggtaccggggg

SEQ ID NO: 209503 - DNA, 761 bp, Homo sapiens
  misc_feature: GYAE6OF02GT0VE.17.25.C03.1.454.CMB.1.raw
  modified_base (646)..(646): a, c, t, g, unknown or other
  misc_feature (646)..(646): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactccaggtgcagctggtgcagtcgtggggctggagggtagaaggaacgtccgtgggggcctcgaggtgaaggtcctcctgacgaacggtcttcgtggtacttcctaccggttttaccctaccttaagtacgttaactccgtaaacggttgggtacggtccgaccgacgggcccggtcgtacggaaccgaacggacccgtggtaaggtggtaggtgggtaggtacggggaccgtaaacccgtaacgtacgtcgggttactaccgacgtaggttcgttaccttacccgtaccctacgtacccggtccgggaaccgtaccgtaacctaccgtacgtaccgaacccaaccgtaacctaccctacaaacgtaaacccacacgtacccgtaactcggtagggtaagttacgggacgtacgtcctaacggtaactacgttcccgaacggtaaccgaccggtacccggttacccgttatacgtttacncgggtactaccgacggttacggtacccctagggtaccggttccggttaccggaccggttacccggagttcccggacggttcccggttccgtttggtacccgtcgggtacccgggg

SEQ ID NO: 209504 - DNA, 849 bp, Homo sapiens
  misc_feature: GYAE6OF02FVYRO.17.25.C03.1.454.CMB.1.raw
  modified_base (254)..(254): a, c, t, g, unknown or other
  misc_feature (254)..(254): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtagaagacggccgtggggcctcgaggtgtaggtcctccgtgacaaggtcttcgnggtacttccgtaccgtttacctcttaattacgtaactaccgtaacggtgggtcgtccgaccgacgggtcccgtaccgtacgggaaccaaccggtaccgtacgggtagggtacgggacggtaggggtacggtaccggggaacccgtaaacccggtaacgtccggttagggtaccggttccgtaacggttacgttacgtttcccgttaccgaaccccgtaccgttacccggtacccggggtaacctaaccgggtacccttaaccgtaacgttacccggaaccctaacccggtaacccttcccttaaaccgaactaaacccgaccgtaaccgtaccccgttaagtacggtacgggtaacgttacgggaacggtaccgtaccgtacgtaacgtaccggttacgtaacggtaccggaccggtccgggttaacccttacgttaacgtttaaccggttcgggtacgtaaccggttaaccgtacccgttaccccggtaacggttaccggtacccggggttacgtacccggtaccggttaccggaccggttcccgggttacccggttaccggttttaccgtccgggttccgggttaaccggggg

SEQ ID NO: 209505 - DNA, 755 bp, Homo sapiens
  misc_feature: GYAE6OF02I6RSM.17.25.C03.1.454.CMB.1.raw
  modified_base (452)..(452): a, c, t, g, unknown or other
  misc_feature (452)..(452): n is a, c, g, or t
tcagcgtagactagcacgaccggtgctcgatttagtagtgtagatttgggtttggggactcaacaaccacatctgtcctctagagaaaaccctgtgagcacagctcctcaccatggactcggacctggaggatcctcttcttggtggcagcagctacagtgcccactcccaggtgcagctggtagcagtcgtggggctgaggtgaagaagtccgtggggcctacgagtgaaggtctccgtgaccaagggtccttacgtcggtattacctaccggttttaccctccttaagtagttaactaccgtaacgttggggtagccgaccgtagggcccgcgtacggacaaaccggtccgtaggacgtgggagttggggagttcgggacccgtaaccctaagacgtcgggtactcgaaccgtagttcgtccttacccgaccctatcccggtccggtaanaccgtaccttaccgtatacccgaccgtaaccgtaaccttccctaaccgtaaactaaacccgaacgtaaccgtaccctaacgaagtacggtaaggttacgaacgggtacctccgtacgatacgtccgtacgaaccggaccgtcccgggttaccgtacgttaccttacggtcggtaacgaccgggtacgtaccgtaccccgtaggtacccggttaccggtaacggtaccggtttaccgaaccgggtcgtaaccggggttcccggttaaccgttttcggtacccggttttcccgggacccgggggg

SEQ ID NO: 209506 - DNA, 703 bp, Homo sapiens
  misc_feature: GYAE6OF02GX6R2.17.25.C03.1.454.CMB.1.raw
  modified_base (449)..(449): a, c, t, g, unknown or other
  misc_feature (449)..(449): n is a, c, g, or t
  modified_base (496)..(496): a, c, t, g, unknown or other
  misc_feature (496)..(496): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctctgcaaggcttctggattcacgtttacctcctatagtatcaacgtgggtgcgccaggccgctggaacaacgacctggaggtggactgggacgtcgggaccgaaccctaacgacgtggtgtaccacgtgtcgtcttaccacccgacgtcccgtaccgggaacacgtaaccttaccagttacgacccgaacgtaaccctcccgtaacccaaagtaaaacccnccgtaaccgacccttaacgacgttagggtacgttaggaagggtaccncccgttaggaacctcgttacgtacgggaacccgtaccgtacccgggtccggtttacttaacggtttaccgtcggttaacgggaccggtaacggtaccgggtttaccccgaacgggtaacggtttaccgggtacggaacccggtacccggttaacgggccgtacgggtcccgggtttacctttcgggtacccttggggtacccggggg

SEQ ID NO: 209507 - DNA, 706 bp, Homo sapiens
  misc_feature: GYAE6OF02ICZDS.17.25.C03.1.454.CMB.1.raw
  modified_base (221)..(221): a, c, t, g, unknown or other
  misc_feature (221)..(221): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccgaggtgcagctggtgcagtcgtgggctgagtagagagcgtgggctcgagngaacggtctcctgacgaagggtcttcgtgggactttaccgtaccggttttacctcctaattagtacttacgaaccgttgggtacgccgtccggacgtccggcgtcggaacgaaccgtaccgtaggacggtggtacggtggggtaggttccgggaccgtaaacccctacggtacgtcgggttacgtacgacgtagtccgttaccgtaccctacccgtaacttccgggaccggtaacaccgttactaacccgataccggaacctaccgtaactccctaccgaaactaaactacgacgtccaacgtagtacggtagttacggacgtacgtccgtagaactgtacgtacgacggtacccgcgggttaccctcgttaacgttcgacggtagccgaagtacccgtccggacgtaccggttcggtaccgaggttacccgtacggtaccgcgggttcccggtttcggttaccgttcggttaccggtaccgggg

SEQ ID NO: 209508 - DNA, 642 bp, Homo sapiens
  misc_feature: GYAE6OF02HHQE6.17.25.C03.1.454.CMB.1.raw
  modified_base (455)..(455): a, c, t, g, unknown or other
  misc_feature (455)..(455): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagaagccgtggggcctcgaggtgaaggtcctccgtgacgaacggtcttcgtggtacttctaccgtttacctctaatagtatacaacgtgggtcgcgccacggccgcgtcggaaccaacgacctggagtggagtgggagtcgggaccgtaaccctaacgacgttggtacgtcaacgtgttcgtcctacacccactccggtacggacacgtacctactagtcgaccgaccaacttccaacaaacgtaaacnccgtaacgacctaacgtagtacgggtagttacggacggttacctccgatacatccgacgggtaccacggtccgtacctaatttaacgtcgtaggcgtaaccgacgtaccgtacctacggcgttccggtagaccggttcccgagccggtacggtccggttaccgtttgtacccgggttggtcccgggg

SEQ ID NO: 209509 - DNA, 869 bp, Homo sapiens
  misc_feature: GYAE6OF02IN978.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtgcagcagctacaagtgcccactcccaggtgctagcgtggtcgacagttcgtggggtctggtaagggtacgaaaggtaacggccgtcgggggcccttcgaggtacggaacggttccttccgagtacctaacggtccgttcgtagggtacttaccgtaccggttttaaccctacgtaacgttaagttacttaccgaacgttgggggtcctccggtacccgaacgggtcccggtacgtacgggaaaccctaaccggtaacctgggaaggttacgggtacggtaaggggaccgttcgggaacccggtaaaaccttaacgacgttcggtacgtaccacgtaggttcgtacccctttaaccgaaccctaccggttaccgtaaccggggaccttaacggtaaccctaaaccgtacgtacgaaaccctaccgtaacccgtacctaccgtaaactaaacccgtacgtaccgtacctaaccgtaacgtacggtacggttacgaaacgggttccgaccgtacgtaactaccgttacgaaccgtcgaaacccggtccgtaacccggttacgttaaaccgttcgttaacgaagggtaccgtaacgtacccgttaacccgacggtttaccgggtaccgttaccgggttaaacccggtaccggttacccggttaaaccggtcccggttcccggggttttaaccgttcccggttaacccgggttcgggttaaccccggggg

SEQ ID NO: 209510 - DNA, 845 bp, Homo sapiens
  misc_feature: GYAE6OF02JFOVH.17.25.C03.1.454.CMB.1.raw
  modified_base (180)..(180): a, c, t, g, unknown or other
  misc_feature (180)..(180): n is a, c, g, or t
  modified_base (187)..(187): a, c, t, g, unknown or other
  misc_feature (187)..(187): n is a, c, g, or t
  modified_base (194)..(194): a, c, t, g, unknown or other
  misc_feature (194)..(194): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttgggtggcagcagctacaagtgcccactcccgaggtgcngctggtnctgtcgngggctaggaggtgaagagccgtgggcctcgagtcgaagtcctccgtgactaaggtcgttcgtggacggacctaaccgtcgacgtaccgtacttagttaacgtttacgtaaggttcggggtacggaccggaccggggttacccttcgtaacggggaaccgtaacgggttcccgttagggtaaggtacggggtaaggtaccggggtaaaacgggtaccttcccgggtaccctttaaggtttccggtaaccgtaaccgaaccgtaaaccctaaaccgtacggacctaaaccggtaggttaacgtaccggacggtacgaacgtaccgtacccgtaaccggtaaccgtaaacccggacgtaaaacctaaacgttaaaccggaaccctaacgtttaaacgttaacgttactaacggggtacctaccgtaagaaaaccgtaccggtacgtttacgaacttacgtaaccggttagaacgggtacccgtaccgggtttacctttccggttaacgttcgtacgggtaccggtaacggtaaggttaacgttaacgtttaaccgtacttaaaccggtccgtttacgttaaccccttttcgtttaaaccccgtccgttaacccgttggtaacccggttttacggtccggtaccgttaacccggg

SEQ ID NO: 209511 - DNA, 959 bp, Homo sapiens
  misc_feature: GYAE6OF02G2ZV2.17.25.C03.1.454.CMB.1.raw
  modified_base (157)..(157): a, c, t, g, unknown or other
  misc_feature (157)..(157): n is a, c, g, or t
  modified_base (204)..(204): a, c, t, g, unknown or other
  misc_feature (204)..(204): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctacttcttggtggcagcagctanagtcgcccactcccgagtcgcagctggtcgcagtcgtggggctaggnggtacgaagaagccggtgggcctcgaggtggaacggtcctaccgtgactaacggtcttacgtggtacttacgtaaccgtttacctacgttacgtaagttactacctaacggttgggtacgccgaccgtaacgggtcccgacgttacggaaccctaaccggtacccggtggtaacgggtcgggtaacgtacgggggtaggtaccggggtacccgttaaaaccccggtaaaccggtccggtttaggggaccttaacccaacgggttaacggttacggtttacccctttaaccgaaccccgttacgggttaaccccgtccgggggtaaacccttaccgttaaaccgtttacccgtaacggtacccgtaacccggaaacccggttaacccctttaccccgggtaaccctaaacgttaaaaccccgtaccgaaaacccgtttaccctaacgttaacgggttacccggtaagggttttaccgggaaccgtaacgttaaccggttaacccgtaattaacccgggttcgtaaccgggtaaaccgggaacccgttacccgggggtaacctttaaccgtttaacgtttaacccggttaacggagggtttaaccccggaaggttaccccggtaaccccgtaaaccgggttccgttaacccggggttaacaacccggttaaccccggttaccgggacccgggtttaaccctacccgggggtttaacgttttcccgggggtaactttaccccgggggtaacccggggg

SEQ ID NO: 209512 - DNA, 818 bp, Homo sapiens
  misc_feature: GYAE6OF02F4S91.17.25.C03.1.454.CMB.1.raw
  modified_base (178)..(178): a, c, t, g, unknown or other
  misc_feature (178)..(178): n is a, c, g, or t
  modified_base (674)..(674): a, c, t, g, unknown or other
  misc_feature (674)..(674): n is a, c, g, or t
  modified_base (753)..(753): a, c, t, g, unknown or other
  misc_feature (753)..(753): n is a, c, g, or t
tcagcgtagactagcacgaccggtgctcgatttagtagtgtagatttgggtttggggtacgtcaacaaccacatctgtcctctagagaaaaccctagtgagcacagctcctcaccatggactggacctggaggatcctcttcttggtggcagcagctacaagtgcccactcccaggtncgagctggtgcagtcgtggggctgaggtagaagaagccgtggggcctcaggtagaaggtctcgtgacgaaggcttcgtggtattcctacgtttaccctacgttaacttagttacttacctaagttcggggtgacccggacctaacggggtcccggaccgttggggaaaccctaacccggaaccgttacggaacgggtttagggaagttcggggagttacgggggacccgtaaaccctaaccgtaacgttggtcggtaccacgtaagttggttacctttaccaccccgttaacgtcccgttaaccgggaacgtaaccggtaacctttaaccccgacgttacgaaccccgtaaccgtaaccttaacccgtacccaaaaccttaaaccgacgtaccgtaaccccgtaaacgtaccgtaacgggttacggttacggtaaacgggtacccgggtacccgttacggtaacctaccgtttaccgaacggtaccggtaaccccncggggtaccctttaccgttagtttaacccgttcgtacggaaccgtaggaccgtccccgtaaggaccggtttcccggganaccgtacccggttaccggccgtacgggacccggtttaccgttacgttaccgtgggtaacccgggg

SEQ ID NO: 209513 - DNA, 778 bp, Homo sapiens
  misc_feature: GYAE6OF02HEF3E.17.25.C03.1.454.CMB.1.raw
  modified_base (375)..(375): a, c, t, g, unknown or other
  misc_feature (375)..(375): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagcgtggtgcagtcgtgggctggaggtgaagagcgtgggctcagtgaggtctcgtgcgaggcttcgtggacttcgtaaccgtttacctcctagttagtactacaacgttggggtcgccgtccgacggtccggcgttacggaacctaaccgccgttggaggttagggtagtggggagtcggggtaccgaaacccgtaacncggttgggtctaccgacgtacggtttgtacccttaccaacccgtacgtcccggttaccgggaactacgtaacccttaccgagttaccgaaccgtaaccgtaacccgtcccttaacccgtaaaactaaaccaccgtaccgacccttaacgaacggttacgggtacggtttacggggaacgtacgggtccctttaagaaccgtaggttaccgttacgggaaacccggtaccggtaacccggggtcccgtttacgttaacgttttcgtacggtccgtaacgggtaccggacccggttacccgtaaccggtacggtaacccggtcgggaaccgtccccggttaacgggtcccggtaacggttccccggttacccgtttttaggtacccggttaccggggtaccgggg

SEQ ID NO: 209514 - DNA, 700 bp, Homo sapiens
  misc_feature: GYAE6OF02HCXH5.17.25.C03.1.454.CMB.1.raw
  modified_base (354)..(354): a, c, t, g, unknown or other
  misc_feature (354)..(354): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttctggtggcagcagctacaagtgcccactcccaggtgcagctgggtgcagtcgtggggctggaggtgaagaagccgtggggcctcgagtgaaggtctcctgcgaggcttcgtggtatctacgtttacctctatagtatctaacgtgggtcgccgccgacggccgacgtggaccaacggacctggaggtggagtgggtagtgggacctaacccgtanaccgtgtgtacacgtagtgtccttacacccgtaactcccgtaccgggacctaactcctacccgagtacgacccaacgtacccctacctaacccgtaaactaaaaccaccgaaccgtacctaaacgtacggttaggggtaaggttacggacgggtacgaccggtttacgaactacggtacttaacggaacccggtacgacccgggtccggttaacttacgtttaacgtggttaccgacggtacgtaccgtaccccgtaggtacggttcccggaggtaacccgtcccggttaacgggaccgtcgggtcccccggttaggttttacggtacccgtttccgggtacgggg

SEQ ID NO: 209515 - DNA, 897 bp, Homo sapiens
  misc_feature: GYAE6OF02FPNNF.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctccgtgcgaaggcttcgtggattctacgtttacctctatagtactactaacgtgggtacgccgtaccgacgggcccgtaccgtacggaaccaaaccggtacccgttggtaacggtagggaaggttcgggggtaacgttcggggggaacccgtaaaccccgttaaaccggtaccggttacggggttacgtaccgtaaccgaacgggtttcggttacccttacccgtaacccctacgttccccggttacccgggggaaacctaacgggttaaccccctttaacccgaaacgttaccggaaaccccgttaacccgtaaaccccgttacccccgttaaacccgaaactttaaaaaccccgacccgtaaccgtaccccgttaaacggaaccgttacgggggtaaacggttttacggggaaaccggtaaccggtacccttagggaaacctagtttacccgtaaacgggaaccccggtaacggtaccccgggttacccttaccggtttaaaccgtttacgtacgggtttacggaccggtaacggtacccgggtacccctaaccgggtcggttacccgggtaccggtaacccggtaacccggtttaccgggacccgttacgggttacccccggggttaccttttaccggtacccgggttttaccggaccccgggggg

SEQ ID NO: 209516 - DNA, 722 bp, Homo sapiens
  misc_feature: GYAE6OF02HDL9V.17.25.C03.1.454.CMB.1.raw
  modified_base (300)..(300): a, c, t, g, unknown or other
  misc_feature (300)..(300): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggagtgaagaagccgtggggcctcgagtgaaggtctcctgacaaggcttcgtggattctaccgttttacctcctatagtatcaacgtgggtgcgccaggcccgngtaggaccaaccgacctggaggtacggagtggggagtcggggaccgtaaaacccctaacgacgtgggtgtaccacgtaggttgttccttaccacccctatcccggtaccgggtaacacgtaaccttaccagtacgaaccctaacgtaaccctccctaaccaaactaaaccacctacgacctaacacggttggaacggtttagaggactccgtagaactcgtacgtacggaaccgtaccgaccgggtaccttaccgttacgttaacgtcggtaacgacgggtaacgtaacccggtaccccgtaaccgtaacgggttaccccggggtaagtaacccggtaccccggttaacggggacccgttaacccggggtcccgggtttacccgtttttaccgggtaccttttcccgggggtacccgggggg

SEQ ID NO: 209517 - DNA, 592 bp, Homo sapiens
  misc_feature: GYAE6OF02I25LD.17.25.C03.1.454.CMB.1.raw
  modified_base (559)..(559): a, c, t, g, unknown or other
  misc_feature (559)..(559): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcgaggtggaggtctcgtgcaaggcttcgtggattcaacgtttacctcctatagtatcaacgtgggtgccgaccaggccgctggactaaccgactgagtggagtgggatggggaccgaacctaagctgggtcgtacactagtgttcctaccaccctatcccgtacggacacgtactaccagtcgaccacgtaacctctaccaataaacacacgtaccctacagtcggtagttacggacgtacgcctagactacgttcacggaccgacgaccggtccgttattagttacgtgtcggcgtaacgcgtaccgacggtacgtcgggtacgacgtccgtaccggngtacggccggttcttggaccgttcggtacgggg

SEQ ID NO: 209518 - DNA, 801 bp, Homo sapiens
  misc_feature: GYAE6OF02F4N5K.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagccagctacaagtgcccactcccaggtgcagctggtgcagtcgtggggctgaggtgaagagccgtggggcctcagtgaacggtctaccgtgacaaggcttcgtggtattcgtaacgtttacctacctaattagtactcgtaacgtggggtcgtccgccgacggccgtctacggacaaccgaccgtggtacggtggagtgggacgttacggggaccgtaaacccgtacacgttcgggtacgtaccgacgtacgttcgttaccttaccgaaccccgtacgttccccgtaccgggggtaactaacgggttaacccttaacccgtaacgtaccggtaaccccgaacggtaaacccctttacccgtaacccaaaccttaaaacccgaccgtaaaccgtacccttaaccgtagttaaccgggtacggttaacgggaacgtaacggttcccttaaggacctaagtccgtaacgaaccggttaccggaacggtacccgttatttaacgttacgtcggtaacgtccggtaaggtcccgtaaccccgtaacggtaccgggtacccggttaacgggaacccggttaaccccggtttacgggaccttacggggtaaccccgttttacccggttttcggtaacccgtttccgggtaacccgggggg

SEQ ID NO: 209519 - DNA, 694 bp, Homo sapiens
  misc_feature: GYAE6OF02FLNAD.17.25.C03.1.454.CMB.1.raw
  modified_base (319)..(319): a, c, t, g, unknown or other
  misc_feature (319)..(319): n is a, c, g, or t
  modified_base (362)..(362): a, c, t, g, unknown or other
  misc_feature (362)..(362): n is a, c, g, or t
  modified_base (410)..(410): a, c, t, g, unknown or other
  misc_feature (410)..(410): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaacgccgtggggaccttcgaggtgaagggtcctcctgccgaaggtccttactggtacttccgtaccgtttaccctccttaatagtatctaacgtgggtgcgcccagggccncgtggacaacgactgagtggagtgggatgggaccaaccctaancgtggtctactacgtagttcgtcttccaccctacgtccgtccgggaanacgtactaccgtacgtacgacccaacgaacctcccgtacctaactaaaacaccgtaacgtaccctaaccgagtaggaacgttaggacgtacgtacccgtagacgtaatccgtacgacggtaaccgacccgggtaccgtaccgtttaagttaccgttcggttaggacccggtagggtaccgtacccggtaccggtaaaccggttccggtacgggaccgttaccggaaccggcggtaccggtccgggttacccgtttacggttacccgttccgggtaacccggggg

SEQ ID NO: 209520 - DNA, 867 bp, Homo sapiens
  misc_feature: GYAE6OF02HI45O.17.25.C03.1.454.CMB.1.raw
  modified_base (247)..(247): a, c, t, g, unknown or other
  misc_feature (247)..(247): n is a, c, g, or t
  modified_base (278)..(278): a, c, t, g, unknown or other
  misc_feature (278)..(278): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccagtgcagctggtgcagtcgtgggctggaggtgaagagccgtggggcctcgagtgaaggtcctcctgcgaagcttcgnggtacttcgtacgtttacctctatacgttanctaacgtgggtgccgccgacggccgcgtacggaaccgtaaccgaccgtggtacggtagggtacgtaggggtacggtaggggtaccccgtaaaaccccgtaacggtaacggttcggggttacgtacctaacggttacggtttacggttaccctttacccgtaaccccctacgttaccccgggttacccggggaacccgttaacggtaacccgtttacccgaacgtttaaccggaacccctaaccggtaaacccctttcccccgtaaacctaaaacctaaaccgtaacctaaccgttaacccttaacggagttaaccggggtagtttaccgggaaagggttcctacccgtagtaaacctagttaccgtaaccggggaaccctacccgggacccggtttaaccccttaaggttttacccgttaaacgttccgggttaccgggaacggttaaccggaccccgtacccctttaacgggtccccgtacccgggggttaagtaacccccgggttaccgtacccgggaccgggtaaccgttccccgggtttaaccggttttacccgggtacccggtttccggggttaaccccggggg

SEQ ID NO: 209521 - DNA, 857 bp, Homo sapiens
  misc_feature: GYAE6OF02G1A5K.17.25.C03.1.454.CMB.1.raw
  modified_base (178)..(178): a, c, t, g, unknown or other
  misc_feature (178)..(178): n is a, c, g, or t
  modified_base (189)..(189): a, c, t, g, unknown or other
  misc_feature (189)..(189): n is a, c, g, or t
tcagcgtagactagcacgaccggtgctcgatttagtagtgtagatttgggtttggggactcaacaaccacatctatcctctagagaaaaccctgtgagcacagctcctcaccatggactggacctggaggatcctcttcgtggtggcagcagctacaagtcgcccacctcccgaggtncgagcgtggtncgtagtcgtgggctggagtaggaagagtccgtcggggcctacgaggtagaacggtccttaccgtcgcggtaacgttcgttaccgtggttacgtttccgttaacccggtttacccttccgttaacgttaacgttaacgttaccgtaacggttgggtaccgtcccgtaccgacggtcccgcgtaacggaaccgaaccggtaccgtacggtaggtacggtaggtacgggacggtaccggtaaccgtaaaccccgttaacgtaccggttacggtaccgttaccgtaacggttacggttaccgtttaacccgttaacctaccccgttaaccggttcccggttaaccggaaaccgttaccggttaaaacccgttccgtaaccgttaacccgtaacccccgtaacccgttaacccgttaccccgtaaaccgtaaaccgtaaaacccgaacccgtaaccgtaacccgttaaaccgtacggtaggttaacggttaacggtacgggtacgttacccgtacgtaaccgtaccgtccggtacgtaaccggtaccggtacccgtaccgttacgttacgttgtacggtacgtacggcgtaccgacccgtacggtaccggtaccggtacaccgtccgtaccggtcggtaccgtccggttcgtaacgtcgttaccggtaccggg

SEQ ID NO: 209522 - DNA, 672 bp, Homo sapiens
  misc_feature: GYAE6OF02FNS7M.17.25.C03.1.454.CMB.1.raw
tcagcgtagactagcacgaccggtgctcgatttagtagtgtagatttgggtttggggagtcagtctcagtcaggacacagcatggacatgagggtccccgctcagctcctggggctcctgctactctggctcgagctgccagatgtgacatccagatgacccagtctccatcctccctgtcctgcctctgtgggggtcagagtcacatcacttgccggacaagtcacggtacgttaaaaaccttatttaaagttggtatcagacaagaaaccgtggaaaaacgccccaagaccctcctgactctcgtggtacgccaattcccactcgtacgccgtaagtcggtaccgtccccgaagtccgtaaggtttcgaaggtcggactagggtcggaatcgtagggacaagtacttacgaatcgtacacctatccaacctacgtctactacgacctaggtaactagttcgtagacgtaacttaccttaacgttacttacgtaccgtaaactacgtaggttaaccgtccgtttacccccgtacgtaccgtttacgtttacggttcccggaacggggttaacctaaacgggttacggaagttaaccgtaaccgtaaaaccgggttacttaacgggttacggtaccgttacgacgtaacccgtacttcgttacgtttacccg

SEQ ID NO: 209523 - DNA, 553 bp, Homo sapiens
  misc_feature: GYAE6OF02HKGIZ.17.25.C03.1.454.CMB.1.raw
  modified_base (289)..(289): a, c, t, g, unknown or other
  misc_feature (289)..(289): n is a, c, g, or t
  modified_base (474)..(474): a, c, t, g, unknown or other
  misc_feature (474)..(474): n is a, c, g, or t
  modified_base (504)..(504): a, c, t, g, unknown or other
  misc_feature (504)..(504): n is a, c, g, or t
tcagcgtagactagcacgaccggtgctcgatttagtagtgtagatttgggtttggggactcaacaaccacatctgtcctctagataaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtgcgccaggccnctggacaacgcctgagtggatgggatggggacaaccctaacacgtggtgtcactagtgtcttcaccctactccgtccgggacagaccttaccatcgaccaaccgactcctaccaataaaccacacgcctacatggaattggagacgcctagacatctagacgacgaccggcctactatttaccgngtcgcgagactcccgacggtacgtcccggnaccggtacccgtacggcacggccggtcctttacggccttcggtcggggg

SEQ ID NO: 209524 - DNA, 643 bp, Homo sapiens
  misc_feature: GYAE6OF02F1WCS.17.25.C03.1.454.CMB.1.raw
  modified_base (203)..(203): a, c, t, g, unknown or other
  misc_feature (203)..(203): n is a, c, g, or t
  modified_base (285)..(285): a, c, t, g, unknown or other
  misc_feature (285)..(285): n is a, c, g, or t
  modified_base (326)..(326): a, c, t, g, unknown or other
  misc_feature (326)..(326): n is a, c, g, or t
  modified_base (372)..(372): a, c, t, g, unknown or other
  misc_feature (372)..(372): n is a, c, g, or t
  modified_base (386)..(386): a, c, t, g, unknown or other
  misc_feature (386)..(386): n is a, c, g, or t
  modified_base (419)..(419): a, c, t, g, unknown or other
  misc_feature (419)..(419): n is a, c, g, or t
  modified_base (460)..(460): a, c, t, g, unknown or other
  misc_feature (460)..(460): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctcggtgccagtcgtggggctaggnggtagaacgaagccgtggggccttacgaggtagtaacggtctccgtgacgtaagtcttcgtggtaattcgtaccgtttaccncgttattagtactcgaactggggttacaccgcgaggcccgngtggaactacgacgtcggagtggatgggactgggaacccaacctancgtggtcactacgngtcgtactccaccctagtcccgtcggaacctanaccttaccgaagtaccgaacctaccgacctccgtaccaaanaacgacaccggtaccaacgacggtggaagttcggaggtacgtacgtacgacaattccgaacgacgaccgtaccgccgttacttaacgttaccgtgcgacggtacaccgaccccgtaggacggtaccggtacgacgtccgtacggacgtcggtacccgttactttccggacgttcggtaccggg

SEQ ID NO: 209525 - DNA, 788 bp, Homo sapiens
  misc_feature: GYAE6OF02GK8W0.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtagagaagccgtgggcctcgagtgaggtctccgtgcgaggtctcgtggattctacgttacctctatagtactcaacgttgggtcgcgccgacgggccgtcgtacggaaccaaccggaccgtggaggtaggagtcggggaggtcgggaccgtaaacccgtaacgtcggtcggtcgtaccgacgtacgttcgtaccttaccacccgtacgtccccggtaccgggtaacctacggtaaacccttaccgaacgttacccgaaacccgtaacccgtaacccttcccctaaccctaaacgttaaacccaccgtaaccgtaccctaacgtacggtttaggacggttacggaagggtacctcccgtaacgtaacctcgttaccgtaacggtacccgtaacccgggtcccggtacccgtttactttaaccgtttaccggttacggtacggtacccgtaaggttaccccgttaccccggaacgggttcccggtaccgggttaccggaaccccggttacccgggtaaccgggtccggaacccggggtttccggggttaccccttttacggggttaccccggttcggggttacccggggg

SEQ ID NO: 209526 - DNA, 798 bp, Homo sapiens
  misc_feature: GYAE6OF02HF9WB.17.25.C03.1.454.CMB.1.raw
tcagcgtagactagcacgaccggtgctcgatttagtagtgtagatttgggtttgggggactcaacaaccacatcctgtcctctagagaaaacccctgtgagcacagctcctcaccatggactggacctggaggatcctcttcgttggtggcagcgagctacaagtgcccactcccaggtgcagctggtgcagtcgtggggctggaggtgaacgaagccgtggggcctcgaggtgaaggtctcctgacgaacggcttcgtggtacttccgtaaccggtttaccctacctataacgttactacgtaaccgttgggtcgccggacccgacggccgccgtcggaaccaaccggaccctggtacggtaggtaagtaggggtagtcggggaacccgaaaccccgttaaccgtaccggttaggtccgtaacgaccgtaggttcgtccgttacccgtaaccccacgttccccggtaccgggtaactaccgtaaccttaaccgaacgttaccgaacccgtaaccgtaaacccgtacccctaaccgtaaaactaaacccgaacgtaacgtaccctaacgtatacgggtagttaacgggtaggtaccgtaccgtaagtacctacgtaccgtacggaaccgtacggacccggttccgtaacgtttaccggttaaccttcgggtaaccgggacgttaacggaccccggttaaccgtaaccggtaaccgttcccgggtacggtaaccgtacccggtaaccggtcgaaccgggttcccggtaccttttcccggacggttcccggtaccggggg

SEQ ID NO: 209527 - DNA, 700 bp, Homo sapiens
  misc_feature: GYAE6OF02GGR5R.17.25.C03.1.454.CMB.1.raw
  modified_base (539)..(539): a, c, t, g, unknown or other
  misc_feature (539)..(539): n is a, c, g, or t
tcagcgtagactagcacgaccggtgctcgatttagtagtgtagatttgggtttggggactcaacaaccacattctgtcctctagagaaaaccctgtgagcacagctcctcaccatggactggacctggaggactcctcttcttggtggcagcagctacaagtgcccgactccgaggtgcagctggtgcagtcgtgggctgaggtagaagagccgtacggggccttcgaggtacgaaggtcctccgtagcaaggtcttacgtggtattccgtaacgtttaccctcgtaagtagttactacgtaacgtgggtcgcgccgacggtccgacgtcggaaccaaccgtccgtgaacggtggagtcggggagtcggggaaccaacccgtaagacgttacggttcgacgtagcgttcgtcctacgacccgtactccggtacgggatacgtaccgtacacgtacgaccaaccgtaccgtaccctagaactaacacgtaactaccctaagtagtaccggtagttacggacgtacgaccgtacgaccgtnttacggacgtaacccgtcgaaccggttccgttacttaacgtttaccgtggtaccgacgtacgtaccgaccgtaaccggttcggtacgtcggtaaccggtaccgtaccggacgttacgggttaccccggttcgtttaccgtaccggtttcgggaacccgggg

SEQ ID NO: 209528 - DNA, 630 bp, Homo sapiens
  misc_feature: GYAE6OF02JY8F7.17.25.C03.1.454.CMB.1.raw
  modified_base (237)..(237): a, c, t, g, unknown or other
  misc_feature (237)..(237): n is a, c, g, or t
  modified_base (267)..(267): a, c, t, g, unknown or other
  misc_feature (267)..(267): n is a, c, g, or t
  modified_base (304)..(304): a, c, t, g, unknown or other
  misc_feature (304)..(304): n is a, c, g, or t
  modified_base (355)..(355): a, c, t, g, unknown or other
  misc_feature (355)..(355): n is a, c, g, or t
  modified_base (467)..(467): a, c, t, g, unknown or other
  misc_feature (467)..(467): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctggaggtgaagagccgtggggcctcgagtgaaggtctccgngacgaggcttctggtattcgtacgtttccncctatagtactacaacgttgggtgcgccgacggccgntacggacaacgtacctggacgtggagttgggagtcgggacaaacccgtaanacgtgggtctcagacgttgtccttacaacccacgtccgtaccggggactacgtaaccttaccgatccgaaccacgtaacctcctactaacaaacgacaccgtaccacgtagnggagttcggacgcgctacgacattccgtggaaccgccgtaccggtcgtacttacttaaccgtgacgtaccgtggacccttcgaaccggtccgttcgggtcgtaaccgtacccgtacggctaaccggccgggtttacctttacggacgttcccgggtaccgggg

SEQ ID NO: 209529 - DNA, 789 bp, Homo sapiens
  misc_feature: GYAE6OF02GEJS9.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggtagcagctacaagtgcccactcccaggtgcagctggtgcagtcgtggggctggaggtgaagaagccgtggggcctcgagtgaaggtcctcctgctaaggcttcgtggacttctaccgttttaaccctcttaatagttatactaacgttgggtcgccgccgacgggcccgcgtacggaacctaaaccggaccgtaggaacggttagggaagttagggggagtacgggggacccgtaaaaccccgtaactacggttcgggttacgtaccgaccggtaagttcgtttaccctttacccgaacccctacgttcccccggtaaccggggtaactaaccgggtaaacccttttaacccgaactaaccggtaaaccccgtaacccggttaaaccttaccccttaacccgtaaaacctaaaaacccgtaacctaaaccgtaccctaaaacgtaacggtacgggttaacggtttacgggaacgggtaccgtaccgtacgtacctacgttaccgtcggtaacccgaaccggtacccgggtacccgttacgttactttacgtagtcggacgacgtaccgtacccgacgtacggttcggacgaccgtccgtacgagacggtccggttccgttacgtaccgttcggtaggacccgg

SEQ ID NO: 209530 - DNA, 612 bp, Homo sapiens
  misc_feature: GYAE6OF02GXVRB.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcgagtgaaggtctcctgcgaaggcttcgtggattcacgtttacctcctatagtatcaacgtgggtgcgccaggccgcgtggaccaacgacctggagtggatgggatcgggacgaaccctaacgacgtggtcgtcacagtgtccttacaccctatccgtaccgggacacgacttaccatcgaccacgacctccctaccaataaaccacacgacctacagtggagttgaggcgcctgactgtctaggaaccgacgaccgggtcccgttactaacgtttaccgtggtacgaccggtaggaccgttaccccgaacgtaacggttcccgggtagaccggtacccgtacgggccgtacgggccggttacccttttggtaccgttcgggtacccggggg

SEQ ID NO: 209531 - DNA, 706 bp, Homo sapiens
  misc_feature: GYAE6OF02HAQMJ.17.25.C03.1.454.CMB.1.raw
  modified_base (293)..(293): a, c, t, g, unknown or other
  misc_feature (293)..(293): n is a, c, g, or t
  modified_base (304)..(304): a, c, t, g, unknown or other
  misc_feature (304)..(304): n is a, c, g, or t
  modified_base (386)..(386): a, c, t, g, unknown or other
  misc_feature (386)..(386): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctccgtgacaaggcttcgtggtacttcgtaccgttttacctccttatagtatcaactgggtncgccaggccgntcggaacacgacctggagtggacgtgggagtcgggacctaaccccgtaacgacgttggtcggtacacaggttctccttaccnccctactcccgtacggggacacggtaccttaccgaatccgaacccgtacgacctccctaccaaactaaacccaactaccgacccttaccgaagttacgggtaacgttagggacggtaccggcttacgaccaacttccgaacggaacccgaccggaacccgggtcccgtttaacttacgtttacggtacgttacggaccgggtaccgtacccgtccccggtaaggtacccggttccgggtaccgggtacgtaccccggttaccgggccgtacgggtccccgggttacccgtttacggttacccggttacgggtcccggggg

SEQ ID NO: 209532 - DNA, 715 bp, Homo sapiens
  misc_feature: GYAE6OF02HQP5W.17.25.C03.1.454.CMB.1.raw
  modified_base (301)..(301): a, c, t, g, unknown or other
  misc_feature (301)..(301): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatcgacccagtcctccactccctccgtgtctcgcctcgtggtgggggtcagacgtcaccatcacttcgccggacaacgtccgacggtaacttaaaaccttaatttaaagttggtactcgagacaacgtaaaccgaggaaaaccncccaacgtaccctcgtagtactccgtcgtggtacgacacttcccacttcgtaggaacgtacggtcggtaccctacccgtagtccggtaggttaccgcggtacggcgtaggtcggtacgtcggtacgggaactagtttactacctaacgttacccgacaacctacgtacccaccgtccttacgaccgtaacgtaccgtagggtacgtacgttcgacgttaacttaaccgttccgttaacgtacgtactaaccgaagttaaccggtacttacccgttaccgtttccccgtacgttaccgtttacggttaccggaccgggttaaagtaccgttaggttagaaccgtaactaaacccggtaaggtccgttacggcgttacctaacgacccgttacgttacccgttgttcccttaaccg

SEQ ID NO: 209533 - DNA, 785 bp, Homo sapiens
  misc_feature: GYAE6OF02I51MP.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggactggaggatctcttcttggtggcagtcagtctacaagtgcccactcccaggtgcagctggtgcagtcgtgggcgtagaggtgaacgacggccgtcggggcctcgagtgaacggtctccgtgacgaggtctcgtggtattctaccgtttacctcttatacgtactacgtaacgtgggtcgtaccgaccgtacgggcccgtacgtaccgggaaccgtaaccggtaacccgttggaagggtttacgggaagttcggggtaacggtccggggtaacccgtaaacccgtaacgtacggttcgggtacgtaccgtacgtacgtttacgtaccttacccgaaccctacggtacccgtaccgggaactaaccgttaaccgttaaccgcgtaacgtaaccgtaccgtaaacccttacccgaactaaaccgtaaaaccgacttacgtacctacgtaacggtagggttacgttacggaacgtacgtcctaacgtaactacggcttaacggaccgtaaccgtacggtacccttaggttaactttcgggtaactacggcgtaaaccgtaccgggtaccctaccggttaaacgggtcccggttacgggtaccgtaccccgtacgggaccgttccgggtacccggttccttaacggtttcccggtaaggtcccggggg

SEQ ID NO: 209534 - DNA, 676 bp, Homo sapiens
  misc_feature: GYAE6OF02GT2ZA.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagccgtggggcctcagtgaaggtctcctgcaaggtcttctggattctacgtttaccctccttatagtatcaacgtgggtgcgccacggccgcgtggaccaacgacccgtggaggtggagtggggagtcgggaccgtaaacccgtaactacgtggtcgtacgacgtagttcgttcttaccaccctactcccgtaccgggactagtacccttaccatacgacccaaccgaacctcctaccaaataaaccactacgccctaacacgttgggtaaggttggacggtacgcccgtagacctacgttacgtacggtaccgaccgaccgggtccgttacgttaaccgttcgtcggttacggccgtaacggtaccgtacccgaccggtaacggttcccgggtacgtaccggtacccgttaccgggaccgtacggggttcccggttacccttttcggtaccgtttcgggtacccggggg

SEQ ID NO: 209535 - DNA, 784 bp, Homo sapiens
  misc_feature: GYAE6OF02IU4PX.17.25.C03.1.454.CMB.1.raw
  modified_base (593)..(593): a, c, t, g, unknown or other
  misc_feature (593)..(593): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcctggggcctcagtggaaggtctccgtgaccaggcttctaggacttctacgtttaccctctagttagtacactaaccgtggggtcgtcgcccgagggcccggccgttagggaacccaaaaccgtccgtaggacggtaggggaacgttggggaacggtcgggggaacccgtaaacccctaaccgtaccggttacgggtcgttaccgtaaccgtagggtttacgttcccgttaacccacccgtacgtccccgttacggggacctacgtaccttaaccgacgtacggtacccgaaaccgtaccctcccaacgaaactaaaccgtaccacgtaccccttaagacttagggtaggttacgggaacggtaccgaccggtaacgtaacctntaaccgtacggtaacccggtacccgtaccgggttcccgttaacgtacgttttacggtcggtttacggaacccgggtaggtaccccgttcccgggaaccggtccggtttacccgggtacggtaaccggtccggtacccgggtacgtaccgggtcccgttacggtttccggtaccggttacggggtcccgggg

SEQ ID NO: 209536 - DNA, 689 bp, Homo sapiens
  misc_feature: GYAE6OF02JFQT1.17.25.C03.1.454.CMB.1.raw
  modified_base (187)..(187): a, c, t, g, unknown or other
  misc_feature (187)..(187): n is a, c, g, or t
  modified_base (223)..(223): a, c, t, g, unknown or other
  misc_feature (223)..(223): n is a, c, g, or t
  modified_base (267)..(267): a, c, t, g, unknown or other
  misc_feature (267)..(267): n is a, c, g, or t
  modified_base (292)..(292): a, c, t, g, unknown or other
  misc_feature (292)..(292): n is a, c, g, or t
  modified_base (308)..(308): a, c, t, g, unknown or other
  misc_feature (308)..(308): n is a, c, g, or t
tcagcgtagactagcacgaccggtgctcgatttagtagtgtagatttgggtttggggactcaacaaccacatctgtcctctagagaaaccctgtgagcacagctcctcaccatggactggacctggaggatcctctcttggtggcagccagctacaagtcgcccactcccgaggtgcagctgggtcncagtccgtgggctgaggtgaagtagccgtgggcctnagtagaaggtctctgcaggtcttcgtggattcgacgttttaccncctagttagtatacaacgttgggtnccggaccaggtcccgngttggaaccaacgaccgttggaggtaggtagtggggtactcggggacctaacccctaagtaccgtggtcggtaccatacggtgttaccttaccgaccctacgtcccggtacggtaccacggaaccttacccgtagtacgtacccaccgtaacctccctacgtaactaaacccgacgaaccgtccttaaacgagaccgggttaaaggttcggtaaaccggacggtacccttagaccttagtacgttaggaacccggtaccgaaccggtcccgttaacttaccgttacggtcttaacgggcgtaacgtcggttacccacggttcgccgtacggaccgacctcggaccctacgggtccgttaccgttcgacccttcggtacggg

SEQ ID NO: 209537 - DNA, 976 bp, Homo sapiens
  misc_feature: GYAE6OF02HR171.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtgcagcagctacaagtcgccccacctcccgaggtcgcagtcgtgggtcgctaggttcggtagggggcctgggtaaggtgaaaggaacgcccggttacggggcctaccgacggttaggaacgggttcctaccgtaggacctaacgggtccttacgttacgggtactttaccgttaacccggttttaaccctaccttaagttagttacttacccgtaacggtttcggggtccggtaccggtaccgaaccgggtccccgacggttagggacccaaacccggtaccgttagggtacggtacggacggtaggggacgggtacggggtaacccgaaaacccgttacgaacggttcgggttacgtacccgtaacgtaacggtttccggttcccgttaacccgacccgttaccgttaccccggacccgggtaacctaacgtttaacccgtaacctaaccgggtacctaaaccccgtaaccggtaaccctaccctttaaccccgaaagtttaaacccgtaacgacccggtaaccttaaccgtacgggttaggtaacggggttttacggaaccggtacggtacccgttaacggtacccttaaggtcccggttaaggaaaccccggaaccggaaccggggtccccgtttaaacgtttaaggttccgttaccggacggttaacccgggtaaccgtaccccgggttaccgtaccggttaacccggttccccgggttaacggaacccggttaaccccgggaaccggttccgggtaacccgggttacccggggtttaccccgggttttcggttaaccccgggtttcccggggttaaacccggggggg

SEQ ID NO: 209538 - DNA, 769 bp, Homo sapiens
  misc_feature: GYAE6OF02H66ET.17.25.C03.1.454.CMB.1.raw
  modified_base (607)..(607): a, c, t, g, unknown or other
  misc_feature (607)..(607): n is a, c, g, or t
tcagcgtagactagcacgaccggtgctcgatttagtagtgtagatttgggtttggggtacgtcaacaaccacatctgtcctctagagaaaaccctgtgagcacagctcctcaccatggactggacctggaggatcgtcttctggtggcagcagctacgagtcggcccactcccaggtcgacagcgtggtcgcgaggtcctgggggtctggaggtaggaaggaagccggtggggacctcgaggtggaaggtccgttcctggacgtaacggtcttacgtggacttccgtacgtttacctcgtacttagtactacgtactgggtacgcgtccgaccggcgtacgtgggaaacctaaccggtacctgggaacggttggaaggtggtacgtacggggacccgtaaacccgtacggtacgccgggttgtaccgaaggttacggtcggttacccgtcctaaccccgttcgtacccgtccggggaaccctaaggtaccccgtttacaacgtcccgtaaaccaccggtacctacccgttacgtaaaacctaaacctaacgaccgtacctacgtaacgttacggtaacgttgggaccgttacggtacctccggtaanaccgttacggtaccgtaaccggccgtaccggtaccgtacgttaccgttaacgtcgtaacgtccgtaacgaccggtccgtaccgtaacggtccggttcggaacggttaccgaccggtacggaccggttaccggttccgttcggttaaccggttcgaccggggg

SEQ ID NO: 209539 - DNA, 694 bp, Homo sapiens
  misc_feature: GYAE6OF02F3WWB.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcgagtgaaggtctcctgcaaggcttctggattcacgtttacctcctatagtatcaacgtgggtgcgccaggccgctggacaacgacctgagtggatgggagtgggaccgaaccctaacgacgtggtcgtcacagtgtccttccgaccccacttcccgtacccggggaactacggtaacctttaacccgaagttcgaaccctaccgtaaaccctccctacccaaactaaaaccacctaaacggaccccttaacgaacgttagggaacggtttacggaagggtacgacccgtagtacctaacttcgtacggaaccggaccgtaacccggtcccgttacgttaaaccgttaacgttggtacggaccggtaagtaccggtacccgtaacggtaaccggtaccgggtcgtaaccggtacccgttaacgggccgtaacggtccgggttacccttttacgggtaccgtttccggtaccggggg

SEQ ID NO: 209540 - DNA, 837 bp, Homo sapiens
  misc_feature: GYAE6OF02JK97L.17.25.C03.1.454.CMB.1.raw
  modified_base (175)..(175): a, c, t, g, unknown or other
  misc_feature (175)..(175): n is a, c, g, or t
  modified_base (328)..(328): a, c, t, g, unknown or other
  misc_feature (328)..(328): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttctggtggcagcagctacaagtgcccactcccaggtcncagctggtgcagttcgtgggctggaggtgaagacgccgtcgggcctcgagtaggaacggtcctaccgtgaccgtaaggtcctttacgtgggtaactttccgtaccgttttaccctccttaagttacgtactaccgtaaacggttcggggtacncccggtacccgtacgggcccggtcgttacggggaaaccccaaccggtaacccgtaggtaaccggttgggaacggttacgggggtacgttaccggggaaacccggttaaacccccttaaaccggtcgtttacggggttacctaccgtaaaccggttcgggtttcgttaacccgtttaccccgaaacccgtaacccgttcccgggtaaccggggtaactacccgggttaaccttaccgtaacgtaccgtaaccccgaaccgttaaccttaccccggtaactaaaacgtaaaccctacgggaaacctcccgtaaaccgtaagtacgggttacggttacggaaccgtacgtcccgtaacgctaccgttacgaacgacccgacgttaaccggtccgtaactttaacgtaccggtgaaccggtaacgtcggaccgttcccacggtaaccggttcggacaaccggtcccgtaaggcctaacggtccgtttcccttagggtacctttacgggccggg

SEQ ID NO: 209541 - DNA, 656 bp, Homo sapiens
  misc_feature: GYAE6OF02FGCJK.17.25.C03.1.454.CMB.1.raw
  modified_base (189)..(189): a, c, t, g, unknown or other
  misc_feature (189)..(189): n is a, c, g, or t
  modified_base (221)..(221): a, c, t, g, unknown or other
  misc_feature (221)..(221): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctntgtgggggtcagagtcaccatcacttgccganaagtcacggtacgttaaaacctatttaaagttggtatcagcaagaaacctggaaaacgccccagacctcctgactctcgtggtcgctactccactcgtcgacgtaaagtggcctaccccagtccgggtacgttcgaaggtcggactaggtcggtactcggtagggaactaggtacttttaccgacttcctaccgacctactaccaccctaccgtctacgactaaccgtggaacgtagtcgtcgaactacttacttactacgtacgtacaacgtagtacgttaccgtacccgtttcccgtaccgtaccgttacgttaccgggtaccggtaacgggtaaccgttacgttacgtaaccggtaacttaaccgtaaaccggtaacgttcgggtaccggacgttaccgaaccgtacccgtacttacccggttacttacccg

SEQ ID NO: 209542 - DNA, 694 bp, Homo sapiens
  misc_feature: GYAE6OF02ILXQZ.17.25.C03.1.454.CMB.1.raw
  modified_base (284)..(284): a, c, t, g, unknown or other
  misc_feature (284)..(284): n is a, c, g, or t
  modified_base (293)..(293): a, c, t, g, unknown or other
  misc_feature (293)..(293): n is a, c, g, or t
tcagcgtagactagcacgaccggtgctcgatttagtagtgtagatttgggtttgggggacgtcaacaaccacatctgtcctctagagaaaaccctgtgagcacagctcctcaccatggactggacctggaggatccgtcttctggtggcagcagctacaagtgcccactcccaggtgcagctggtgcagtctgggctgaggtgaagagcctggggcctcagtgaaggtctcctgcaggcttctggattcacgtttacctccgtatagtatcaactgggtacgcnccaggccgntggaccaacggccttggagtggatcggggatcgggccgaaaccctaacgattgggtagtctacgagtcgtaccttcacccgatcccgtaccgggactacggtaccttaccagtcgaacccgaaccgtaactcccttacccaaacgtaaaccctaccaacgtaccgtaaccaacgtacggtaaggttacgacggtacgtcgtaacgaccgtaattcccgtaaggtaccgacgtaccgggttaccgttacgttaacgtttaccgtaggttacgtccgtaacgggtacccgttaacccgtaccggtaaaccggttcccgggttacgaacccggtaccgttacccggggtacggaacggttcccggttacccgtttaccggttacctttccgggttacccggggg

SEQ ID NO: 209543 - DNA, 888 bp, Homo sapiens
  misc_feature: GYAE6OF02FUEKN.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagaagccgtcggggcctcaggtgaaggtctccgtgcgtaacggtcttctggtattcctaccgtttacctcctagtagtactactaacgtgggtcgcgtccgacggccgtacgtggaaccaaccggtaccgtaggtacggtaggggtaacgttagggggacgttacgggggaacccgtaaaaccccgttaacggtacgttcgggttacggttacccgaacgttaacgggttcgtttacccgttaacccgaaccccgtacgttccccgggtaacccggggtaactaacccggtaacccgtttaaacccgacgttaaccggaaaccccgtaacccgttaaacccgttaccccttaacccggaaaaccttaaaaacccgtacccgtaaccgttaaccccgttaaacgtacggttacgggttaacgtttaacggggacggggttaacccttcggttaacggaaccgttaaccgttacgtaaccggaacccgtaaccggtacccggggttaccttaactttaaccggtttaaccgtggttaccgaaccgggtacgttaaccccgtacccggaccggttaacggtttaccccggggacggttaacccgtaccccgggttacccggaacggttacccggttaccccgggttacccggtttttcggacccgggttttacgggaaccccggggg

SEQ ID NO: 209544 - DNA, 831 bp, Homo sapiens
  misc_feature: GYAE6OF02HFKN6.17.25.C03.1.454.CMB.1.raw
  modified_base (308)..(308): a, c, t, g, unknown or other
  misc_feature (308)..(308): n is a, c, g, or t
tcagcgtagactagcacgaccggtgctcgatttagtagtgtagatttgggtttgggggagtcagtctcagtcaggacacagcatggacatgagggtccccgctcagctcctgggctcctgctactctggctcgagctgccagatgtgacatccagatcgacccagtcctccatccctcctgtctcgcctcgtggtggggtacagacgtcaccatccacgttcgaccggaacaaggtccgaacgggtaactttaaaaaccgtatttaaattggtactacgagacaacgtaaaaccgtagggaaaaaccnccccaaggtacccctcgtagtacttcctcgtggtacgactactcctacttcgacggtacggtaaacggttcggaccgtaccctaggttaccggtaggtttccgaagggttcggacgtagggttacgggtacgtacgggtacggggaacttaacggttaaccttttaacgaaactttcccgtaacctaaacccgtaccgttaaccccgtaacccttacccgttaccgttaccggtaaacccgttaaccggttaggggttaaacggttacgtttacggttaaccgtaacttaaccgttaaccttaaccgtaccgtttacgtaaccgtaaaccgtaaggttaacccgtttacccgttacccgtttaccccgttacggtaccgttttaacggtttcccgggaacccgttaaaccgggggtaaaccttaacgggttcgtaaacgttaaccgtaaaccggtaaacgtaaccggtttcggaccggttacttaccggaaccgtttaccgtacgtttccggttaaccttccg

SEQ ID NO: 209545 - DNA, 626 bp, Homo sapiens
  misc_feature: GYAE6OF02FUTRY.17.25.C03.1.454.CMB.1.raw
  modified_base (301)..(301): a, c, t, g, unknown or other
  misc_feature (301)..(301): n is a, c, g, or t
  modified_base (454)..(454): a, c, t, g, unknown or other
  misc_feature (454)..(454): n is a, c, g, or t
  modified_base (486)..(486): a, c, t, g, unknown or other
  misc_feature (486)..(486): n is a, c, g, or t
  modified_base (492)..(492): a, c, t, g, unknown or other
  misc_feature (492)..(492): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccacctcccaggtgcagcgtggtgcagtcgtgggctgaggtgaagacgccgtgggcctcgaggtgaacggtcctccgtgcgaaggtctttcgtggtattcctaccgtttaccctcctattagtactcaacgtgggtcncgccaggccgcgtggacaacgcctgagtgagtgggagtcgggaccgtaaacctacgacgttcggtactcacgagttcgttacctaccgaccccagtcccgtaccgggacagtacccttaaccagtacgaccacgaactcctaccaataaaccncacgtacctacagtcggtagttagacggtacnccgtanactctctacgaacgaccgtacggtccgttacttacgttactggtcgacgtaacggtaccgtacccacggtcgtccgggtacgccgtaccgacggcgcgggtccgttaccgtttcgtaccgtttcgggtaccggg

SEQ ID NO: 209546 - DNA, 611 bp, Homo sapiens
  misc_feature: GYAE6OF02I92I8.17.25.C03.1.454.CMB.1.raw
  modified_base (241)..(241): a, c, t, g, unknown or other
  misc_feature (241)..(241): n is a, c, g, or t
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
  modified_base (328)..(328): a, c, t, g, unknown or other
  misc_feature (328)..(328): n is a, c, g, or t
  modified_base (335)..(335): a, c, t, g, unknown or other
  misc_feature (335)..(335): n is a, c, g, or t
  modified_base (419)..(419): a, c, t, g, unknown or other
  misc_feature (419)..(419): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtgggctcagtgaaggtctctgcaggcttcnggattctacgtttacctctaatagtanctaacgtgggtcncgcacggccgctggacaacgcctgagtggatgggatgggcaacctancgtggtntcagtagtgtccttcacctacgtccgtaccggatacgtaccttaccatcgaccactacctcctacaactaacacacgtacctanacgtaggacgttggaacggcgaccgtgaactacttaccgaggaaccgacggtaccgtacccggttacttacgtttaccgtggtacggtacgacgtaccgttacccgaaccgtacgggttccggacggaaccgtcccgtaacggtccggacggtccggttacccgttttacggtcccgttcggtaaccggggg

SEQ ID NO: 209547 - DNA, 803 bp, Homo sapiens
  misc_feature: GYAE6OF02HHKNA.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaaggccgtcggggcctacgaggtagaaggtcctcctgacgacggtcttcgtggtacttaccgtaccgttttacctccttaattaaggttataccgtaagttcggggtcgcccggtacccgaacggggtcccgtcgttacgggaaaccccgaaaaccggtacccgttagggtacggttaaggggacggttagggggtacggttcgggggtaaacccgtaaacccccgtaaacggtaccgttggggttacggtacaacgtaaggtttcgtacctttaccgaacccctcgttacccggtacccggacgtaaccgtacccttaaaccgataccgaacccgtaaccgtaacccttcccctaaaccgttaactaaaacccgtacctaaccgtaccctaactacggttacggtaaggttaccggaggtacgccgtacacgtaacgtcgtaccgaaccgtaccgacggttacccgttacgttaaccttcgtaccggttcggaacgtaccggaccgtaccggtaccggtacgttccggggactacgtccggtacggccggtacggtaccgttcccggttttacggtaccggttccggtaccgggg

SEQ ID NO: 209548 - DNA, 1006 bp, Homo sapiens
  misc_feature: GYAE6OF02JL6D9.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggagatcctcttctggtgcagcagctacaagtcgcccactcccaggtgcagctggtgcagtcgtggggctggaggtagaagagccgtggggcctcgagtgaacggtcctaccgtgacaacggtcttacgtggtacttcacgttacctctagtacgtatccgaacgttgggtacgtaccgaccgtaagggtcccgtacgttacgggaacctaaccggtaccccgttagggaacggttcgggtaacgtcgggggtaaacgttaccggggggaacccgaaaacccccgttaaagaaccggtttacggggttaaccgttaacccgtaacggtaaacgggtttaccgttacccgtttaaacccggaaaccccccgttaacgttcccccggtaacccggggggtaaaccctaaacgggttaacccccgttttaaacccgaaacggtttaccgggaaaccccgtaaaccggtaaaccccgtttaccccgtaaaccctaaaacggttaaaaaccccgtaccgtaaaccgggttaccccgttaaaacggtaacggtttaaccgggggtaaacgggttttaccggaaaaccggggggtttaacctaaccccgggtttaaacggaaacccgttaacgggtttaacccggttaaccggaaacccgggtaaacccggttaaaccgggggtaccccttttaaccggtttaaaacgttacccggttaagggttacccgggtaacgggaaccgtttacccgggtaacccccgtaaccgggtaaccggtttccccgggaaacggtaacccggtaaccccggtttaaccggacggtaaccgggtaccccgggtttaccgttttaaccgggtaccggtttaccccggggtaaccgggggg

SEQ ID NO: 209549 - DNA, 758 bp, Homo sapiens
  misc_feature: GYAE6OF02GO59L.17.25.C03.1.454.CMB.1.raw
  modified_base (321)..(321): a, c, t, g, unknown or other
  misc_feature (321)..(321): n is a, c, g, or t
tcagcgtagactagcacgaccggtgctcgatttagtagtgtagatttgggtttggggactcaaccagccacatctgtcctctagagaaaaccctgtgagcacagctcctcaccatggactggacctggaggatcctcttcttggtggcagcagctacaagtgcccactcccgaggtgcagcctggtcgcagtctgggctgacggtgaagaacgcctggggctcagtgaacggtctcctgctaaggcttcgtggtacttccgtaacgtttacctccttataacgtagtacctaaacggtgggtcgccgaccgacgggtcccncgttaggaacctaaaccggtaccgtaggtacggttagggacgttaggggacgtacggggtaccaaaacccctaacgtaaccgttgggtcttaccggactaacgggtctaccgttcaccgtactccgtcccggagaccgtactttacacgtacgaccaataacccgtactaccgtaactaaacgaccgtaccgacccgttacaacgttcgggaacgttacgtacggaacgtacctacggtccaagttcccggtaacggaccgaacccggtaacggttcccgtaaccttaaccgttacggtttaacgccgggtaccgtacgtaaccggttaccccgtaacggtaacccggttcccggggaacggttacccgggtacgttacccgggaccgtaacccggttacccggggttcccctttaaggggttaaccccttccgggg

SEQ ID NO: 209550 - DNA, 734 bp, Homo sapiens
  misc_feature: GYAE6OF02ICOBP.17.25.C03.1.454.CMB.1.raw
  modified_base (184)..(184): a, c, t, g, unknown or other
  misc_feature (184)..(184): n is a, c, g, or t
  modified_base (250)..(250): a, c, t, g, unknown or other
  misc_feature (250)..(250): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtncagtcgtggggctgaggtgaagaagccgtgggcctcgagtgaaggtctcctgacgaaggtcttcgnggtattctacgtttacctcctatagtatcaacgtggggtagccgccgacggccgcgtacggaccaacgacctggaggttggagtcgggacgtggggaccgtaaaccctaacacgtgggtgtaccacgtggttcgtcttaccaccctagtcccgtccggaactacgtaccttaccagtaccgaaccaccgtaaccctacccgtacctaaacaaaacccgtaccacgtaccctaaacgagttcggggtaacgttacgggtaacgggaccggtcctacgaacctacgttctacgggaacccgtaaccgaaccgggtccttaacgtttaccgtttaacgtcggtaccggaacggtacgtaccggtaccccgtaaccgggtcggtaccccggggtaggaaccgggttacccccgtaacggggtacccgacggggtttccccgggtaccccttttttagggtaccccgggtttccgggtaccgggggggg

SEQ ID NO: 209551 - DNA, 734 bp, Homo sapiens
  misc_feature: GYAE6OF02J0OTN.17.25.C03.1.454.CMB.1.raw
  modified_base (146)..(146): a, c, t, g, unknown or other
  misc_feature (146)..(146): n is a, c, g, or t
  modified_base (279)..(279): a, c, t, g, unknown or other
  misc_feature (279)..(279): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttgggngcagcagcctacaagtgtcccactcccaggtgcagctggtgcaggtcgtgggctggaggtgaacgacgccggtcgggcctcgaggtagaaggtctaccgtagtcaggtcttcgaggacttcctacgtttaccncttaagtagttactctaacggtgggtcgcgtccgaggccgtacgtcggactaaccgtaccgtaggaacggtggtacggtgggacgtacgggaccgtaacccttaagaccggtgggttactccgaagttaggttcgtaccttacccgcccgtaccgtccggttaccggaacacggttaaacccttacgaccgtttacggaaccccgtaacggtacccttaccctaacgtaaactaaacccggtacctaacggttaaccccgtaagtacgtacgggtacgggttaagtaaccggacgttaaccgtcgaacgtctactaccggaacgtacccgaccgtcgttaccgtacgttacgcgttacgagttaccgaccggttaccgacggtaccgtttacgacgtaccggtaccgttaggaccgttcgggaccggtttctaccggttacgtacggtcccgggg

SEQ ID NO: 209552 - DNA, 786 bp, Homo sapiens
  misc_feature: GYAE6OF02GNXKY.17.25.C03.1.454.CMB.1.raw
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtcgtcgggctgaggtgaagaagccgtggggcctcgagtgaacggtctcctggcaaggtcttcgtggtacttacctacgtttacctccgttaatagtaactcctaacgtgggtcgacgcccgtaggcccgtcggtaggactaaaccggaccgtggaacggtgggtacgtgggggagtcggggaaccgtaaacctaacggacgttgggtcgttacgaacgtaggttcgttaccttacccgaacccgtcgttcccggtacccgggtacgtaacggtaacctttaaccgacgtttaccgaacccgtaaacggtaaacccgttacccctaaccgaaacgttaaaaacccacccgtaaacgtaacccttaactaaccggttgggtaaacgggtttacgacgggttaacctaccgtaacgtaccgtaacgttcgtaccggtaaccgaacccgttaacccgggtaccccgtttaattaacggtttaacgttcggtacgggtaccgaggttaccgtacccgaaccgggtcggttaaccggtcggtaacgcccgttaaggcccggtacgggtccggttccgtttacggtacccgttgggtaaccgggg

SEQ ID NO: 209553 - DNA, 706 bp, Homo sapiens
  misc_feature: GYAE6OF02G9QV9.17.25.C03.1.454.CMB.1.raw
  modified_base (284)..(284): a, c, t, g, unknown or other
  misc_feature (284)..(284): n is a, c, g, or t
  modified_base (347)..(347): a, c, t, g, unknown or other
  misc_feature (347)..(347): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagccgtggggcctcagtgaaggtctcctgcaaggcttctggattctacgtttacctcctatagtatcaacgtgggtcncgccagggccgcgtcggaccacgaccgtggaggtggagtgggagtcgggaccgaacccctaanaccgtgggtctacgacgtaggttcgtcctttaccaacccctacgttaccccgtacccgggaactacggtacctttaacccgaagttaccggaaccctaaaccgaaccctttcccctaaccccgtaaactaaaaccctaccgaaccggtacccctaacgtaacggttcgggtaaggtttacggaacgggtacgcccgtaagaacctaacgttcgtaaccggaaccggtacccgtaccgggtacccgttacttaagttaccgtggtacgcggtaacgcgtacccgacggtactcccgggtacgaacgtcccggtaaggccgtacggtccggttccgtttacggaccgtttcgggaccgggg

SEQ ID NO: 209554 - DNA, 613 bp, Homo sapiens
  misc_feature: GYAE6OF02HO4IO.17.25.C03.1.454.CMB.1.raw
  modified_base (307)..(307): a, c, t, g, unknown or other
  misc_feature (307)..(307): n is a, c, g, or t
  modified_base (313)..(313): a, c, t, g, unknown or other
  misc_feature (313)..(313): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcctggggcctcagtgaaggtctcctgcaaggcttctggattcacgtttacctcctatagtatcaacgtgggtgcgccaggccgctggacaacgcctgngtggangggatgggacaacctacgacgtggtgtacacgagtgacttcaccctatccgcggacacgtactaccatacgaccacgtaacctccgtaacaataaacacacgaccgtaacagttaggtagttagggacgacgtcctagaactctcgtaggaaccgtacgtaacccggccgtttaacttacgttacgtggtacgaccgtagaccgtacccgaaccgtaacggttcccggtaggtaaccgtcccgaaccgggtactaccgggtcccggtttacctttacggtacccgtttcgggaccggggg

SEQ ID NO: 209555 - DNA, 585 bp, Homo sapiens
  misc_feature: GYAE6OF02G2B04.17.25.C03.1.454.CMB.1.raw
  modified_base (100)..(100): a, c, t, g, unknown or other
  misc_feature (100)..(100): n is a, c, g, or t
  modified_base (217)..(217): a, c, t, g, unknown or other
  misc_feature (217)..(217): n is a, c, g, or t
  modified_base (267)..(267): a, c, t, g, unknown or other
  misc_feature (267)..(267): n is a, c, g, or t
  modified_base (328)..(328): a, c, t, g, unknown or other
  misc_feature (328)..(328): n is a, c, g, or t
  modified_base (342)..(342): a, c, t, g, unknown or other
  misc_feature (342)..(342): n is a, c, g, or t
  modified_base (406)..(406): a, c, t, g, unknown or other
  misc_feature (406)..(406): n is a, c, g, or t
  modified_base (412)..(412): a, c, t, g, unknown or other
  misc_feature (412)..(412): n is a, c, g, or t
  modified_base (416)..(416): a, c, t, g, unknown or other
  misc_feature (416)..(416): n is a, c, g, or t
  modified_base (457)..(457): a, c, t, g, unknown or other
  misc_feature (457)..(457): n is a, c, g, or t
  modified_base (549)..(549): a, c, t, g, unknown or other
  misc_feature (549)..(549): n is a, c, g, or t
tcagcgtagactagcacgaccggtgctcgatttagtagtgtagatttgggtttgggagtcagtctcagtcaggacacagcatggacatgagggtccccgntcagctccgtgggctcctgctactctggctccgagctgcctagctgtgacatccaggatcgacccagtctccactccgtccctgtcctcgctcgtggtggggtctagacgtccactntcgcgttcgaccgacaagtcacggtacttaaaacctattaatcgtatacngctaacgtaacgtagtaaaccgcccgatacctctagtatcgtacgtggtctactcgtaccncgtccgtgaaccgngtccgccgtactacgtgtactaggtctgggctacggtagcgtgacggtaactgtaacttgaacncgttanaccntaaccgtcacgtacacgtcctagacgactcgtgtaaccgtntatacactacgtactacgtacgtactagtccgtacgtcctactacgttcgtaacggacgtacgtacgtacgtacgacgtaacgtacgttaancgtagtccgagtacctaccgtactcggtctactacg

SEQ ID NO: 209556 - DNA, 765 bp, Homo sapiens
  misc_feature: GYAE6OF02GD0JP.17.25.C03.1.454.CMB.1.raw
  modified_base (247)..(247): a, c, t, g, unknown or other
  misc_feature (247)..(247): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctccgtgcaaggcttcgnggattcacgtttacctcctatagtactcaacgtgggtacgccgccgaggccgcgtacggaccaacggaccgtgaggtggagttgggatcggggaccgaaacccctaacgacgtggtcgtacgaactaggttcgttaccttaccaccctacgttcccgtaccggggtaactacgtaacctttaccgacgttacgaacccgtaaccgtaaccctaccccgtacctaaacgttaaaaccctaaccgacgtacccctaacgtaaggttacgggaaggtttacggaaggtaccggtaccctagtaacctagttacccgtaggaacccgtaaccggacccgggttacccgtaacgtttaacgtttaaccgtacggttacggtaacccggtaaggtaccccggttaccccgaacgggttaaccgggttcccggttaacgggtaaccgtaccccggtaaccggggcccgtaaccgggttcccgggttacccgtttttcgggaacccgttttccgggaaccgggggg

SEQ ID NO: 209557 - DNA, 937 bp, Homo sapiens
  misc_feature: GYAE6OF02HJM5M.17.25.C03.1.454.CMB.1.raw
  modified_base (385)..(385): a, c, t, g, unknown or other
  misc_feature (385)..(385): n is a, c, g, or t
  modified_base (652)..(652): a, c, t, g, unknown or other
  misc_feature (652)..(652): n is a, c, g, or t
  modified_base (706)..(706): a, c, t, g, unknown or other
  misc_feature (706)..(706): n is a, c, g, or t
tcagcgtagactagcacgaccggtgctcgatttagtagtgtagatttggggtttggggactcaacaaccacatctgtcctctagagaaaaccctgtgagcacagctcctcaccatggacgtcggacgtggaggcttccttcgtttcttgggtcggcaggcaacgtctaacgtaacgtccgtaccccacgttcccgagggtcgccaggccggttagggtcgacgtacggttcggtcggggggtaccttagggagggtaccgaaaggaacggtcccgggttacggggcccttaacggagggttacggtaacgggttcctccggtcgaacgaacggggtctttccggtaagggtaccttaccgttaaccggttttaccaccggtttanaacgtttaactaccgtaacggggttcgggtcggacccggaccggtacggggacccttacccggtaagggaaccctaaaccgggtacctagggttagggttaggaacgggttacggggtacggaaccgggggtaaccctaaacccgttaacgtacgggtcgggttccgtaacaacccggtagtttacggtaccccgtttaaaccgcccccgttacgtttaaccccgggaccccgggggttaataacccgggttaaccgtttaaaccgngttaaccccggaaaccttacccgtaacccgtcgttaaaacccaactaaaaaccnccggtttaaacggacccttacacgggttaggtcggttaaaccgggacgtcgaaccttacggataccggtacgacctacggggaccctccggttaataccgtttaggttcacggttaacggaccgttacgtacccgccggttaccgacggggttaccaggttcccgtaaccggtccggtaaccggccgggtttcccggtaccggttttacacccgggttagccccggggggg

SEQ ID NO: 209558 - DNA, 802 bp, Homo sapiens
  misc_feature: GYAE6OF02GBKJB.17.25.C03.1.454.CMB.1.raw
  modified_base (185)..(185): a, c, t, g, unknown or other
  misc_feature (185)..(185): n is a, c, g, or t
  modified_base (240)..(240): a, c, t, g, unknown or other
  misc_feature (240)..(240): n is a, c, g, or t
  modified_base (754)..(754): a, c, t, g, unknown or other
  misc_feature (754)..(754): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagtctggtncgagtcgtggggctagaggtgaagaagtccgtgggaccttgagtggaacggttcnccctggacgtaaggtctttcgtggtatttccgtacgttttaccctacgtaagttacgtactaccgtaacgtggggttcgcggacctacgggccgtacgtacggaacgaaccgtccgtaagtcggttagacggttacgggtacgtcggggaaccctaaaacccgttaaccgacggtttacggtcggttaccgaacggttacggtgttaccctttaccgaaccccgtacgttccgggttaacccggaccgtaaacgttaccggttacccgtaacgttacccgaaccgtaacccgtaaacccgtttaccctaccgtaaaccgttaaaccgaaccgtaaccgtaccgtttaaccgaaccggttgggttaaacggtttccggaaacgggtaccgttcccgtaaggtaccctagggttaccctacggtaacccggaccgtaccggttaccccgttaattaccgttaaggtccgtttacgaaccgtacgtaacccggtccctaacggtaccgtacgggtancccgtacggtacgccgttacggaccgttcgtacgtacgcgtaaccggg

SEQ ID NO: 209559 - DNA, 855 bp, Homo sapiens
  misc_feature: GYAE6OF02H497P.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatctcttcttggtggcagcagctacaagtcgcccactcccaggtgccagctggtgcagtcgtgggctggaggtacgaaagacgtccggtcgggaccttcgaggtagtacggtcctaccgtgacgaacggtcttcgaggttacttccgtaaccgttttacctaccgtaattagtaactaccgtaacgttggggtccgccgaccggacggcccgcgttacggaacctaaaccggtccgtaggaggttaggacggttcggggagttacccggggaaccgtaaacccgttaacgtcggttagggtacgtaccgtaacggttacggtttccgttacccttacccgtaaacccgtaccgttacccggtaccggggtaaactaaaccggttaaccctttaaaccgcgttaaacccgtacccctaaacggtaacccctttcccgaaacctaaaacccgtaaaacccgaacgtaaaccgtacccttaaacggtacgttaaacgggtttacggtaacggtaacgggtaccgttaccgttacgtaaacctaacgttacgtaccggaaaccgtacccgggtaaccgttaccggttaacttacgttacggtcgtaacggcgtaaccgtacccggtaacccacgggttaacgtccgggtacgaaacccggtaccgttaccgggaacgttaccgggttacccgtttcgggtttaccgttaccggttacgggtaaccgggg

SEQ ID NO: 209560 - DNA, 652 bp, Homo sapiens
  misc_feature: GYAE6OF02HQWLT.17.25.C03.1.454.CMB.1.raw
  modified_base (607)..(607): a, c, t, g, unknown or other
  misc_feature (607)..(607): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctgaggtgaagaagccgtggggcctcgagtgaacggtctccgtgactaggcttctggtaacttctacgtttacctccttaagtacgtatacacgtggtcgacgcgacggccgtacgtcggaacctaaccgaccttaggacgtggaacgtgggacgtacggggaccgtaaaccctaagtacgtgggtctacgacgttaggtcgttccttaccaacccgtacgtcccgtaccgggaacacgtaaccgttacactccgaaccatacccgtctaccgaaataaaccacaacgccttaagacggttggaagttcggaagaccgtcccgtaagacctacgtcgaccggtaacggacgaccgggttactcgtttatacgtgtaccgacgacgtcgaccgaacgttcggcccggttaancgttacccgagcccggagtccgtcgtttacgtcgttcggacgggg

SEQ ID NO: 209561 - DNA, 681 bp, Homo sapiens
  misc_feature: GYAE6OF02FK5NP.17.25.C03.1.454.CMB.1.raw
  modified_base (221)..(221): a, c, t, g, unknown or other
  misc_feature (221)..(221): n is a, c, g, or t
  modified_base (408)..(408): a, c, t, g, unknown or other
  misc_feature (408)..(408): n is a, c, g, or t
  modified_base (478)..(478): a, c, t, g, unknown or other
  misc_feature (478)..(478): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggattcctcttcttggtggcagcagctacaagtcgcccactcccaggtgcagcgtggtgcagtcgtgggctgaggtgaagagccgtgggcctnagtgaaggtctcgtgcaggtcttcgtggtattcgtacgtttaccctctaacgtagtactcaacgttgggtacgccgaccgacggcccgtcgtacggaaccgaaccgtaccgtggacggtggagtgggaacgtcggggaaccaaccctacgacgtgggtcgtacacgtagtcgtccttaccgaccctntcccggtacggactacgtacctactacgtacgaccacgtaacctcctacaaactaacaccacgtacctanacgtagtacgtgacgtcgcctagactacgtacgacgtaaccgtaccggaccgttaccgttactttaacgtacttcggtacgaccggttacgtaaccgttccccggaaaggttcccggacgggttaccgacccgttacccgggacggtaccgcccgggttacccggttacccgggtttacgtaccggttccggggtacccgggg

SEQ ID NO: 209562 - DNA, 630 bp, Homo sapiens
  misc_feature: GYAE6OF02GOTOK.17.25.C03.1.454.CMB.1.raw
  modified_base (185)..(185): a, c, t, g, unknown or other
  misc_feature (185)..(185): n is a, c, g, or t
  modified_base (261)..(261): a, c, t, g, unknown or other
  misc_feature (261)..(261): n is a, c, g, or t
  modified_base (281)..(281): a, c, t, g, unknown or other
  misc_feature (281)..(281): n is a, c, g, or t
tcagcgtagactagcacgaccggtgctcgatttagtagtgtagatttgggtttggggactcaacaaccacatctgtcctctagagaaaaccctgtgagcacagctcctcaccaatggactggacctggaggatcctcttcttggtggcagcagctacaagtgcccactcccaggtgcagctggtncagtctggggctgaggtgaagaagcctggggcctcagtgaaggtctcctgcaaggcttctggattcacgtttaccnctatagtatcaacgtgggtnccgccaggccgctggacaacgaccgtgagtggatggggatcggggaccaaaccctaacgacgttggtgtaccacgagttcggtcctttccaacccctagtcccgtaccggggactacggtaccttaccatcgacccacgtaactcctaccaataaacaccacgtccctaacagtgggtaagttaggacggactcccgtagacctatccgtagaccgaccgtaccggtccgttacttaagttccctgggtcgacggtaacgtaccgttacccgaacggtaccgtccgggtacgaccgtcccgtacgggacgtacggtcccggtaccgttttggaccgtttggaccggggg

SEQ ID NO: 209563 - DNA, 877 bp, Homo sapiens
  misc_feature: GYAE6OF02IVP9I.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctgtgcagtctgggctgaggtgaagaagcctggggcctcagtgaaggtctcctgcaaggcttctggattcacgtttacctcctatagtactcaacgtgggtcgcgtccgaggcccgctgggaccaacgacccgtggacggtggacgtggggaacgttcgggggaccgaaaccccgttaacgacccgtttagggtacgttccgtaaacgacggtttacggttcccgtttacccaacccccgtacgttacccccgtttacccggggggaaaccctaacggttaaccccttttaaaccccgacgtttaaccggaacccccgtaacggtaaaaccccctttccccggttaacccgaaaaccttttaaaaaacccggacccttaaacgggacccctttaaaacgaaccggtttacgggggtaaccgttttagggaaacggggtacggttacccttaacgggaacccctaagttcccggtaacggaacccggaacccgtaacccgggggtcccctttaaccgtttaaacgttttaacccgttcgggttaacggtacccgggaacgggtttacccggttacccccgaaacgggttaaccggttccccggggtttaggaaaccgtacccccggtttaacggggccctaaaccggggtccccgggtttcctttaaccggggttaccccttttcgggtaacccgggggg

SEQ ID NO: 209564 - DNA, 686 bp, Homo sapiens
  misc_feature: GYAE6OF02GI28V.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaaggcttctggattcacgtttacctcctatagtatcaacgtgggtacgcgccgaggccgctggacaacgacctgagtcggagtgggatggggaccaaaccctaacgacgtggtcgtacagtacgtcgtccttaccacccgtaacgttcccgtccggggaactacggtaacccttaccgaacgtcgaaacccgaaccggtaacctccccgttaccaaacttaaaaccgaccacgtacccctaactaacgttcgggtaaggttcggaaaggtcgtaccgttacgaactacgttccgtacggaacccgtaaccgtacccgggtaccgttaccttaagtttaccgtggttcgaccggtaacgaccgtccccgaaggtaccgttacccgggtagaccgtcccggttacggccgtaacgggcccggttcctttacgggacccgttccggtaccggggg

SEQ ID NO: 209565 - DNA, 781 bp, Homo sapiens
  misc_feature: GYAE6OF02JO08Z.17.25.C03.1.454.CMB.1.raw
  modified_base (186)..(186): a, c, t, g, unknown or other
  misc_feature (186)..(186): n is a, c, g, or t
  modified_base (188)..(188): a, c, t, g, unknown or other
  misc_feature (188)..(188): n is a, c, g, or t
  modified_base (264)..(264): a, c, t, g, unknown or other
  misc_feature (264)..(264): n is a, c, g, or t
  modified_base (289)..(289): a, c, t, g, unknown or other
  misc_feature (289)..(289): n is a, c, g, or t
tcagcgtagactagcacgaccggtgctcgatttagtagtgtagatttgggtttggggacgtcaacaaccacatctgtcctctagagaaaaccctgtgagcacagctcctcaccatgactggacctggaggatcctcttcttggtggcagcacgctaacaagtgcccactcccaggtgcagctggtncngtcgtgggctgaggtgaagacgccgtcggggccttcgacggttagaagggtcctccgtagccgaagggtccttagnggtacttccgtaaccgttttacccnccgttaattagttacactaacgtacggggtgaccgccgtaagggacccgtcggtacgggaacctaaccggaacccgttggaacggttacggggacgttaacggggggattccggggaacctaaaccccgttaacgaccgttacgggttacggtaacaccggtaagggttcgttacccgttaacgacccccgtaagtttaccccggtaccggggaactaaccgggtacctttaacccgaggttaacccgaacccgtaacgtaaccctccgtaacccgaactaaaaccgacaccgtaaccgtacgaacgtacggtacttgtaacgtagaccgtcgtaaccgacgtacgttccgtaggtacccgacgtacccggtccggttattacggttaccgtacgtcgtaacgaccggtccgtaacccgtacggtaacgtccgggtaaccgcgtaccggtacggaccgtaccggtcggtcccctttaggttacccgtacggg

SEQ ID NO: 209566 - DNA, 811 bp, Homo sapiens
  misc_feature: GYAE6OF02JA36N.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtcgcagcgtggtcgctaggttccggtggggtctaggaggtaggaaaggaagccggtcgggggcctcgtaggtaggaacggttcctccgtggtaccgtaacgggtccttcggtacggtacgtttaccgttacggttttaaccctccttaagtaacgttaactcgtaacggttcgggtcgccggaccgtacggcccgacgtacggaaccgaaccgacgtacggagtacggagtcgggacgtacggggtaaccgaaccccgttacgaccggtggtacgtacgtaacgtggttacgtccgttaccacccgtacgtaccggtaccgggaactaccggtaccttaaaccgatcccgaaccgaaccgtaacccgtcctaacgaaaccttaaacgaacgtacctaccgtactacggtacgtaaggtcgacgtaacgccgtagtaactcgtacgttacggacgaccggtaccgtaccgttaaccgttacgttaaccgttccggtacgtaccgggtaacggtacccggtaacccggtaaccggttaccggttaccgggttaaccggaaccggttaccccgtaccgggaccgttacccgggtacggttacccggtttaaccgggttccggttaccgggtaacccggggg

SEQ ID NO: 209567 - DNA, 621 bp, Homo sapiens
  misc_feature: GYAE6OF02FVCN8.17.25.C03.1.454.CMB.1.raw
  modified_base (261)..(261): a, c, t, g, unknown or other
  misc_feature (261)..(261): n is a, c, g, or t
  modified_base (434)..(434): a, c, t, g, unknown or other
  misc_feature (434)..(434): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcgagtgaaggtctcctgcaaggcttcgtggattcacgtttaccncctatagtatcgaacgtgggtgccgccgaggcccgctggaaccaacggcctggagtggatgggatcgggaccaaccgtaacgcgtggtctcgactagtcgttcctccgaccctagtcccgtaccgggacgtaccttacgagtcgaaccacgtacctcctacaataacacgacncctagagtggacgttggagcgtaccgtgactatccgtggaaccgcgaccggtccttagttaccgttagcggttgacgtaccgtacgtaccccaggtaccgttccgggtagacccgtcccggtaaccggcgtaccgggtccggttaccccgttttacggacccgttttcgggtacccggggtacccgg

SEQ ID NO: 209568 - DNA, 616 bp, Homo sapiens
  misc_feature: GYAE6OF02GB9KC.17.25.C03.1.454.CMB.1.raw
  modified_base (280)..(280): a, c, t, g, unknown or other
  misc_feature (280)..(280): n is a, c, g, or t
  modified_base (435)..(435): a, c, t, g, unknown or other
  misc_feature (435)..(435): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatggggatcgggccgaaaccctaacacgtggtcgtcactaggtcgtccttcaccctatccctccggggacacggtaccttacatcgaaccacgaacctccctaccaactaaacacacgccctaanactacgggagttgaacgggtacgccctagacattccgaggaccgaaccgaccgggtccgtcttaacgttcgtcgtagccgaggtaccgtcccgaaccggtcttcccggggtagaaccggtacccgttacgggacctacgggtcccgggttacccttttcgggaccgtttcggtaccggggg

SEQ ID NO: 209569 - DNA, 707 bp, Homo sapiens
  misc_feature: GYAE6OF02FKNWP.17.25.C03.1.454.CMB.1.raw
  modified_base (527)..(527): a, c, t, g, unknown or other
  misc_feature (527)..(527): n is a, c, g, or t
  modified_base (589)..(589): a, c, t, g, unknown or other
  misc_feature (589)..(589): n is a, c, g, or t
tcagcgtagactagcacgaccggtgctcgatttagtagtgtagatttgggtttgggggacgtcaacaaccacatctgtcctctagagaaaaccctgtgagcacagctccgtcaccatggactggacctggaggatcctcttcttggtggcagcagctacaagtgcccactcccaggtgcagctggtgcagtcgtggggctggaggtgaagaacgccgtggggcctcagtgaaggtcctccgtgcaaggcttgtaggtattactacgttttacctccttatacgtactaccaacgttcggggtcgaccggcccgaacggcccgtaccgtcgggaacctaaccggtaccgttaggaggtagggtagtcggggagtacggggtacccgtaaaccccgttaacgtaccgttgggtacgtcctaacgtggtaccgtttcctacctaaccccgtacgttcccggaccgggtacaccgtaccttaccgactcggaaccacgtaacctcctacgaactaacgcacgtcctaacgngtacggtattgaagcgtcagtacacgtctacggaccgaccgtacgtcctacgttaacttcgngttaccgacgtacgtacggttaccccgacgttacggtccggtaacggaacccggtaccggtaccggtaccggcgggttacccggttaccgttttcgggaccgtttccgggacccgggg

SEQ ID NO: 209570 - DNA, 976 bp, Homo sapiens
  misc_feature: GYAE6OF02HVKRL.17.25.C03.1.454.CMB.1.raw
tcagcgtagactagcacgaccggtgctcgatttagtagtgtagatttgggtttgggactcaacaaccacatctgtcctctagacgaaaccctgtgagcacagctcctcaccatcggactggacctgggacggactccttcttcgttcggtggcagcagcctacaagtcgcccactccgaggtcgcacgtcgtggtcgtcgagtcgtggggtcgtaggacggtagaaacggaacgtcccggtgggggtaccttcggtaacggttagtaacggttcctaccgtcggtaaccgtaacggttccgtttacggttacggtacttttaccgttaacccggttttacccgtaaccgttacgttaagttacctaccggtaaccggtttcggggtccgtccgtaccgaccgggtacccgtacggtaaccggtaaccgtaaaccgaacgttcggtaacggttacgggtacggttacggggtacggtaccggggtaacccgtaaaccccgttaacgtacggttacggttaccgtaacgtaaccgtacggtttacggttccccgttacaaaccccggttccgtacccggttaccgggtaccgtaaccgtacccgtttaaaccgacgttccgaaaccgttaaccccgtaaacccgtttaccctaaccgttaaacctaaaccggtacgtaaaccgttacccgtaacggttaaccgggtaggtaaccggttaagggtaccgttaccgtacccgtaacgtaccggtaacgtcccgttaaccggtaaccggaacccggttaccgggttaaccgtacgtttttaacgttaccggttacggaccggttacgtaaacccggttcccgggtaacccgtaaccggggtaccctttacccggggtaaggttaccccggaccggttaacccgggacggtcccgggttaaccgggtttacccgttttacgggtacccccgggtttagggttaaccccgggg

SEQ ID NO: 209571 - DNA, 534 bp, Homo sapiens
  misc_feature: GYAE6OF02GIW6J.17.25.C03.1.454.CMB.1.raw
  modified_base (409)..(409): a, c, t, g, unknown or other
  misc_feature (409)..(409): n is a, c, g, or t
  modified_base (416)..(416): a, c, t, g, unknown or other
  misc_feature (416)..(416): n is a, c, g, or t
  modified_base (428)..(428): a, c, t, g, unknown or other
  misc_feature (428)..(428): n is a, c, g, or t
  modified_base (454)..(454): a, c, t, g, unknown or other
  misc_feature (454)..(454): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcaggtgaaggtctcctgcaaggcttctggattcacgtttacctctatagtatcaactgggtgcgccgagccgctggacaacgacctgagtggatgggatgggcgaaccctaacacgtggtgtcacagtgtccttcacccatcctccgggacagacttacatgaccacgaactccctacaataaaccacancctaacntggagttgaggncctagacatctgacgacgacggcctntattctggtgacgagacgtcccacggtatcccggtgacgtccgtacggcacggtccggtcctttcggacttcgtccgggg

SEQ ID NO: 209572 - DNA, 738 bp, Homo sapiens
  misc_feature: GYAE6OF02F3F3S.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaggtctcctgcaaggcttctggtattctacgtttacctctatagtatctaacgtgggtcgcgcaaggccgagtcggacaacgctggagtggagtcgggatcgggaccgaaccctaacgcgtggtcgtaccacgagtcgtccttacaccctacgtccgtccgggaatacggtacttaccgagtacgaccacgtaacctcccgtaacaagtaaacccacgacgtaccctaacgtacgtacgggtagttgggaacggtacgaccgttagaaccctacggttaccgttaccgggaaacccggtaccggaaccccgggttacccgttaccgttaaagttttcccggtacggttaaccgggtaccggtaccgggttacccgtaccccggtaaaccgggttccggttacccgggtttaccggaacccggtttacccgggtaacccgggcccgttaaccgggggttcccggtttaccccggttttaacgggtaccccgggtttttaccgggaccccgggggg

SEQ ID NO: 209573 - DNA, 650 bp, Homo sapiens
  misc_feature: GYAE6OF02HQL1D.17.25.C03.1.454.CMB.1.raw
  modified_base (287)..(287): a, c, t, g, unknown or other
  misc_feature (287)..(287): n is a, c, g, or t
  modified_base (377)..(377): a, c, t, g, unknown or other
  misc_feature (377)..(377): n is a, c, g, or t
  modified_base (593)..(593): a, c, t, g, unknown or other
  misc_feature (593)..(593): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagccgtggggcctcgagtgaaggtctcctggcaaggtcttcgtggtattcaccgtttacctcctatagtatcaactggtancgccgaggccgcgtggaccaacgacctgagtggagtgggatcgggacaacctaacacgtggtcgtacctacgagtcgttcttacaccctntccccgtcgggaaccacgtaaccttaccataccgacccgtaacgaaccccttcctaacccaactaaaaccactaaccgtacctaccgtaagtgggaaacggttcggaggacgtcccgtaagtacctatccgtagaaccgtaccgaccgggttacccttacgttactttaaccgtgtacgtacgacgtaccggtacccacggtacgtcccgggttanaccggtccgtaacggccgtacggtccggtacccgtttagtaccgttcggtaccgggg

SEQ ID NO: 209574 - DNA, 722 bp, Homo sapiens
  misc_feature: GYAE6OF02HI2ZJ.17.25.C03.1.454.CMB.1.raw
  modified_base (297)..(297): a, c, t, g, unknown or other
  misc_feature (297)..(297): n is a, c, g, or t
  modified_base (317)..(317): a, c, t, g, unknown or other
  misc_feature (317)..(317): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggtcttcgtggattctaccgtttacctcctattagtatcaacgtgggtgcgccgaggccncgtggacaacgacctggagnggagtgggagtcggggaccgaacccgtaacgacgtcggtgtcacgtagttcgtccttaccacccgtacgttcccgtaccgggaactacggtaacccttaccgaacgttacgaaccccgtaacgtaacccttacccttaacccgtaaactaaaacccaaccgtaacgtaccctaactaagtcgggtaaggttacggaagggtaccgccgttaacgacctagttaccgtcgtaaacccggaccgacccggggtacccgttacgttaaccgtttaaccggtcggttcggaccgttacggaccgtaccccgtaacggtacgttaccgggtaacggtccggtacccgttacgggaccgttaccgggtaccggttacccggttttacggttccggttacggtaccgggggg

SEQ ID NO: 209575 - DNA, 906 bp, Homo sapiens
  misc_feature: GYAE6OF02IPHZ0.17.25.C03.1.454.CMB.1.raw
  modified_base (110)..(110): a, c, t, g, unknown or other
  misc_feature (110)..(110): n is a, c, g, or t
  modified_base (162)..(162): a, c, t, g, unknown or other
  misc_feature (162)..(162): n is a, c, g, or t
  modified_base (351)..(351): a, c, t, g, unknown or other
  misc_feature (351)..(351): n is a, c, g, or t
tcagcgtagactagcacgaccggtgctcgatttagtagtgtagatttgggtttggggactcaacaaccacatctgtcctctagagaaaccctgtcgagcacagctcctcnccactggactggacctggaggatcctcttcttggtgcagcacgctacaagtntccactccagtcgcacgtctgtcgtcagttcgtgggctgacggtcaaacgagtccgttcggggaccttcgacggtagtaaacggtccgttacccgtagtccgtaaacgggccgtttaccgttcggggtaaacttttcggtaaacccggttttttaacccgtacccgttaaagttaaaccgggttttaanaaccccgttaaaaccgttcgggggtttaccgtaccccggaacccgtaaacgggtccccgtaccgttacggggtaaccctaaacggtaccccgtagggttaagtcgggtaaaacctttggggtaaacccgtttcgggaaccgttaaaaccccgtaacgtaaccggtttcgggtacggtaccaaccgtaagtttccggtacttacgaccgaccgtttaccgtcggaacgtacgtaacctttaccgactcggaccctaacggaccctttaccgtaacgtaaccgttaaaaccacgacggttaccctaaacgtacggaggttaaccgttagtaacggtaacgtccccttaaagtaccggtaacttacgttaacggacccgtaaccgttaacggtaccccggtttacgtttaacccgtttaacgtttaccggagtaaccgggttaccaaggtttccccaacggggttttaccaccccggggttagaaaccccggttcccggtaacgtacccgtcgggtacccggtaaccggttttttgaaccccgtttagggtaccccgg

SEQ ID NO: 209576 - DNA, 691 bp, Homo sapiens
  misc_feature: GYAE6OF02I7VPK.17.25.C03.1.454.CMB.1.raw
  modified_base (178)..(178): a, c, t, g, unknown or other
  misc_feature (178)..(178): n is a, c, g, or t
  modified_base (182)..(182): a, c, t, g, unknown or other
  misc_feature (182)..(182): n is a, c, g, or t
  modified_base (331)..(331): a, c, t, g, unknown or other
  misc_feature (331)..(331): n is a, c, g, or t
  modified_base (668)..(668): a, c, t, g, unknown or other
  misc_feature (668)..(668): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgaccagtctccatcctccngtcncgcctcgtgtggggtacaggacgtcaaccgatcacttcgaccggacaagtacaccggtacgttaaaacctatttaattggtataccagacaacgtaaaccgtagaaaacgtccccagaccttactagactcgtactgggtcactaaccncctagtctggtaaccgtagtcgggacctcccagttacggaggttaccacggtcgacgagttacgggtctacgggtacgggaactgttaaacgtttacaaacgttctaccgaaccgtactacctaccgtacctacgtcgtacccgtaaacgtacggtaaggtacgttggacgtcgtaaacttaccgttaactacgtactacgtaaccgtaagttaacgttaccgtacccgttacccgtacgttaccgttaaccggtttccggaacggttaaccgggtaactacggttagaacggtaacgtaacgtaaacggtaacgtacggtgtaccgcggttaaccnccgtaacttacgttcgttacccg

SEQ ID NO: 209577 - DNA, 813 bp, Homo sapiens
  misc_feature: GYAE6OF02GUQSL.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccacctcccaggtgcagctggtgcagtcgtgggctgaggtgaagagccgtgggcctcgagtagacggtcctccgtgacgaaggtcttcgtggtacttactaccgtttacctcctaatagtactacgtaacgtgggtgccgccgaggccgtcgtacggaaccgaccgaccgtaggacggtaggtagtggggtacggtcggggacccgaaacccgttaaccgtacggttcggtacgtcgtaacgtacggtttcgttccttacccgacccctaccgtcccggtacccgggtaacgtaaccgtaacccttaccgtaacgtaccgtaacccgtaacccgtaacccttacccgtaacccgtaaacctaaacccgaacctaaccgtacccgtaacgtaacgtttacgggtacgggttaacggacgggtaacgtaccgttacgtaaccttacgtcccgtaacgggtaacccgtaaccggtacccgggttacccgttaaccttaacgtttaacccggttcggtaaccggtaccgtaaccgggtacccggtacccgtaaccgggtacccggttaccggttacggtaacccggtacccggtaccggaccggttccggtaccggtttaccgtttccggttaccggttccgggtaacccggggg

SEQ ID NO: 209578 - DNA, 703 bp, Homo sapiens
  misc_feature: GYAE6OF02GOCIN.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagaagccgtggggcctcagtgaaggtctccgtgcaaggcttcgtggtattctaccgtttacctcttagtagtactacgaacgtgggtcgcgccgaggccgctcgggaccaacgaccgtggtacggtggtaaggtggggacgtacggggaccctaaacccgtaacgacgtagggtcgttaccgacgtacgttacgtccttaccgaacccctacgtcccggttacccgggactaacggtaacctttaccgaacgtccgaaccaaccgtaacctcccgtaacctaaactaaacacgtacgaccctaactaactgggtagttacgggaggtacgtccgtacggtactacgtacgtacggaaccgtaaccggaccgtcccggttacttaacgttacgtaggttaccgacgtacggtaccgacccgtaacggtacggttacccggtggacccgtccgtaaccggcgtacggtccgttaccgtttggtacccgtcgggtaccgggg

SEQ ID NO: 209579 - DNA, 661 bp, Homo sapiens
  misc_feature: GYAE6OF02FJSG8.17.25.C03.1.454.CMB.1.raw
  modified_base (246)..(246): a, c, t, g, unknown or other
  misc_feature (246)..(246): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtacccactcccaggtgcagctggtgcagtctggggctgaggtgaagaagcctggggcctcgagtgaaggtcctcctgcaaggcttcnggtattctacgtttacctccttatacgtatctaactgggtgcgccgagggccgtctgggtaccaaccgaccgtggacggtgggagttggggattggggaccgaaccctaacaccgtggtacgtcacgtagtcgtccttccacctacgtcccgtaccgggacacgtaccttaccatacgacctacgacctcctacaactaaaccacacgccctacacgtaggacggtttagacggacgaccgtgactagttcgacgtaaccggaaccgaccgggtacccgttaccttaactttacgttggtacggaccgtacgaccggtaccccgaacggtaccgtcccgggtagaccggtacccgtaccgggtaccgaacggccggttacccctttggtacccgtttcgacccgggggtaaccgg

SEQ ID NO: 209580 - DNA, 641 bp, Homo sapiens
  misc_feature: GYAE6OF02JL39W.17.25.C03.1.454.CMB.1.raw
  modified_base (238)..(238): a, c, t, g, unknown or other
  misc_feature (238)..(238): n is a, c, g, or t
  modified_base (248)..(248): a, c, t, g, unknown or other
  misc_feature (248)..(248): n is a, c, g, or t
tcagcgtagactagcacgaccggtgctcgatttagtagtgtagatttgggtttggggacgtcaacgaaccacatctgtcctctagagaaaaccctagtgagcacagctcctcaccatgactggacctggaggatctcttcttggtgcagcgagctacaagtgcccactcccaggtcgcagcgtggtgcagttcgtggggctaggaggtgaaagacgcctggggcctgagtgaaggtcnctgcaggctngatcacgttctcctatatatcagtggtgccgcgacggcgcgtaggaccaaccggtacctggtagtcggacgtgggaacgttcgggggaaccaacccgttaacgacgttgggtccgtacgacgacggttgtccttaccgacccgagtcccgtaccgggaacgtacgtacctaccgacgtcgacccaacgtaacctacccacaaaccgttaacaaccgtacgtacctaccgtagtacgggtacggttaggtacggacgttccacgtaactcgtactcgaaccgtaacggaccgttccgtattaccgttagtcgttacgccgtagccgttaccgacgtacggttacggcgtaacctcgccgtagccgggctttcgttacgtacgttcgtaccgggg

SEQ ID NO: 209581 - DNA, 675 bp, Homo sapiens
  misc_feature: GYAE6OF02GVUW8.17.25.C03.1.454.CMB.1.raw
  modified_base (640)..(640): a, c, t, g, unknown or other
  misc_feature (640)..(640): n is a, c, g, or t
  modified_base (659)..(659): a, c, t, g, unknown or other
  misc_feature (659)..(659): n is a, c, g, or t
tcagcgtagactagcacgaccggtgctcgatttagtagtgtagatttgggtttgggagtcagtctcagtcaggacacagcatggacatgagggtccccgctcagctcctgggctcctgctactctggctccgagctgccagatgtgacatccagatcgacccagtcctccactccctccctgtctcggtcctcgttggtcgggggtaccagtacgtaccaccatccacgttcggaccggtaacaagttccgaacggtaccgttaaaaccttattttaaagttcggtatacagtacaagtaaacctaggaaaactccccaagtaccctactagacttctcgtaggtcgactactccattcgacggacgtaagtcggccgttaccacgtcggtacggttaccaggttcggacgtagtaggagttccgaggggactagtactttacacgttaccacgtaccgacttacaccctacgttctacgtaccaacgttacggtaacgtgttcgactaccgtaattccgtaaactgtacgtaacaacgtacgtaacttccgtaccttacccgtcgtaccgtttacgttaccgggccgtaaacggggaccctttaaggcgtaacgtactaaacggtaaccggattacggngtccgttacgaccttaccncgtttcctcgttaccc

SEQ ID NO: 209582 - DNA, 145 bp, Homo sapiens
  misc_feature: GYAE6OF02I3V3U.17.25.C03.1.454.CMB.1.raw
  modified_base (120)..(145): a, c, t, g, unknown or other
  misc_feature (120)..(145): n is a, c, g, or t
tcagcgtagactagcacgaccggtgctcgatttagtagtgtagattgggttgggactcaacaaccacatctgtcctctagagaaaaccctgtgagcacagctcctcaccatggactcggnnnnnnnnnnnnnnnnnnnnnnnnnn

SEQ ID NO: 209583 - DNA, 666 bp, Homo sapiens
  misc_feature: GYAE6OF02FR1KF.17.25.C03.1.454.CMB.1.raw
  modified_base (318)..(318): a, c, t, g, unknown or other
  misc_feature (318)..(318): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggccagcagactacaagtgcccactcccaggtgcagctggtgccagtctggggctgagtgaagagccgtgggctcgagtgaaggtctctgcaggcttctggtattctacgtttacctcctatagtatacacgtggtcgcgaccgaggccgcgtcggaccaacgaccgtagaggnggagtgggagtgggcgaaccctaagactggtcgtcaactagttgtaccttcgaccctacgtccgtacccgggactacgtactaacccgagtaccgtaccgaacccgtaaccttaccctaaccaaacctaaaacgaccctaccgaaccctaactacgttaggtaacggttggtaacggccgtaccgttacgacgtaccgtacgtacggaccggtacgacccgggtccgttacttaacgttacgtcgttgacgtacgcgtaccccgtaacgggtctaccgggcgtcggtaccccgtaacggtcccgtacgggcccggttcgtttacccggtccgtttaccgggtccgggg

SEQ ID NO: 209584 - DNA, 715 bp, Homo sapiens
  misc_feature: GYAE6OF02H857C.17.25.C03.1.454.CMB.1.raw
  modified_base (292)..(292): a, c, t, g, unknown or other
  misc_feature (292)..(292): n is a, c, g, or t
  modified_base (303)..(303): a, c, t, g, unknown or other
  misc_feature (303)..(303): n is a, c, g, or t
  modified_base (442)..(442): a, c, t, g, unknown or other
  misc_feature (442)..(442): n is a, c, g, or t
tcagcgtagactagcacgaccggtgctcgatttagtagtgtagatttgggtttggggactcaacaaccacatctgtctctagagaaaaccctgtgagcacagctcctcaccatggactggacctggaggatctcttcttggtggcagcagctacagtgcccactccaggtgcagctggtgcagtctgggctgacggtgaagacgccgtgggcctcgagtgaacggtccttcctagcgtaaaggtcttcgtggtattcgtacgtttacctctatacgtactcgaactgggtanccgccgaggcncgtacggactaaccgcgtgaggtcgaggtgggactcggggaacaacccgtaacacgttggtagtactacggtacgttcgtaccttacccgtaacccgtacgttacccggtaccccgggtaacacgtaaccggtttaacnggtttaaccgaccgtaaccgtaaccctttaccctaacccacttaaaaccgacctacgacccttaacgagtttacgggtaggttaagtcggggaactccgttaacgggactaacggtgtacgacgtaccggacgtcccgtagttaacgttacgtcgttacgagtaccgaccgtacccgtacggtacttacccggggtaagtcccggtaaccggtaacgtacggtaaccgggttcccgttaccggttttacgttaccgttccggggttaccgggg

SEQ ID NO: 209585 - DNA, 906 bp, Homo sapiens
  misc_feature: GYAE6OF02H7EH2.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactgacctggaggatctcttcttggtggcagcagctacagtcgcccactcccaggtcgcagctggtagcaggtcgtgggctggaggtcgaagaacgtccgtaggggcctcgacgtgaacggtcctccgtggacgtaacggtcttcgtgggtaactttccgtaaccggttttacctaccttaagttaacggtacttacgaaacggttggggtcgaccgtaccggaacggtccgtaccgttaggaaacccgtaacccggtaccgttagggacggttacggtaacgggttacgggggtaacggttaccgggggaaaccccttaaaaccccgtaacggtacggttcgggttacgtaccaaacggttacggtttccgttaacccgtacctaaccccgttacgttaccccgggtacccggggtaaactaaccggtttaaacccttaaccgtaacgttacccggtaaaccccgtaaaccggtaacccctttacccccgtaaaaccgttaaacccgtaaaaacccgtaccgtaaacccgtacccgtaaacggtaacgttacggggttaacgtcgggtaaaccggaccgtaccgtcgtaactaccgttcgaacccggtaaaccgtaccgggtaccccgggttacgttaccgttacggtttaccgtgggtaccgaaggttacccgtaccgtacccgtaaacggttccggtaaccgggtacgttaaccgggaccccgtaggggtaccgtaaccggtcccgggttttacctacgggttcccgtttaccggggaccccggggg

SEQ ID NO: 209586 - DNA, 784 bp, Homo sapiens
  misc_feature: GYAE6OF02GSWTK.17.25.C03.1.454.CMB.1.raw
  modified_base (286)..(286): a, c, t, g, unknown or other
  misc_feature (286)..(286): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcgagtgaaggtctcctgcaaggcttcgtggtattctacgtttacctcctatagtatcaacgtgggtncgccaggcccgcgtacggacaaccgacctggaggtggagtggggagtacggggaccgaaaccccgttaacgacggtgggttacgtaccaacgtacggtcgttccttaccaaccctacgtcccgtaccgggaactaacgtaccttaacccagtaccgaacccgaacgtaacccttccctaacccgtaaacttaaaacccgaaccgaaccgtaccccttaaacgtaacggttacgggtaacggtttacgggaaacgggtaccggtacccgttaacggtaacctacggtttaccgaacggaacccggtaaccgtaacccgggtcccgttacgttaacgtttaccggtcgttacggaccggaaccgtaccggtaccccgtaacggtacccggtttacccgggtacggtaacccggtaccccggtaaccgggtaccgtaacccggggttcccgggttaccccgtttttacgggtaacccggtttccggggtaaccccgggggg

SEQ ID NO: 209587 - DNA, 643 bp, Homo sapiens
  misc_feature: GYAE6OF02IVWPH.17.25.C03.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
  modified_base (280)..(280): a, c, t, g, unknown or other
  misc_feature (280)..(280): n is a, c, g, or t
  modified_base (365)..(365): a, c, t, g, unknown or other
  misc_feature (365)..(365): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatctcttcttggtggcagcagctacaagtgccactcccaggtgcagctggtgcagtctggggctgaggtgaagacgccgtgggccctcagtgaagtctcngcaaggcttcgngcttctacgtttacctcctatagttatcaacgtgggtnccgccgacggcccgtcgtggaccaacgaccgtgacggtgggagtgggagtcgggacctaacccgtacacggttggtcgtcaacgngttcgttccttccgaccctacgtcccgtaccgggaacacggtaaccttacccatacgacccactaacccgtacctaccaactaaacacaacgcctactacgtacggtagttacggacggtacgtcctacgacagttcgacggtaccgacgaccggtccgttacgttacgttacgtgttacgacgtacgtaccgtaaccgacgtacggtccggtacggtaccgtaccgtaccggcgtaccggtccgttacccggttaggttaccggttcggtaccgggg

SEQ ID NO: 209588 - DNA, 711 bp, Homo sapiens
  misc_feature: GYAE6OF02JJ4T9.17.25.C03.1.454.CMB.1.raw
  modified_base (270)..(270): a, c, t, g, unknown or other
  misc_feature (270)..(270): n is a, c, g, or t
  modified_base (282)..(282): a, c, t, g, unknown or other
  misc_feature (282)..(282): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacagtgccactcccaggtgcagctggtgcagtcgtgggctgaggtgaagacgcgtgggcctcagtgaaggtctctgacacggtcttctggtacttctacgtttacctctatgtanctacgtgggtcncgccgacggccgtcgtacggaactaacggccttagggacgtgggacgtagggggagtaccgggggacctaaacccgtaacgtacgtcgggtataccaaggtaggttcgttcctttaccgaacccctacggttcccggtaccgggtaactaacggtaacctttacccgaagtacggtaaccccgaacgtaaccccgttaccctaccgtaaactaaaccaacgtaccgtaccctaacggtaggtacggtaaggttacggaacggaccgtcctacggtacacttacgtacgaccgtaacgacccggtcgttacttaacgttcgtaggtcgtacgaccgtaccgtacccggagttaccggtaccggtacgaaccggttacccgtaaccggcgtaccggccggttaccttcggtaccttccggggtaaccgggg

SEQ ID NO: 209589 - DNA, 648 bp, Homo sapiens
  misc_feature: GYAE6OF02HADGW.17.25.C03.1.454.CMB.1.raw
  modified_base (248)..(248): a, c, t, g, unknown or other
  misc_feature (248)..(248): n is a, c, g, or t
  modified_base (331)..(331): a, c, t, g, unknown or other
  misc_feature (331)..(331): n is a, c, g, or t
  modified_base (510)..(510): a, c, t, g, unknown or other
  misc_feature (510)..(510): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctctttcttgggtggcagcagcctacaagtgcccactcccaggtgcagctggtgcagtcgtggggctggaggtagaagagccgtgggcctcagtgaagtctcctgacaggtcttnggattcacgtttacctctatagtatcaagttgggcgcgccgaggcccgtgtacggaaccgaaccgtaccgtaggagtaggagnggggaactcggggaaccctaaaccctacgacggttggtacgtacacgtaggttcgttccttaccgaacctcgtacccgtacgggactacgtaccttacagtcgaccctacgtacctcctaacgaaactaaaccacaaccgtcctaagagtcggtaagttacggacggacgtcctcgacncgttaccgaagtaccgcgaccgtccgtattaacgttcgtgtcggacacgtaccgtacccgaacgttcggtacccggtagacccggttaccgacggacggcggtacccggtttccttaacggttcggttcccggacggg

SEQ ID NO: 209590 - DNA, 888 bp, Homo sapiens
  misc_feature: GYAE6OF02GDQJJ.17.25.C03.1.454.CMB.1.raw
  modified_base (635)..(635): a, c, t, g, unknown or other
  misc_feature (635)..(635): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtagaagagccgtggggcctcgagtagaggtcctcgtgacgaaggtcttacgtggattcgtaccgtttacctcttaataggtactacgaacgttggggtcgtaccggacccggtacggtcccggtacggtacggggaaaccctaaaacccggtaacccggttaaggggtaacgggttagggggtaacgggtttaacggggggtaacgggtttccggggggaaaccccgtaaaacccccttaaacgggtaccggttacggggttacgttacccgaaacggttacggtttacggtccctttaccgaaccccttacgttaccccggtaccggggaacctacggtaacccgtttaacccgatttaccggaaccctaaccggtaaccctttaccctaacccgaaacgttaaaacccaccggtaaccgttaaccccttaanacgggttaacggtaacggtttaggtaacttcgggtaaccggtaccgttacccggtaactacgttacgaaccgggaacggtaccgaaccggttcccgtttacgttaaccttcggtaacggtcggtaaccgtacggtacccggttaaccccggcgggtaaccgttcccggggtaacgtaacccggttacccggacgggtacccgtaaccggggttccccgttttaaccgggttacgttacccgggtttcccgggg

SEQ ID NO: 209591 - DNA, 721 bp, Homo sapiens
  misc_feature: GYAE6OF02JABW5.17.25.C03.1.454.CMB.1.raw
  modified_base (188)..(188): a, c, t, g, unknown or other
  misc_feature (188)..(188): n is a, c, g, or t
  modified_base (225)..(225): a, c, t, g, unknown or other
  misc_feature (225)..(225): n is a, c, g, or t
  modified_base (235)..(235): a, c, t, g, unknown or other
  misc_feature (235)..(235): n is a, c, g, or t
  modified_base (291)..(291): a, c, t, g, unknown or other
  misc_feature (291)..(291): n is a, c, g, or t
tcagcgtagactagcacgaccggtgctcgatttagtagtgtagatttggggtttggggactcaacaaccacatctgtcctctagagaaaaccctgtgagcacagctcctcaccatggactggacctggaggatcctcttcgttggtggcaggcagctacagtgccactcccgaggtgcagctggtcgngagtcgtgggctggaggtcgaagagccgtgggctcgngtgagtctcngacagctcgtagtcttacgtacgtttacctcttaataggtataccgacgtgggtcncgtaccgacggtcgaccgtggaaccacgtaccgaggtcggtaggagtggggtactcggggaaccgtaaccctaagtccggtagtcggtacctaagtggttctacctacgaaccctcgtccggtaccgaataacgtccttacgacgtaccgaaccaacgtaccgtaccgtacaaactaacgacgactccgtaactagtacggacggtacggtacgtacgtcctacgattaaccgtcgtacgaccggtaaccgtaccgggttacccgttacgttaacgttaaccgtcggtaacggtaccggacggtttacccgtaacccggaccggttaaccgggtaccggtaccgggtaacccgttcccgggtacggtacccggtacgggtacccgggtttaaccccggttcgttaaacccggggttcgggttcccggggg

SEQ ID NO: 209592 - DNA, 718 bp, Homo sapiens
  misc_feature: GYAE6OF02JU7CH.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggaccctggaggatcctcttcttggtggcagcagctacaagtgcccactcccgagtgcagctggtcgcagtcgtggggtctggaggtacgaaaggaacggtcccgtggggggtccctcgtaacggttcgggtaaacggttacccgtccctgggtaccgaagggtcctttccgtagggtacttccgttaaccggttttaccctacccgttagttaggttaactccgtaaccggtcgggttggcccggcccgacgggtcccggacgttcgggtaaacccgaaccggtaacccttggaacgggttaggtagggttagggaggtccggggaacccgtaaaccctaacgaccgttggttaggaccaacggtgtacgtcctaccacccgtactcccggacgggtaccagtaccctacctagtacgacccagtaaccctaccgtacctacgtaaacctacgaccgtactagaacgtcggagttcggacggactccaagactatcgcgacgtaccgcggtactctacgtcgtagaccgtacgacgtcgtccgtacggcgttccgacgtcgaccgtagcgtcgtacgtcgttaagtccgtacggtcgg

SEQ ID NO: 209593 - DNA, 893 bp, Homo sapiens
  misc_feature: GYAE6OF02JDANA.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccattcccaggtgcagctggtgtcagtcgtggggtactgaggttagaaggaagccgtggggccctcgaggttaggaacggtcgtaccgtgaccgaaggtccttcgtggattaccgtacggttttaaccctccttaagttaacgttaattaccgtaaacgtcggggtagccgaccgacgggtccccgcggtaccgggaaccaaccggtaccgtcgggtaaggtcgggagtcggggtagtcggggaacctaaaccccgtaagtaccggttagggtacgttccgaacgtacgttcggttacccttaccgtaaccctacggttacccgtaccgggtaacgtaaccggtaaccctttaccgtaacgttaccgtaacccgaccgttaaaccgttccccgtaacgttaaaccgtaaaaccgtacccgtaaccgtacccggttaaacctacggttacggggtaaccgtttaaccggggacgggttaccgtacccgttaaggaccttaaacccggtacgggtaccgtaacccgggtaaaccgtaacccgggttaccgtttaccgttaaaccgtttacggtaccgggttaaccggtcgttaaaccgggtaccgtttaaccccgcggggttaaacccggttacgggttacccggaaccggttaaccccggtacgggtacccgttacccgggttacccgtttacccggtttacgggtacccgttttccggggtaaccccgggg

SEQ ID NO: 209594 - DNA, 760 bp, Homo sapiens
  misc_feature: GYAE6OF02GG8XC.17.25.C03.1.454.CMB.1.raw
  modified_base (643)..(643): a, c, t, g, unknown or other
  misc_feature (643)..(643): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtagaagacgccgtcgggcctcgagtagaacgtctccgtcgacgaacggtcttcgtagtactaccgttacgtttaccctctaatacgtacgttacgtaacggtcgggtcgtccggaccggtccggacccgtcggtaccggaaccgtaaccgtaccgtagggaacgggttacgggaggtacggggtagtaccggggaacccgtaacccgttacggacgttggtacgtacgacgtacggttctaccgtacccgtaacccgtacgtacccgggtaccgtaaccgtaccgttaacctaaccgtacgtaacccgaacccgtaaccgtaacccttccgaaacctaaactaaacccgcctaaacgtacccgtaaagtcggttaggttaacggtacgggacgtaccgtacctagacctagtccgtacggacgtaccgtaccgttacgtnttaacgtcgtacggacgtacggacctaaccgtcccggtaacgtaccggtaccgtcggtaaccgtcggtccgtaccgtacggtcccgtttaccggttacggtccggtcccggtacggg

SEQ ID NO: 209595 - DNA, 685 bp, Homo sapiens
  misc_feature: GYAE6OF02FIDV6.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatccttcttcttggtggctagctagctactaagtgcccactcccaggtgctagcctaggtgcagtctggggtctgaggtgaagacgccgtggggcctcagtgaacggtctcctgacaggcttctggtattcacgtttacctctagtactatcaacgtgggtactccgcgacgccgtctggacaacgtaccgtgacggtggagtgggattacggggccgtaaaccctacacgtgggtgtcatacgtctcttcgacccagtcgacgggacacggtacttaccagtcgaccaaccgtactcccgtaccgaactaaacactacgaccctaacgactacggtaattggaacgtcgtcccgtagtaacctaggtaccgttacggaaaccgaccggtacgggtaccgttaccgttaacgttaaccttcggtacggaccgaacgggttacggaccccgaacggtaacggtcccgggtaaggtacccgacccgtttaacggtcccgtaaccgggtccccggggtttaccttttccggggtacccgtttcgggtaaccccggggg

SEQ ID NO: 209596 - DNA, 703 bp, Homo sapiens
  misc_feature: GYAE6OF02H3CMD.17.25.C03.1.454.CMB.1.raw
  modified_base (221)..(221): a, c, t, g, unknown or other
  misc_feature (221)..(221): n is a, c, g, or t
tcagcgtagactagcacgaccggtgctcgatttagtagtgtagatttgggtttggggactcaacaaccacatctgtcctctagaagaaaaccctgtgagcacagctcctcaccatggactggacctggaggtactcctctttcgttggtggcagcagctaacaagtcgcccactcccgaggtcgccagcgttggtcgcaggttcggtggggtctaggaggngaaggacgcgtggggcctcgagtgacggtcctcgtgacgaacggtctcgtaggtacttcgtacctttacctactatagttacacgagtgggtgccgacgccgggtaccgtcgtacggaaccacgtacgtcggtaggttaggaggtagggcggcgggtaccgtaaacccagtacggtcgtagtaccgagtacggtcgtactcccaaccgtacgttccccggacgggactaaccgtaaccctttaacgccgtaaccgacccggaaacttaccctcctaacctaacgaaacctacgacgtaacctacgaaggtggtaaacgttacggaggtacgtactaacggaactaccgttaggaaccgtaaccgaccggtaccgtaccttacgttacttcggagttacgacgtaccgtacgacccgtgttacccgtcggacgtaacgccgtcgaccggtaccgtccggttccttcggtaccgtggtcccggg

SEQ ID NO: 209597 - DNA, 710 bp, Homo sapiens
  misc_feature: GYAE6OF02JU0P8.17.25.C03.1.454.CMB.1.raw
  modified_base (319)..(319): a, c, t, g, unknown or other
  misc_feature (319)..(319): n is a, c, g, or t
  modified_base (363)..(363): a, c, t, g, unknown or other
  misc_feature (363)..(363): n is a, c, g, or t
tcagcgtagactagcacgaccggtgctcgatttagtagtgtagatttgggttttgggagtcagtctcagtcaggacacagcatggacatgagggtccccgctcagctcctggggctcctgctactctggctccgagctgccagatgtgacactccagatcgacccagtcctcctactcccttcccctgtcctcgccttcgttggtgggggtacagtacgtcacctatcacgttcggaccggaacgtaacgtccgaccggtaacgtttaaaaccttagtttaaagttgtatacgagacgaacaaaccgtaacggtaaacnccccgatacctcctcgatccgttcgtagtcgacactccactcgngacgacgtccgtacgtacctagtcgtagtcgacgtagccgaggttcgatcggtacggacgttacgtatttacaccgttcctacctacgtacctaccaccgtactccgtacgtacgtacgtagtaggtacttagtacgtaactacgttacttaaccgttactaccgtaagaacgttacgttaacccgttaccgttacccgttcccgtacttacccgttacggttaccggtaaccggtaaacgggttaacgttaacggtacgtaccgtaagtaaccgttaaccggaccgttttaagaccggttaccgtccgtaaaccgttccgttaaaccgtttccggttacttacccg

SEQ ID NO: 209598 - DNA, 801 bp, Homo sapiens
  misc_feature: GYAE6OF02F2JNS.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggactcctcttcgttggtggcagcagctacaagtcgcccacctcccgaggtgcagcgtggtgctaggtcgtcggggctggagggtagaaggaacggccggtggggcctcgaggtaggaacggtcctccgtgacgaacggtcttcgtaggtactttaccgtaccgttttaccctaccttaagttaacgttaacttacgtaacggttggggtacgccgacccgtacgggcccgacgtcggaacccgtaaccggtaccgtaggacggtagggtaaggtggggacggtacggggaacccgtaaaccccgtaaacgtacgttggttcgtaaccgtaagtacggttacgttaccttacccgaaccctaccgttcccggacggtaacgtaccgtaacccgttaaccacgtaccgaacctaacccgtaacctccctaacaaaccgtaaccaacgacccgtaacctaacgtaacgtgggtaacgttagggaaccggtacgtaccgtacgtactaacgttccggaacggtaaccgacccggttaccggccggtttaccttaaaggtttcgtccggtaggacgtaaccgtaccgtacccggtacggtaccggttccgggtaagacccgggtcccgtaacggccggtaccgtccgggttaccctttagggtaccttcgggacggg

SEQ ID NO: 209599 - DNA, 760 bp, Homo sapiens
  misc_feature: GYAE6OF02JPXXJ.17.25.C03.1.454.CMB.1.raw
tcagcgtagactagcacgaccggtgctcgatttagtagtgtagatttgggtttggggtacgtcaacaaccacatctgtcctctagagaaaaccctagtgagcacagctcctcaccatgactggacctggaggatcctcttctggtggcagcagctacaagtcgcccactcccaggtgcagctggtgcagtcgttgggctgaggtgaagaagccgtggggcctcgagtgaacggtctccgtgacgaaggtcttctagggtacttacgtacgtttacctcctaattaggtactactaacgtcgggtcgcgccggagtccgcgtcggaacctacgacttgacggtggagttgggtatccggggaacgtaaccctaacgtacgtggtcacgtacgtagtcggttacttccgaaccctacgttacccggccgggtaaactacgtaacccgttacgaactacggtaaccaaccgtaacctacccgttaaccgtaactaaaccgaaccacgttaccgtaacgtacggtacggttacggttaaggacgacggtcgtaacgtaacccgtaagttaccctacgggaaaccggttaccgtaaacccggggttcccgttaacttttaacgttaaccggtcggttaaccgacgggacccgttaacgggtaccccctacggtaaccggttacccggtacggtaacccggttcggtaaaccgggtcgtaacgggtacccggttccggtttaacggtcccgttaccccgggtaggg

SEQ ID NO: 209600 - DNA, 762 bp, Homo sapiens
  misc_feature: GYAE6OF02JNWQY.17.25.C03.1.454.CMB.1.raw
  modified_base (232)..(232): a, c, t, g, unknown or other
  misc_feature (232)..(232): n is a, c, g, or t
  modified_base (244)..(244): a, c, t, g, unknown or other
  misc_feature (244)..(244): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctgaggtgaagagccgtgggcctcagtgagtctccngcaggtcttcgnggattctaccgtttacctctaatagtactcgaacgtgggtcgccgccgacggccgcgttacggacgtaaccgtaccgtaggaggttcgggaagtggggacgtcggggaaccgtaaaccccgtaacgacgttcgggtacgtacgtaacgtaggttcgtccgtttaccgaaccctacgtcccggtaccgggaaccgtaacgtaacccgttaaccgtacgtaccgtaacccgaaccgtaacccttcccgtaaccgaaacgtaaacccaccgtaacgtaacccgtaacgtacgttacggtaccggttaacggacggtaaccgtccgttacgtaacctaacgtcgtaaccggaaccgaccgtacccgggtaccgttaccttacgtttaaccggtggttaccgacgttacggtaccgtaaccccggtacgtccggttaacccggtgggaacccgtacccgttacggacccggtaccggttccggtttacccgttaccgggttaccgttcccggggtaaccgggg

SEQ ID NO: 209601 - DNA, 720 bp, Homo sapiens
  misc_feature: GYAE6OF02JJIXY.17.25.C03.1.454.CMB.1.raw
  modified_base (242)..(242): a, c, t, g, unknown or other
  misc_feature (242)..(242): n is a, c, g, or t
  modified_base (254)..(254): a, c, t, g, unknown or other
  misc_feature (254)..(254): n is a, c, g, or t
  modified_base (274)..(274): a, c, t, g, unknown or other
  misc_feature (274)..(274): n is a, c, g, or t
  modified_base (624)..(624): a, c, t, g, unknown or other
  misc_feature (624)..(624): n is a, c, g, or t
  modified_base (705)..(705): a, c, t, g, unknown or other
  misc_feature (705)..(705): n is a, c, g, or t
tcagcgtagactagcacgaccggtgctcgatttagtagtgtagatttgggtttgggggactcaacaaccacgatctgtcctctagagaaaaccctgtgagcacagctcctcaccgatggactcggacctggaggactcctcttcgttcggtggcagcagctacaagtcgcccactcccaggtcgcagctggtcgcagtctgggctgaggtgaagacgccgtgggcctcagtgacggtctccngcaacgtcgttntcggattcaccgttttaccnccgtagtacgttatctaacgtcggtgccgtaccgacggccggtcgtacggaccgaacgtccgtaggtacgtaggagtgggagtcgggaccgaaacccttacgacggtcggtactcgacgtacggttactccgtttaccgacgacgttcccgttacgggactaccggtacccgttaaccgtacgtcgtaacccgtacgtaaacccttccccgtaacgaaaccgttaaaccgaccgtaaccggtacccttaacgaacgtttaccgggttaagttccgggaacgtaacccggtcctaagtccgaaacgttctaacgggacctaacggtacccggccgtttacttacgtttacncgggttacgacgtacgtcgtaacccgacgtcgttccggacggtccgaccggtgtacccggaggtcccgtttagttacccgnggtttaccggcgggg

SEQ ID NO: 209602 - DNA, 643 bp, Homo sapiens
  misc_feature: GYAE6OF02JAL3G.17.25.C03.1.454.CMB.1.raw
  modified_base (184)..(184): a, c, t, g, unknown or other
  misc_feature (184)..(184): n is a, c, g, or t
  modified_base (215)..(215): a, c, t, g, unknown or other
  misc_feature (215)..(215): n is a, c, g, or t
  modified_base (234)..(234): a, c, t, g, unknown or other
  misc_feature (234)..(234): n is a, c, g, or t
  modified_base (443)..(443): a, c, t, g, unknown or other
  misc_feature (443)..(443): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtncagtctgggctgagtgagagcctgggcctcngtgagtctctgcagcttcngacttcacgtttacctctatagtactcaacgtgggtacgcgccaggccgacgtaggaccaacgaccgtggagtcggagtagggagtacgggaccgaaccctaacgacgtgggtacgtacacgtacgtcgttccttaccaccctacgtcccgtaccgggacacgtaccttaccgatacgacccacgaaccttccctaccaaactaaaccncgacgtaccctaataccgtaggtacgttcggaaggacgtacccgtagactacgtctaggaccgaccgtaccggtccgttacttacttacgtagtacgacgtacggtactaccccgtacggtaccgttaccggtacgggtaccgtcccgtacggtaccgtacggacccgtttccggttacgtaccgtttccgggaccgggg

SEQ ID NO: 209603 - DNA, 635 bp, Homo sapiens
  misc_feature: GYAE6OF02G1XY0.17.25.C03.1.454.CMB.1.raw
  modified_base (283)..(283): a, c, t, g, unknown or other
  misc_feature (283)..(283): n is a, c, g, or t
  modified_base (604)..(604): a, c, t, g, unknown or other
  misc_feature (604)..(604): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcgagtgaaggtctcctgcaaggcttcgtggtattctacgtttacctcctatagtatcaagtgggngcgccaggccgctggacctaaacgccgttgaacggtggtagtggggactcggggacgtaaacccctaagtaccgtgggtcgtaccaaccgaggttcgttccttccgaacccctactcccgtccgggaacacggtaacctttaccatcgacccaacgaaccttcccgtaccaactaaaccaccgacacctaacagtacggtagttaggacgacgtcctacgacacttctaggaaccgacgtaacggacccgttattaacgttaccgtggtcgtacggacgtaccgtacccgtacgacgtcggtacgaacgtccgtacgccgnggtcccggtcttacggtctttacggccgggg

SEQ ID NO: 209604 - DNA, 709 bp, Homo sapiens
  misc_feature: GYAE6OF02JMHXZ.17.25.C03.1.454.CMB.1.raw
  modified_base (143)..(143): a, c, t, g, unknown or other
  misc_feature (143)..(143): n is a, c, g, or t
tcagcgtagactagcacgaccggtgctcgatttagtagtgtagatttgggtttggggactcaacaaccacatctgtcctctagagaaaaccctgtgagcacagctcctcaccatgactggacctggaggatcctcttcttggnggcagcagctacaagtcgcccactcccaggtgcagcgtggtgcagtcgtgggctggaggtgaagacgccgtggggcctcgaggtagaaggttcctccgtgcgtaacggtccttcgtaggactttccgtaccttttaccgtaccttagttaagttactaccgtaacgtggtacgccgtccgacggccgtcgtaggacgaccgtaccgtggtagtggagtcgggtagtaccggggaaccaacccgtaagcgttggctaccgagtacggttctcctaccgaacccgtacgtcccgtacggaaccaggttaaccctaccacgtacgaacccgtaccgacctaccgtaccctaaagaacccgactacgtacctaacgtacgtacggtagttacggacgtacgtccgtagtaaccagtaccgtacggaaccgtaaccggtccgtaccgttaccttaagttccgtaaggtccgtaacggtccgtaacccgaccgacccgttcgggtaccggtcgaacccgtccggttaacggccgtaccgggttccttaccgttcggtaccgttcgggaccgg

SEQ ID NO: 209605 - DNA, 745 bp, Homo sapiens
  misc_feature: GYAE6OF02I20PQ.17.25.C03.1.454.CMB.1.raw
  modified_base (178)..(178): a, c, t, g, unknown or other
  misc_feature (178)..(178): n is a, c, g, or t
  modified_base (677)..(677): a, c, t, g, unknown or other
  misc_feature (677)..(677): n is a, c, g, or t
  modified_base (696)..(696): a, c, t, g, unknown or other
  misc_feature (696)..(696): n is a, c, g, or t
  modified_base (726)..(726): a, c, t, g, unknown or other
  misc_feature (726)..(726): n is a, c, g, or t
  modified_base (735)..(735): a, c, t, g, unknown or other
  misc_feature (735)..(735): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagctagctaacagtcgcccactcccaggtncagtcgtggtcgctagtcgtgggctggaggtagaacgacgtccgtcgggcctgagtagacggtcctccgtgaccgagtcctcgtggtacttcgtacctttacctccgttaatacgtacgtactacggtcggtcgccgccgtacggtccgtacgtcggaccgacgtaccgtaggaggtacggtaggtggggtacgtacgggtaaccgtaaccgtacgtacggttcggtaccgtaccgtaggtacgttcgttccctaccgaacccgtaccgtacccgtaaccggggaactaaccgttaacccgtaccgtacgtaccgacccgtaaacgtacccttaccccgtaactaaaacggtaaacccacggtaacccgttaccctaaggtaacggtcgggttaaacggttggaaccggggttccaccgtacggtaaccacgttaccggtcggaacccgtaccgtaacccggtcgtttatccgtttaacgcgtacgacgggtcgtaccncccggacttccgggtacgngtccgaccgtcgacgtacggtcgttaccgngttaccggnggtacccggg

SEQ ID NO: 209606 - DNA, 729 bp, Homo sapiens
  misc_feature: GYAE6OF02IPX8G.17.25.C03.1.454.CMB.1.raw
  modified_base (220)..(220): a, c, t, g, unknown or other
  misc_feature (220)..(220): n is a, c, g, or t
  modified_base (244)..(244): a, c, t, g, unknown or other
  misc_feature (244)..(244): n is a, c, g, or t
  modified_base (284)..(284): a, c, t, g, unknown or other
  misc_feature (284)..(284): n is a, c, g, or t
  modified_base (518)..(518): a, c, t, g, unknown or other
  misc_feature (518)..(518): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttggtggcagcagctacaagtgcccactcccaggtgcagctggtgcagtcgtgggctgaggtgaagaagcctggggcctnagtgaagtctcctgcaaggtcttntggattcacgtttacctcctatagtactcaacgtggggtnccgcgacggccgtcgtcgggaaccaacgacccgtggacgtacgggagtggggagtcgggaccgtaaacccaacgtaacgtgggtacgtccaacgtacgttcgttaccttaccacccctacttacccgtacccgggaacgaacgtaacccttacccgtaagtaccgaacccgtaaacccggtaaaccttccccgtaactaaacgtaaaacccgtacgaacctcccgttaaaccgngttagggtaacgtttcgggaacggttaccggtcctaagtacctaccggttcctaacggaaacccgtaccggaaccggttcccgttaataaccgtttaacgtgttaccggaccgtaagtaccgtcccgaaggtacccggttcggacggaaccgtcccggtaaccggcgtaccgggccgttcccgtttaacggtaccgtcgggtacccggggg

SEQ ID NO: 209607 - DNA, 801 bp, Homo sapiens
  misc_feature: GYAE6OF02F4B7C.17.25.C03.1.454.CMB.1.raw
tcagcgtagactagcacgaccggtgctcgatttagtagtgtagatttgggtttgggggacgtcgaacaaccacatactgttccgtctagaggaaaaccctgtgagccacgagctcctcgaccaagtggacttcggacctggaggactcctcttcgtggtggcgagcagctacaagtcgcccactccaggtgcagctggtgcagtcgtgggctgaggtcgaagacgtccgtggggcctcgaggtagaacggtcctcctggaccaagggtcttctggtacttccgtaccgtttaccctcttaagtacgtataccgtaacggtgggtcgccgaccgacggtcccgtccgtagggaaccaaccggaccgtggtaagggttcggaagtgggggacgttaccggggacccgtaaacccctaaacgtaccggtcggttcgtaacctaacgtacggtttcgtacctaccaacccgtacgtcccgtaccggggactaaccggtaccttaccgaacgtaccgaacccgtaaccgtaaccctccctaaccgaaactaaaccgaccgtacgtacctaacgacgttacggaggttacggaacgggtaccgtccgtaaccgtactacgttaccgaaccgtaaccgacccgtaccgggtcctttaaccgttacttaacccggttggaaccgtacgggtacgtacccgaacccgtacgggtaccgttaccggtaccggtaccccgtacggtaacccgggttcggaccgggtttaacccggtccgttttaccgggtacccgtttccgggaaccggggg

SEQ ID NO: 209608 - DNA, 807 bp, Homo sapiens
  misc_feature: GYAE6OF02H4SY1.17.25.C03.1.454.CMB.1.raw
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtgcccactcccaggtgcagctggtgcagtcgtggggctgaggtgaagaagccgtgggcctcgagtgaaggtctcctgacgaaggccttgtcggtattccgtaaccgtttacctcctagtagtataccaacgttgggtcgccgaccgtacggcccgcttacggaacctaaccgtaccgtggtaaggtggtacggtagggggtacgtaccggggaaccgtaaaaccccgtaacgtaaccggtgggtttaaccggtaccgtaaacggtacgtttcggttcccgtttaacccaaccccgtaacggttccccggaaccggggtaaaccgacgttaaacccgtttacccgaaatttcccggaaccctaaaccggtaaccctaccccgtttaaccgaaaactaaaccgtacgaccgtacctaacgtaggtaaccgggtaagttacgggaaacggcctaccgtttcgaactaaccttcggtaaccgaacccgggaacggttacccccggacgtttaccgttaaacttccgggttacgtaccgggacgtaacccggtacggttcccccgaagtaccggttaacccggttggaaccgttaccggtacggccgttaaccggcggtttacccggtcgttacccggttgggtacccgggg

SEQ ID NO: 209609 - DNA, 924 bp, Homo sapiens
  misc_feature: GYAE6OF02INMQ9.17.25.C03.1.454.CMB.1.raw
tcagcgtagactagcacgaccggtgctcgatttagtagtgtagatttgggttgggggactcaacaaccacatctgtcctctagagaaaacctgtgagcacagctcctcaccatggactggacctggaggattccgtcttcttggtggcagcagctacaagtgcccactcccaggtgcagctggtgcagtcgtgggctagaggtgaagaagccgtgggcctcgagtgaacggtctcctgcaagcttacgtgacttcgtaacgtttacctcgtatacgttaactcgtaaactgggtcgcgtaccgacgggtacccgcggttacggaaccgtaacggaccgttaggacggtaggacgttggggactacggggacctaaaacccgtaacgtacgtagggtactccgaacgtagttgtacccttacgaacccgttagtaccccggttcgggaactaaacggttacccttaaaccgtaacggtaaccggtaaccccgtaaaccggtaacccgtttaaccccgttaaacccgtaaaaccgtttaaaaacccgaaaccgttaaaccggacccgttaaaccggtaaaggtttaccgggtaaacgggtttacgggtaaacgggtaaaccgggttaccccgtaaggttacccggtaaagttaacccggttaccgggtaaaaccggtaccggggtaaacccccgggttaaccgggtttaaccgttaaaccgttttaacccgggttacgttaaccgggttaaccgggtaaaccggttaccccggtaaccccgggttaaccgggtaaaccggttaccccgggggttaaagggttaacccggtaaccccgggtttaaacccggtaccggggttaaccggtacccggggttttccccttttaaccgggggtttacccttaccggggttaaccccgggggg

SEQ ID NO: 209610 - DNA, 784 bp, Homo sapiens
  misc_feature: GYAE6OF02H4G3Q.17.25.C03.1.454.CMB.1.raw
  modified_base (225)..(225): a, c, t, g, unknown or other
  misc_feature (225)..(225): n is a, c, g, or t
  modified_base (305)..(305): a, c, t, g, unknown or other
  misc_feature (305)..(305): n is a, c, g, or t
  modified_base (609)..(609): a, c, t, g, unknown or other
  misc_feature (609)..(609): n is a, c, g, or t
  modified_base (716)..(716): a, c, t, g, unknown or other
  misc_feature (716)..(716): n is a, c, g, or t
tcagcgtagactagcacgaccggtgctcgatttagtagtgtagatttgggtttgggactcaacaaccacatctgtcctctagagaaaaccctgtgagcacagctcctcaccatggactggacctggaggatcctcttacttggtggcagcagctaccaagtcgcccacctcccgaggtgcagctgtgcagtctggggctggaggtgaagagccgtggggcctcgngtgaacggtctcctgacacggtcttcgtggtactttccgtaccgttttacctcctagtagttactacacgttcggggtcnccggacctacgggcccgtcgtaacggaactaaacccggtccttagggaacggttcgggaaggtcgggggtaacgtcggggaacccgtaaaaccccgtaacgccggtttagggtcgtacccgaccgtaggttccggttccttacccgaacccgtaaccgttcccgggttacccgggaaaactaccggttaaccctttacccgaagtaacccggtaaccctaaccggtaacccttcccccttaaccgaaaactaaacccgacgacccaacgttacgtagtacggtgtacggtagaaccgtcctaanaccttcgaatcccggaagtacccggtaccgtaccgttaacttacgtacccggttagaccgggtacgtacccgtaccgttacccgaccgtaacgggtaccccggttanaccccggttaccgacccgggagtccggtacccgttttccgtttacgggtacccttcgggaacccgggg

SEQ ID NO: 209611 - DNA, 849 bp, Homo sapiens
  misc_feature: GYAE6OF02HURSJ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactcggacctggaggactcctcttcgttggtggcagcagtctaacaaggtcgccccactcccgaggtcgcagcgttggtgacaggtcggtgggggcctaggtaggtacgaaagaacgtccggtggggtacctcgaggtgaacggtcctccgtgacgtaggtcttcgtggttaacttcgttaccgtttacctacgttagtagttagtaccgtaacggtcgggtacgccggaccgtagggccccggtagttaccgggaaacctaaccggtaacgtacggaggttacgggaagggttacgggtacgtaccggggaaaccctaaacccgttacgacggtagggtacgtaacccacgggttacgtttacgttcccttaacccggttaaccctaccgttacccggggtaccgtaaactaaccggttaacccgttacaaccgtaccggtaacccaacccgtaacccgtacccttaaccgtaaacgtaaaccaacgtacccgtacccgttaagtacggtaagttaacgggttaacggtaaccgtacggttaccgtacgtacgttacgtacgtacggtaaccggtacgtacccgttcccttaacgttagttaccgtacgtacggtaacgggtactacccggtaccgaccggttaccggttaccgggtacgaacccggttacccggtacgaccggtaccggtacccgtttcggtacgttttaccgggaccgggttacccgggg

SEQ ID NO: 209612 - DNA, 720 bp, Homo sapiens
  misc_feature: GYAE6OF02HQ08P.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagagccgtgggcctcgagtgaacggtctccgtgacgaaggtctttcgtggtacttccgtaaccgtttacctaccttaagtacgttatccgtaacgttgggtacgccgaccgacgggtcccgtacgttacgggaaacctaaaccggtaccgtagggtagtacgggtaaggtacggggtacgtcgggggaaccctaaaccccgttaacgacggttcgggtacgtacctacgtagttcgttaccttaccaaccctcgtcccgtaccgggactacgtaaccttaccacgtcgaaccgtacgtaacctaccctacctaaactaaacactacgtaccctaagtacgtaggtaggtacgacggacgtccgtagacctacgttcgaacggtaaccgaccgtaaccggtaccgtactttaacgttccgtagtaccgacgtacgtacccgtaccgacggtacgtccggtacgtaccgtaccgtacggcgcggttaccgttccgttacgtaccgttcggtaccgggg

SEQ ID NO: 209613 - DNA, 747 bp, Homo sapiens
  misc_feature: GYAE6OF02JNFLN.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatccttcttcgttggtggcagcagctacaagtgcccactcccaggtgcagcgtggtagcagtcgtggggctggaggtagaagtacggcgtcggggcctcgagtggaaggtcctccgtaggacgaggtccttgtaggtacttcgtaccgttttactcctattagtatactaacgtgggtcgcggacccgtcggtaccggcgtacgggacgaaccgacccgtggacggtggaggttggggaggtcgggtaaccggaaccccgtaacgtaccggttgggttacggtaccacgtaacgtggttaaccttcccgtaccctaccgtccgttacccggggacacggtaaccgtttaccaccgttagaacccgtaccgtaaccgtaccctacctaaaccgtaaaccaacctacgtacctacgtaacgtacgttacggtaaggtacgtaccggaccgtacgactaccgtgtacggaccgtaccgacggtccgtacgttactagtcgttcggacgtacgtcgtacccgtacggaaccggttccgggtacggtacggtaccctaacgggtacccgtcgggttacccgggttcccgttttcggttaaccggttcccggttaccgggggg

SEQ ID NO: 209614 - DNA, 705 bp, Homo sapiens
  misc_feature: GYAE6OF02HSDRB.17.25.C03.1.454.CMB.1.raw
  modified_base (290)..(290): a, c, t, g, unknown or other
  misc_feature (290)..(290): n is a, c, g, or t
  modified_base (304)..(304): a, c, t, g, unknown or other
  misc_feature (304)..(304): n is a, c, g, or t
tcagcgtagactagcacgaccggtgctcgatttagtagtgtagatttgggtttgggggactcaacaaccacatcctgtcctctagagaaaaccctgtgagcacagctcctcaccatggactggacctggaggatcctcttctggtggcagcagctacaagtgcccactcccaggtgcagctggtgcagtctggggctggaggtgaagagccgtgggcctcgagtgaaggtctcctgacgaaggtcttctggacttctacgtttacctcctatagtactcaacgtgggtcncgccgaggcccgtntaggaccaacgcctaggacggtggagtcggggagttcggggacctaaacccctaagtacgtcggtagtccagtagttcgttaccttccaacccgtactccggttaccgggactacgtaacccttcgacgtaccgaacccaacgtaacccttccctaaccctaaactaaaacccgccgtacgtaaccctaacgtacgtcgggtaggttacggtaacggccggtacctagacctacgttccgacggtacccggacgtaccggtccgttaacgttactttacgtgtacggacgtacgtacccgttacccaccgggtacggttaccccgggtagaccgtacccggttaacggccgtaacgggttcccggttaaccgtttcggtacccgttccgggtaacccgggg

SEQ ID NO: 209615 - DNA, 688 bp, Homo sapiens
  misc_feature: GYAE6OF02G7BNE.17.25.C03.1.454.CMB.1.raw
  modified_base (367)..(367): a, c, t, g, unknown or other
  misc_feature (367)..(367): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatcgacccagtcctccatccctccctgtctcgcctcgtggtgggggtacagtacgtcaccgactctacgttcgaccggtaacaacgtccgaacggtaaccgtttaaaaaccttaagttttaaaagttggtaacttcgaacgacgtaaagtaaaaccgtaggaaaaaaccgccccgaaggtaacccttcgtacgaacttccgtcgtcggtacncctaacgtccactcgtacgacgtagcgaccgtaccatcggtagtactaggcggtacagggtactcgtcggtaggaacgtagttaacttacaagtcctctaacccatacccgaactacgtactacgactaaccgtagacgtattcgagtaacctacttactaacttacgtctaaacgacgtaagtaaccgtttacgtaccgtttcccgttaacgtacccgtttacgttaccgggtaaccggtaacggtaaaccgtagtacgtaacgtaactaaaccgtaaacgtggtacgtcgcttacgaccttacgtacttcggtacttcg

SEQ ID NO: 209616 - DNA, 612 bp, Homo sapiens
  misc_feature: GYAE6OF02HO9BK.17.25.C03.1.454.CMB.1.raw
  modified_base (198)..(198): a, c, t, g, unknown or other
  misc_feature (198)..(198): n is a, c, g, or t
  modified_base (265)..(265): a, c, t, g, unknown or other
  misc_feature (265)..(265): n is a, c, g, or t
  modified_base (304)..(304): a, c, t, g, unknown or other
  misc_feature (304)..(304): n is a, c, g, or t
  modified_base (339)..(339): a, c, t, g, unknown or other
  misc_feature (339)..(339): n is a, c, g, or t
tcagcgtagactagcacgaccggtgctcgatttagtagtgtagatttgggtttgggggagtcagtctcagtcaggacacagcatggacatgaggtcccgctcagctcctgggctcctgctactctggctccgagctgccagatgtgacatccagatgacccagtctccatcctccctgtctgcctctgtggggtcagngtcaccatcacttgcgacaagtcacggcttaaaactattaaatggtatcagcagaaacctggaaaanccccagacctctgactctctggtgcaatccactctacgngaagtgcgtcccagtccggagttccgagttcgacnggtcgactcgtgggacagtatttccaaagtcttaccaaccgtactcccgaactctaccgtcgtaacctaaaccctgggtaacggtactttacggtacgtctaaacgttccttactacgtacgtacaacgtaggtaactttaccgaaccgtttccccgtacggtcttaaccgttttcggaccgtaaaggggacccgttaagttcggtaacggtaataaaccgtaaacgtaactggttacgtactacggccttaaccacgttaccgtgttacccc

SEQ ID NO: 209617 - DNA, 681 bp, Homo sapiens
  misc_feature: GYAE6OF02FXALA.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtctgggctggaggtagaagagccgtggggcctcgagtgaaggtctccgtgacgaaggtcttcgtggattccgtaaccgtttacctcttaagtacgttatacgaacgtgggtgccgccgaggcccgcgtacggaaccaaccgtacctaggtagtcggtagtagggtagtcgggaaccgaacctaaccgtacgtggtcgtactacgtacgtgttcctacctaccctaccgtccgtaccggtacacgtaaccttaccgtaacgtacgaacccaaccgtaacctcccgtaccaaacgttaaccaaccgactaccctaactacgttaggagttacggaacggtcgacccttagaaccttacacgtaccaaccgggcccaaccgggtccttaccgtaacttcgttaggtccgagttaacccgctaaccgccgggtaactccgggtagaccgtcgaacggtcgacggtccgtaccgtttcgtccggttaccggtccgggg

SEQ ID NO: 209618 - DNA, 553 bp, Homo sapiens
  misc_feature: GYAE6OF02IO1VU.17.25.C03.1.454.CMB.1.raw
  modified_base (280)..(280): a, c, t, g, unknown or other
  misc_feature (280)..(280): n is a, c, g, or t
  modified_base (474)..(474): a, c, t, g, unknown or other
  misc_feature (474)..(474): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctggagtggatggggatcggggcgaaaccctagacgtggtcgtcacagtgtcttcacccatccgtccgggacagacttaccactcgacacgactccctaccaataaacacacgccctacatggagttgaggacgcctagacatcgcgaacgacgacgccgttactatttacnggtcgcgagaccgtcccacgtacgtccggtagacgccgtaaggccacggtccgtccgtttcgaccgttcggtaccgggg

SEQ ID NO: 209619 - DNA, 892 bp, Homo sapiens
  misc_feature: GYAE6OF02FWNU0.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtagaagagccgtggggcctgagtgaaggtctccgtgacgacggtcttcgtaggtacttaccgtaccgttttaccctccttaagttaacgttacttaccgtaaaccgtgggggtcgccgtacccggaacgggcccgtcgttacggggaaccgaaaccggtacccgttaggacgggttaggggtaacgtcgggggagttccgggggaaccgtaaacccccgttaacgtacggttcggggttacgtacctaaccggtacggttcggtttccttacccgacccccttacgtttccccgggtaaccgggtaaccctaacggttaaccccctttaaccccgaagtttaacccgggaacccctaaacccggtaaacccctttaccccttaaccgtaaacgtaaaaccctaaccgtaaaccgtaccccgttaacgaacggtttacgggttaaggttacgggaaggttaccggtacccgttaacgtaccgttaacgtccggttaacggacccggttaacggtcccgggtacccgtttacgttaaccgtttaccgttcggtacgacggtaacggtaccgttaccccggtaaggttcccggttaacccgggtcggtaacccggtaccgttaacccggggacgaccgggtttacccgggttacccgttttcgggtaaccggttttcccggtaacccgggggg

SEQ ID NO: 209620 - DNA, 726 bp, Homo sapiens
  misc_feature: GYAE6OF02FV79L.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggcctcgaggtagaaggtcctccgtgacgaaggtcttacgtggtactttccgtaccgttttaccctacgtaacttagtacttacgaacgttcgggtcgtccggaccgtacgggcccgtacgtcgggaaccaaccggtccgtggaggtaggtagtcggggacgtacggggaccgtaaacccgtaacgtacgtaggtacgtacgtacgtcgtcgtccttaccaccctacgtccgtaccggaactacgtaccgtaccagtaccgacctaacgaacctcccgtaaccaataaaccaccacgtaccctaagtacgtacggttagacggtaggacctcgtacgactacgtccgtacgaaccgaccgtacccgggtacgttaccttaagttacggtcgtacgcggtacgtaccgtacccgtaacggtcggttaccggtacggtaaccggtccggtaaccgggacgtacccggggtccgtttacccgttaccgggtttacccgttcggggtacccggggg

SEQ ID NO: 209621 - DNA, 606 bp, Homo sapiens
  misc_feature: GYAE6OF02GDTAA.17.25.C03.1.454.CMB.1.raw
  modified_base (239)..(239): a, c, t, g, unknown or other
  misc_feature (239)..(239): n is a, c, g, or t
  modified_base (274)..(274): a, c, t, g, unknown or other
  misc_feature (274)..(274): n is a, c, g, or t
  modified_base (283)..(283): a, c, t, g, unknown or other
  misc_feature (283)..(283): n is a, c, g, or t
  modified_base (332)..(332): a, c, t, g, unknown or other
  misc_feature (332)..(332): n is a, c, g, or t
  modified_base (338)..(338): a, c, t, g, unknown or other
  misc_feature (338)..(338): n is a, c, g, or t
  modified_base (433)..(433): a, c, t, g, unknown or other
  misc_feature (433)..(433): n is a, c, g, or t
tcagcgtagactagcacgaccggtgctcgatttagtagtgtagatttgggtttggggactcaacaaccacatctgtcctctagagaaaaccctgtgagcacagctcctcaccatggactggcctggaggatcctcttcttggtggcagcagctacaagtgcccactcccaggtgcagctggtgcagtctggggctgaggtgaagagcctggggctcagtgaaggtctctgcaagcttcnggattctacgtttacctctatagtatcaatgggtncgcagccgntcggacacgacctgagtggagtgggatgggacctaaacctacacgtggngtccanagtctctcaccctagtccgacgggacacgtacttaccagtcgaaccacgaactccctacaactaaacacacgactacatggagttaggaggtacncgtagactatccgtagaccggaaccgacccggttaccttaccttaacgttacgttggtaccggacggaacgtaccggttaccccaacggtaacggttacccgggtagaccggtaccgttaacgggtacgacgggtccggttacccgttttccggaccgtttccggtaccgggg

SEQ ID NO: 209622 - DNA, 672 bp, Homo sapiens
  misc_feature: GYAE6OF02JLQYZ.17.25.C03.1.454.CMB.1.raw
  modified_base (187)..(187): a, c, t, g, unknown or other
  misc_feature (187)..(187): n is a, c, g, or t
  modified_base (242)..(242): a, c, t, g, unknown or other
  misc_feature (242)..(242): n is a, c, g, or t
  modified_base (259)..(259): a, c, t, g, unknown or other
  misc_feature (259)..(259): n is a, c, g, or t
  modified_base (336)..(336): a, c, t, g, unknown or other
  misc_feature (336)..(336): n is a, c, g, or t
  modified_base (343)..(343): a, c, t, g, unknown or other
  misc_feature (343)..(343): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcngtctgggctgaggtgagagcctgggcctcgagtgaaggtctctgcaaggcttcgnggattctacgtttaccnctatagtatctaactggtcgacgccgtaggccgctggaccaacgacctgagtggagtgggatcgggcaacctaacgngtggttnctacgagttcggtaccttaccgaccctatcccgtaccgggaactacggtaccttaccagtaccgaaccctaacgaaccttccgtaccctaaacgtaaccaaccgtacgaccttaacgtaagtcgggtaacgttcggaacgacgtaccgttagaccgtacttcgtagaacccggaccgtacccgggttacgttactaacgttactaggtaccggcggtaacgtccgtaaccccgtaggaaccggtttccggtcgtaaccggttaccccgtaggccgggaccgttacccgggttctttacccgggtttacccggttacggggacccggggg

SEQ ID NO: 209623 - DNA, 647 bp, Homo sapiens
  misc_feature: GYAE6OF02JQOUH.17.25.C03.1.454.CMB.1.raw
  modified_base (235)..(235): a, c, t, g, unknown or other
  misc_feature (235)..(235): n is a, c, g, or t
  modified_base (414)..(414): a, c, t, g, unknown or other
  misc_feature (414)..(414): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgagtgaagagctgggctcagtgaggtctctgcaggcttntggagcaccttcagcactatagttacaattgggtgcgacggcctgtggacaaggccttgaggtggacgtggggaagactcgtaccctagtcgtgaccacaaccaactcgacacagaacgttccgagggtcaggacctcaaccactaaccggacggaacctaaacgttaacgaaacctanaacgttaatccgtagggaacctacgtagaaacctagtacccttagtaccaggttacgtggaacggaccgtaaaccgggtcttaccgtttaccttacgtcggttacgaacggtacgtaacggttaactttaccgtaagttaaccgacgttacgttacccctttttaccgtttaacctcccccggttaccctttggttaacccgtttccgggttaccgggaccgtttaacccggg

SEQ ID NO: 209624 - DNA, 875 bp, Homo sapiens
  misc_feature: GYAE6OF02GJ0AO.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagcgtggtgctagtcgtgggctggaggtagaaacgaacgccgtcggggcctcgaggttagaacggtcctcctgacgtaagggtccttcgtacggtattccttaacgtttaccccttacgtaattacgttaactccgtaaacgtggggtcgccggtaccgacgggtcccgacgttcgggaaacctaaaccgggacccgttaggacggttaggaacggttaggggtacgggtccgggggaaccccgtaaaacccccgttaaacgacggtttacggggttacgtacccaaacgggttacggttcttaccccgttaccaaacccccgtcgttaccccgggtacccggtaaccgtaactaacccggttaacccgactaaccggaacccgtaaccgtaaacccttccccgttaaacccgaaaccttaaaacccgaaccgttaaccgtaaccccttaacgttaaccggtacgggtttaaacggttcggaaccggtaaccgtaccgtaacggacctaaccgttaccgtacgaaaccgtacccgaacccggggttcttaaccgtttacgttcgttacggcggtaacgtacggaaccttaccccggaaggtacccggttaccggaacggtcccggtaacccgtaaccgggtaccgtacggggtaaccgtttcccggtttaaccgtacccggttccgggtaacccgggg

SEQ ID NO: 209625 - DNA, 688 bp, Homo sapiens
  misc_feature: GYAE6OF02F2GSX.17.25.C03.1.454.CMB.1.raw
  modified_base (455)..(455): a, c, t, g, unknown or other
  misc_feature (455)..(455): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagcgtggtgcagtcgtgggctgaggtgaagaagccgtggggcctcagtgaaggtctctgcgaggcttctggtattccgtacgtttacctctatagtactacacgtgggtgcgccgaggccgcgtgggaaccaaccgaccgtgaggtggagtggggagtcggggaccgaaaccctacgacgtggtcgtacacgtagtcgttccttaccaccctacgtccgtaccgggactacgtaccttaccgatacgaccacgtaacccttcctaaccaactaaaccncgacgtaccctaagacgtagggtagttaggacgtagtcccgtaagaccgtagttaccgtacggaaccggacggtaccgggttccttaacgtttaactttacggttcggtacggtaccggtaacgtacccggtacccgtacgggttacccggtccgggttacgacccggttacccggtaacgggccgtacggtccggtttacccttttacggaccgtttccgggtaccgggggg

SEQ ID NO: 209626 - DNA, 797 bp, Homo sapiens
  misc_feature: GYAE6OF02IONU4.17.25.C03.1.454.CMB.1.raw
  modified_base (185)..(185): a, c, t, g, unknown or other
  misc_feature (185)..(185): n is a, c, g, or t
  modified_base (251)..(251): a, c, t, g, unknown or other
  misc_feature (251)..(251): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtncagtcgtgggctgaggtgaagaagccgtgggcctcgagtgaaggtctccgtgacaaggtcttacgnggtattcctaccgtttacctctatagtatacaacgtggtacgccgtccgacggtccgcgtacggaaccgaaccgtaccgtaggaacggtggagtaggggtacgtcggggacccgtaaaacccgtaacgtacgttcgggttacgtacgaacgtacggtcgttaccttaccgaccctacgtacccgtaccgggtaacgtaacgtaccgttaaccacgttcgaaacccgtaacgtaacctcccgtaaacctaaactaaaacccgactaacaaccccgttaatacggttacgggtagttacgggaacggtaccgtaccttaggaactacgttaccgtaacggaaccgtaaccggtaccgggttaccctacgttttaacgttacccggttggtccggtaaccggtaacgtacccggttaaccccggtaaccgggttacggttacccccgggtaggtaacccttaccccggggttaacccggcggttaaacccgggttccccggtttaccgttttaccgggttaccccggtttcggggtaacccccgggggg

SEQ ID NO: 209627 - DNA, 744 bp, Homo sapiens
  misc_feature: GYAE6OF02GW6PM.17.25.C03.1.454.CMB.1.raw
  modified_base (630)..(630): a, c, t, g, unknown or other
  misc_feature (630)..(630): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttctggtggcagcagctacaagtgcccactcccaggtgcagctggtgcagtctggggctggaggtgaagaagccgtggggcctcgagtgaacggtctcctgacaacggtcttacgtggtactttcgtaccgttttaccgtccttaagttacgttaactcctaaacgtggggtcgccggtccacgggcccgtcgtacggaacctaaccgtcctagggaacggttcgggaagttcgggggtaagtcggggaacccgtaaaaccccgtacgaaccgttgggtactaccggtaaccgaggtttccggtcctttaccgaaccccgtacgttccccggtaccgggaactaacggtaccttaacccgacgtacgaacccgaacgtaaccttccctaaccgaaactaaaccgacaacgtcctaacagttaggacgttagacggtagcctagtacctagcgtacggacctaaccggtccgtaccgttactacgttttaaccgnggttaacgccgtaaggtacccgtaccctaaccggtaacgttcccggtaaggacccgtaccgttaccggaccggtacggtccgttccggtttacggaccctttcgggaaccgggg

SEQ ID NO: 209628 - DNA, 736 bp, Homo sapiens
  misc_feature: GYAE6OF02HQ01H.17.25.C03.1.454.CMB.1.raw
  modified_base (174)..(174): a, c, t, g, unknown or other
  misc_feature (174)..(174): n is a, c, g, or t
  modified_base (617)..(617): a, c, t, g, unknown or other
  misc_feature (617)..(617): n is a, c, g, or t
  modified_base (675)..(675): a, c, t, g, unknown or other
  misc_feature (675)..(675): n is a, c, g, or t
  modified_base (709)..(709): a, c, t, g, unknown or other
  misc_feature (709)..(709): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctgggagatctcttctggtggcagcagctacaagtcgcccactcccaggtncagctggtgcagtcgtgggctgaggtggaagaggccgtgggcctcgaggtgaacggtctccgtgacgtaaggtcttcgtggtatttccgtaccgtttacctcctaagtagttactaccgaaaggttggggtaccgccgaccggacgggccgtaccggttacggaacccgaaccggtaccgtaggtaacgtggtacggtaggggtacgtacggggacctaaaccccgtaataccggtggtactaaccgcggtaacgtttcgtacctttaccaaccccgttacgtcccggtaccgggtaaactaccgttaaccggttaccaagttacccgaacccggtaacgtaaccccgtttaccgtaacccaaaacgttaacccgaccgtacggtaaccccttaacttaaaccggggtgtaaacggttagggtaaacgggctttccgggaacncgtaccgtagaccggtaacgacgacccggttactacgtttactaccggtggacgtacnccgtacgtcgtacgacgtcggcaagaccctggtnaccggtgtaccgtgacgttcgacgggg

SEQ ID NO: 209629 - DNA, 683 bp, Homo sapiens
  misc_feature: GYAE6OF02I8KPQ.17.25.C03.1.454.CMB.1.raw
  modified_base (353)..(353): a, c, t, g, unknown or other
  misc_feature (353)..(353): n is a, c, g, or t
  modified_base (442)..(442): a, c, t, g, unknown or other
  misc_feature (442)..(442): n is a, c, g, or t
tcagcgtagactagcacgaccggtgctcgatttagtagtgtagatttggggtttgggggagtcagtctcagtcaggacacagcatggacatgacgggtccccgctcagctccgtgggctcctgctactctggctccgagctgccagatgtgacatccgaagcgtcgaaccctgtcctcctacttccctcccgtgtctcgtcctcggtggtcgggggtacaggtcgtaccaacctctcctacgttcggaccgaactaacgtccgaacgggtaaccttaaaacttaattttaaacgttggttaactaccgagacgtaacggaaaccgtacggaaaaccgtcccacgtacctacgntactcgtgcgtagctactccgacctggacgtacgtcgcctaccgagtacgtgtactacggtgtcgtgtgacgtgacggtatagttactntaacgtcaacgacctactaccgtactacgtactctaacctaccgtaaggcgttagtacgtacgtactaaccttacgttaccttaacgtgtaacacgttacggtaacttaaccgtccgtaccccgttgttaccgttaccggtttacggaacggtaaacgttacgtaacgtcggtaacgtaaccgttaacggtaaacgcggtaaggtcggtctacgaccgtactacgttcttacgttctaccg

SEQ ID NO: 209630 - DNA, 778 bp, Homo sapiens
  misc_feature: GYAE6OF02GBF4V.17.25.C03.1.454.CMB.1.raw
  modified_base (185)..(185): a, c, t, g, unknown or other
  misc_feature (185)..(185): n is a, c, g, or t
  modified_base (239)..(239): a, c, t, g, unknown or other
  misc_feature (239)..(239): n is a, c, g, or t
  modified_base (293)..(293): a, c, t, g, unknown or other
  misc_feature (293)..(293): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtncagtcgtgggctgaggtagaagaacgccgtggggcctcgagtgaaggtcctccngacaaggtcttgtggacttctacgtttacctcctatagtactacaagtgggtcncgccgaggccgagtaggaaccaacgaccgtggaaaagtggagtgggagtcgggaccgtaaacccttaacgacgttgggtacgtacgaacgtaggttcgttcccttaccaaccccgtagttaccccggaccgggaacctacgtaacccgtttaaccaagtaccgaacccgtaaccgtaaacccgttccctaaaccctaaacttaaaaacccgacccgaaccgtaaccccttaacgtaacgttaacggggtaacggtttacgggaaaccgggtacgttacccgtaaacgaacctacgtttaacccgtacggaaaccggaccgtaacccgggtacctttaacgttaaacgtttaccgtacgttacggacgaacgtacccgtacccgaaccgggttaaggtacccgggtacggtaaccggaccccgttaacgggcccgtaacgggttcccggttacccttttagggaccccgtttgggtaacccggggg

SEQ ID NO: 209631 - DNA, 746 bp, Homo sapiens
  misc_feature: GYAE6OF02FVPZ9.17.25.C03.1.454.CMB.1.raw
  modified_base (232)..(232): a, c, t, g, unknown or other
  misc_feature (232)..(232): n is a, c, g, or t
  modified_base (247)..(247): a, c, t, g, unknown or other
  misc_feature (247)..(247): n is a, c, g, or t
  modified_base (260)..(260): a, c, t, g, unknown or other
  misc_feature (260)..(260): n is a, c, g, or t
tcagcgtagactagcacgaccggtgctcgatttagtagtgtagatttgggtttggggactcaacaaccacatctgtcctctagagaaaaccctcgtgagcaccagctcctcaccatgactcggacgtcggaggatacctccttcttggtggtcagcagctacaagtgccgacctcccagtgcagctggtagcagtcgtgggacgtggaggtagaagaagccgtggggcctcngtagaggtactcctncgagtcttctagnttcctacgttacctctatatatcaacgtgggtgtccgccgtaacggcccggtacgtacggacctaacggtacccgttggaaggtttcggagttagggagttacgggacccgtaaacccgtactacgtaggtcgtaccgtaaccgtagggtccgttccttaccgacccctaccgttacccggtaccgggactacgtaccctttaccgaactaggaccctaaccgtaacctcccgtaacctacgtaaaacccgctaaccgaccctaagtacgtacgtaggttaggacgtaacgcctacggactacggtcctacgggaaccttaccggaccggttcgttacccgttaacgtacttttacggcgtaccggtaaccgtacggttccccacgggttaaccgtacccggttacggacccttaccccgggttaggaaccccgttcgggtacccgtttcccgtttaacgggtccctttaccgggttaacccgggg

SEQ ID NO: 209632 - DNA, 700 bp, Homo sapiens
  misc_feature: GYAE6OF02G9DCB.17.25.C03.1.454.CMB.1.raw
  modified_base (219)..(219): a, c, t, g, unknown or other
  misc_feature (219)..(219): n is a, c, g, or t
  modified_base (251)..(251): a, c, t, g, unknown or other
  misc_feature (251)..(251): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcgttggtggcagcagctaacaagtcgcccactcccaggtgcagccgtggtgcagtcgtgggctggaggtagaagacgcgngggctcgagtgaaggtctctgcgagtcttcgngtacttctacgttacctactatagtatacacgtggtgccgtccgacggccgtcgtacggaacaaccgaaccgtggaggtaggagtggggtacgtcggggaacctaaaccctaacgtacgtcgggttcgactacgtagttcgtccttaccaaccctcgtcccgaccggaactaacacttaacacgtacgaaccgtaccgaaccctaccgaacctaaacgtaaacctaaccggaactaccgtaacctaaggtcgttaacggtaacgggtaacggaccgtaccggtacgtacctacgttcgaaccggaccggaaccgacccggttccgttaacgttacgttacgtaggtccgacgttaaccggaccgtacccgacgtaaccggtcccggtacgggtaaccaccggtacggccggaccgttacggtccgttactccggtttcgggaacccggg

SEQ ID NO: 209633 - DNA, 726 bp, Homo sapiens
  misc_feature: GYAE6OF02JNEPU.17.25.C03.1.454.CMB.1.raw
  modified_base (242)..(242): a, c, t, g, unknown or other
  misc_feature (242)..(242): n is a, c, g, or t
  modified_base (523)..(523): a, c, t, g, unknown or other
  misc_feature (523)..(523): n is a, c, g, or t
  modified_base (559)..(559): a, c, t, g, unknown or other
  misc_feature (559)..(559): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccgaggtgcagcgtggtgcagtcgtggggctggaggtagaaggacgccgtggggcctcgagtagaggtcctcngactaggtcttcgtggtacttcgtaccgtttaccctaccttagtacgttataccgtaacgttggggtcgccgccggacggtccgccgtacgggaacctaaccggaccgtggaaggtggaaggtgggtaggtacgggaccgtaaacccgtacgtaacgtcgggtacgtacctaacggtgttacgttccttaccgacccgtaccttcccgtaccggggactacgtaaccctacgacgtacgaccgtaacgtacctacctacgaaacctaacacacgtacctanaccgtaggtagtacggacggtacgacctacgtaacncgttcgacgaaccggaccgtacccggttacctaacgtttaaccgttacgtacggttacggtaccgacggtacccgttacggaaccgttaccgtacggtacggaccgttacggtaccggaaccggttcggtaccgggttcccttacggttacccggtcggtaccgggg

SEQ ID NO: 209634 - DNA, 758 bp, Homo sapiens
  misc_feature: GYAE6OF02IRL3F.17.25.C03.1.454.CMB.1.raw
  modified_base (249)..(249): a, c, t, g, unknown or other
  misc_feature (249)..(249): n is a, c, g, or t
  modified_base (360)..(360): a, c, t, g, unknown or other
  misc_feature (360)..(360): n is a, c, g, or t
tcagcgtagactagcacgaccggtgctcgatttagtagtgtagatttgggtttggggactcaacaaccacatctgtcctctagagaaaaccctgtgagcacagctcctcaccatcggactggacctggaggactccgtcttacgtggtggcagcagctaccagtcgacccactacccgaggtcgacgagcgtggtcgcgtacgttcggtggggtctaggaggtagaaacggtacgccggtgggtccctntaacggtaggtaacgtcctacgtcgaaccggtaggttccgttgaggttaccttaccgttacccgtttaccttacgttacgtacgttactccgtaacgttgggtaccgaccnccgacggcctacggtacgaacgtaccgtaccgaggtacggtagtacggtcggtaaggttaccgggaccctaaccgtagtcggttcggtactacgtacgtacgtcttaccacctaccgtacctccggaaccgtacgtacgtaacctccaccgtaacgtaccgtaaccgtacccgttacctaaccgtaaactaccgaactaccgtaccacgtaccgtacggtaggtaccgtagggacccttacgtaccgtactaccgtaccgtacggtaccgaccggtaccgtaccgttaacgttacgttacggttcgcgtacgtacgaccgttacgtaccggtacggtacggtaccggaacgtaccgtcggaccgtcgtaccggtactacggttaccgtccgggtccgg

SEQ ID NO: 209635 - DNA, 672 bp, Homo sapiens
  misc_feature: GYAE6OF02FKKOQ.17.25.C03.1.454.CMB.1.raw
  modified_base (283)..(283): a, c, t, g, unknown or other
  misc_feature (283)..(283): n is a, c, g, or t
  modified_base (347)..(347): a, c, t, g, unknown or other
  misc_feature (347)..(347): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcgagtgaaggtctcctgcaaggcttctggattcgacgtttacctcctatagtatcaacgtgggtcncggccacggccgcgtcggacaacgacctggacgtggagtgggatggggaccgaaacccgtaacnccgtggtcgtcgaactggttcgtccttacacccctagtcccgtcggggaacctagtacccgttacattacggacccacgtaacctcctaccaaagtaaaccaccaacgtacccttaacagtagggtaagttacgggaacggacggtacctaggtaacctacggtacttacggaccgacggtacccgtcccggttacttaagtttaccgtggtacgtccggaagtaccgtacccgtacggtaaccgtccgggtagtaacccggcccgttaaccggccggaccggttcccgggttaacccgtttggtacccggttggtacccggggg

SEQ ID NO: 209636 - DNA, 584 bp, Homo sapiens
  misc_feature: GYAE6OF02HF2FY.17.25.C03.1.454.CMB.1.raw
  modified_base (242)..(242): a, c, t, g, unknown or other
  misc_feature (242)..(242): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctggagtgaagagcctggggcctcagtgaaggtctcctgcaaggcttcngattcacgtttacctcctatagtatcaacgtgggtgcgccaggccgcgtggacaacgacctagaggtcgagtaggacgtggacgaaccctaacgcgtaaaaggtgtacacgagtcgtctacaccctactcccgtacggacacggtaccttaaccgactacgaaccacgaaccgtcctaccaataaaccgacacgtaccgtacacgtaggtagttaggagacgctacgacactcgacgacgaccgacggaccgttactacttacgtgtacgacgtacgacgtaccgacgtacgtccgagtacgacctacggcgtacgccgttcgttcgtacgtcggtaccggg

SEQ ID NO: 209637 - DNA, 730 bp, Homo sapiens
  misc_feature: GYAE6OF02GE2YF.17.25.C03.1.454.CMB.1.raw
  modified_base (230)..(230): a, c, t, g, unknown or other
  misc_feature (230)..(230): n is a, c, g, or t
  modified_base (285)..(285): a, c, t, g, unknown or other
  misc_feature (285)..(285): n is a, c, g, or t
  modified_base (620)..(620): a, c, t, g, unknown or other
  misc_feature (620)..(620): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactccagtgcagctggtgcagtcgtgggctgaggtgaagacgctcgggctcagtgacggtctctgnaggcttctggattcgtacgttacctactatagtactcaacgtgggtacgcgaccngggcccgtatacggtaaccgaaccgtacctggtacgtaggacgtgggacttcgggggacccaaacccgttaagaaccgtgggtctaccgagtaggttcgttacttacccgaccgtaacttcccgggtaccggtaagtaaccgtaccttaaaccgtgaccgttaacccgaccggtaaaccttccccgtacggtaaaaacttaaacccggaactaaccggacccctttaagaaccggttaggggttaaacgttacgggaacggtaaccggtccttaaacgactacgttacccgtaggaacccgttaccgtacccgggtacttacttaggttaaccgnttacggacgtaaccgaccgtacccgtaaggtccggttacccggagtaacccgaccgttaacgggcctaacgggttccgtacccgtttaaggttcccgtaggtacccgggg

SEQ ID NO: 209638 - DNA, 737 bp, Homo sapiens
  misc_feature: GYAE6OF02IB0GU.17.25.C03.1.454.CMB.1.raw
  modified_base (546)..(546): a, c, t, g, unknown or other
  misc_feature (546)..(546): n is a, c, g, or t
tcagcgtagactagcacgaccggtgctcgatttagtagtgtagatttgggtttggggactcgaacaaccacatctgtcctctagagaaaaccctgtgagcacagctcctcaccatggactggacctggaggatcctcttcttggtggcaggcagctacagtgcccactcccaggtgcagctggtgcagtctgggctggaggtgaagagccgtgggcctcgagtgaaggtctacctgcgtaggtccttgtaggtatttccgtaccgtttacctaccgttataagtactacctaacgtgggtacggccgtaccgacggtcccgtcgtacgggaaaccaaacggtacccggtaggagggttagggtaacgtcggggggtacgtaccggggtaaccccggttaaacccctaaaccggtaccggttcgggttacggttaccaaaccgggttcggtacggttacctttacccgaccccgttaacgttcccgggtaccgggaccttaacggtaacccttacccgagttaccgaacccgtaactacccgtaccnccgtaaactaacgacgaacgtctacgtagtaggtcgttaagacgtcggcctaaggctacgtacgtacgacgtacggtaccgccgtattacgttcggagtcggcgtaacgccgtacccgtagtcggtaccggttcgacggtacccgtacggaccgcggtaccggttcccgttaggtccttaccgggtacggg

SEQ ID NO: 209639 - DNA, 675 bp, Homo sapiens
  misc_feature: GYAE6OF02IDEY5.17.25.C03.1.454.CMB.1.raw
  modified_base (188)..(188): a, c, t, g, unknown or other
  misc_feature (188)..(188): n is a, c, g, or t
  modified_base (230)..(230): a, c, t, g, unknown or other
  misc_feature (230)..(230): n is a, c, g, or t
  modified_base (321)..(321): a, c, t, g, unknown or other
  misc_feature (321)..(321): n is a, c, g, or t
  modified_base (590)..(590): a, c, t, g, unknown or other
  misc_feature (590)..(590): n is a, c, g, or t
  modified_base (596)..(596): a, c, t, g, unknown or other
  misc_feature (596)..(596): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgtggtggcagcagctacaagtcgccactccgaggtcgcagtctgggtancacggttcgaggggtctggtaaggtaggaacgagtccccggnggggtcctcgtaagtaggaacggttctacctggacacggtcttcgtggtaacttcgtaaccgttcctactatgtataccgtagtcgggtcncgacctacggccgtctacggactaaccgcgtagtcgtacggtagtacggatccggggtaacctaacctaacgtcggtgtctaccgaacgtggttccggttacctcctaacccgtcgttaaccgccgggttaaacctcggttaccttaaccgagtcccgaaccgtaacgtacctaccgaaccttaaacgtaaacgactaaccggtacctagtactaccggtagttacgacggtactacgacgtcaggctacgacgacgtacgctaacttntacgtnacgaccgactcgtaccgacgaccgttacggacgacgtaccgaccggtcacgtccgtccgtagttcccgtggtacccggg

SEQ ID NO: 209640 - DNA, 764 bp, Homo sapiens
  misc_feature: GYAE6OF02JCVWT.17.25.C03.1.454.CMB.1.raw
  modified_base (500)..(500): a, c, t, g, unknown or other
  misc_feature (500)..(500): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcgagtcgtggggctggaggtgaagaagccgtgggcctcgagtgacggtctccgtgcaaggtcttcgtggtacttctacgtttacctccgtatagtatctaacgtgggtcgcgcacgggccgcgtacggacaccgacctggaagtggtacgtggggagtacggggaccgtaaacccgtaacgtacgttcgggtacgtaccgacgtacggtttcgtccttaccgaccctacgttcccgtaccggggactaaccgtaaccgttaccacgtaccggtaacccaacgtaaacccttcccgtaaacctaaactaaaacccnccgaacgtaccttaacgagttacgggtagttcgggaaaggtaccgtcctaacggtacctaaccggtttcgacgggtaaacccgaacccggtacccgggtacccgtttacttaaaccgtttccggttacggttacgggaaccgtaccggttacccggtacccgtaacgggtaccggtttcccgggagtaacccggtacccggtacggggccttacgggtaccccggtttctttaccgggttacccggtttacgggacccgggggg

SEQ ID NO: 209641 - DNA, 745 bp, Homo sapiens
  misc_feature: GYAE6OF02FIPWO.17.25.C03.1.454.CMB.1.raw
tcagcgtagactagcacgaccggtgctcgatttagtagtgtagatttgggtttggggacgtcaacaaccacatctgtccgtctagagaaaaccctgtgagacacagctcctcaccatggactggacctggaggatcctcttcttggtggcagcagctacagtgcccactcccaggtgcagctggtgcagtcgtgggctgaggtgaagagccgtgggcctcagtgaaggtcctctgacaggtccttacgtggtattacaccgtttaccgcctatacggtacttactaacgttggggtacgtccgaccgtacgggtcccgtaccgttaggaaaccgaaccgtacccgtggtaacgggtaccggggtagttacggggacgttcgggggaacccgtaaacccctaacgaccgttagggttacgtacccgtaaggtaccgtttcgtccgtttaacccaacccccggtcttaccccggtaccggggtaactacgtaaccgttaccgacttacggaaaccccaaccggttaacctaccctaccgtaaacttaaaccacccggtaaccgtacctaacgtaacgaccggttaggttaacgagggtaccgtcgttacacgaacttcgacgaacgaccaccgggttctaacgtttacgttacgtcggacgtacggacggtaccaccggtacggtactccgggtacaacggttcccggtaagccggttagccggtactttcgacgtttcggaccggg

SEQ ID NO: 209642 - DNA, 735 bp, Homo sapiens
  misc_feature: GYAE6OF02F3DPP.17.25.C03.1.454.CMB.1.raw
  modified_base (480)..(480): a, c, t, g, unknown or other
  misc_feature (480)..(480): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtgcagcagctacaagtgcccactcccgaggtgcagctggtgcagtcgtggggctggaggtgaagagccgtggggcctcaggtgaacggtctcctgacaacggtcttcgtaggtacttccgtaaccgttttacctacctattacggtactacctaacgttgggtcgtccggtaccacggggtcccgtacgttacggggaaccaaacggtaccgttaggaagggttcggtaaggtacggggtacgtcgggggtacccaaaaccccgttaacaaccggttggggtactaccgaacgtaggttcgttccttaccgacccctaacttcccggtaccgggaanacggtaccttaaccgatacgaccctaacgaaaccgtttcccaccgtaaaactaaacgaacgaaccgtacccgtaactacgtacgggtgttaaggaacggtcgacctgaactaccttcgtacggaaccgacgacccggttcggtaccttacttaccgtggcgtacgtaaggccgtaaccgacggtacgttaccgggcggtacgtaaccgtcgggaccgtacgtccggttcccctttaggacccggttgtaccgggg

SEQ ID NO: 209643 - DNA, 755 bp, Homo sapiens
  misc_feature: GYAE6OF02JPF6N.17.25.C03.1.454.CMB.1.raw
  modified_base (202)..(202): a, c, t, g, unknown or other
  misc_feature (202)..(202): n is a, c, g, or t
  modified_base (209)..(209): a, c, t, g, unknown or other
  misc_feature (209)..(209): n is a, c, g, or t
  modified_base (254)..(254): a, c, t, g, unknown or other
  misc_feature (254)..(254): n is a, c, g, or t
  modified_base (275)..(275): a, c, t, g, unknown or other
  misc_feature (275)..(275): n is a, c, g, or t
  modified_base (747)..(747): a, c, t, g, unknown or other
  misc_feature (747)..(747): n is a, c, g, or t
tcagcgtagactagcacgaccggtgctcgatttagtagtgtagatttgggtttgggagtcagtctcagtcaggacacagcatggacatgagggtccccgctcagctcctgggtctcctgctactctggctcgagctgccagatgtgacatccagatgacccagtctccatccctcctgtcctgcctcgtggtggggtacagngtcaccntcacgtcgcgacaagtcacggtacgttaaaactatttaagtgtancagacaagaacgtaggaaacnccccagtacctctagactcgtactggtcgactatacccacgtcgtacggacgtacggtcggcccgttaccgacgttaccgggtaggttccgtacgggtcggtacgttacgggtacgtagtacccgggttagggaactaacgggtttaactttaccgtaaacgttaccctaccctaaccgtaacctaccccgtaacccgttcgttaccggtaccgtaaaccgtaaccgtttagggacgtttacgttaccggagttaaccctaacccttacggttaacctacgttaccgtaactaaccggtaacggtaccgtttaaacccgtccgttaccccggtaccgttaccgtttaccggtttaaccggaacccgggtaacggtaaccggttaacggtacgtaacggtaaccctaaacggttaaccggtagtttaccgggacgttaaccgaccggttacctaacccggtttgttacccgtntttacccg

SEQ ID NO: 209644 - DNA, 896 bp, Homo sapiens
  misc_feature: GYAE6OF02JWC8I.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaaggactcctcttcttggtggcagcagctaacaagtcgcccacgtcccgaggtcgcgagcgtggtcgcagtcggtggggctggaggtagaagacgccggtggggcctcgaggtaggaacggttcctaccgtggaccgtaacggtcctttgtagggtactttaccttaaccggtttaccctaccgtagttaacgtacgttaccgtaacgggttgggtaccgtccggacccgtacgggcccggtcggtaacgggaacctaacccggaaccgtgggtaacggttcgggaacgggttcggggaacggttacccgggggaaaccgtaaccccgttaaacggtaccgttcgggttaacggtaccgtaacggtaacggtttccggttaacccgttacccgtaaccccgtaccgttacccgggtaacccggggaacttaacccggtaaacccgttaaccgaccgttaaacccggaacccctaacccgggtaacccctttaacccgtaaacccgtaaacctaaacccggaaaccggtttaccaaacccgttaacgtaacgggttacggtaagggttaaccggaacgggtaccgtaccgtaacgtaacgtacggttacgtaacgggaaccgtacccgtaccggggtacctttacggttacgtttaccggacggttacggtaaccggtacggtaccgtccggaaccggttcggtaccggtagtacccgtacggccggactacgggtacccggttacgtcggttaccggttgggtaccggg

SEQ ID NO: 209645 - DNA, 649 bp, Homo sapiens
  misc_feature: GYAE6OF02FIL3F.17.25.C03.1.454.CMB.1.raw
  modified_base (304)..(304): a, c, t, g, unknown or other
  misc_feature (304)..(304): n is a, c, g, or t
  modified_base (478)..(478): a, c, t, g, unknown or other
  misc_feature (478)..(478): n is a, c, g, or t
tcagcgtagactagcacgaccggtgctcgatttagtagtgtagatttgggtttggggactcaacaaccacatctgtcctctagagaaaaaccctgtgagcacagctcctcaccatggactggacctggaggatcctcttcttggtggcagcagcctaacaagtcgcccactcccaggtgcagcgtggtgcagtcgtggggctgaggtgaagacgcgtgggcctgagtgaacggtctccgtgacgaacggtccttcgcggtattcctaccgtttaccctaccttatagtactactaaccgtgggngtcgccgacgccgcgtagacaacgccgtgaggtggagtgggtagtcggaccgtaacccgtaactagtcggtgtacacgtagtcgtaccttccgacccgtactccgaccggtacgacgtacttacctactcgacctaacgtacctccctacaaacgtaaccacacctacctaacngtaggtacgttgaacggtcgcccgttagactacgtctacgaccgacgtaccggtcttaaccgtattcgaggtcgagccgtaccgtcccaccggtaaccggtccggtacgaccggtaccggtcggaccgtcgggtaccgttacccgttttcggtccgttaccggggtccggg

SEQ ID NO: 209646 - DNA, 778 bp, Homo sapiens
  misc_feature: GYAE6OF02G4F97.17.25.C03.1.454.CMB.1.raw
  modified_base (185)..(185): a, c, t, g, unknown or other
  misc_feature (185)..(185): n is a, c, g, or t
  modified_base (202)..(202): a, c, t, g, unknown or other
  misc_feature (202)..(202): n is a, c, g, or t
  modified_base (219)..(219): a, c, t, g, unknown or other
  misc_feature (219)..(219): n is a, c, g, or t
tcagcgtagactagcacgaccggtgctcgatttagtagtgtagatttgggtttggggactcaacgaaccaacatctgtcctctagagaaaaccctgtgagcacagctcctcacctatggactggacctggacggatcctcttcttggtggcagcagctacagtgccactccaggtgcagctggtncagtctgggctgaggtnaagagccgtggggcctnaggtgaaggtcctccgtagcgaaggtccttacgtcgggtacttccgaaccgttttacctcttaacgttaggtaacttcctaaacgttcggggtacgtccgcccgtaggccgtacgtcgggtaacaaccggtacccttggaacgtttcgggtaacgttcgggggacttcggggtacccgtaaacccttaacgtaccgtgggtcgtacctacggtagtcgttacttaccgaaccctacgttccccgtaccggggtactaacggtacctttaacccgaagtttaccgaaccgaaccggtaacccttcccgtaacccgtaaactttaaaacccaccgttaacgtacccccttaaagaacgttaggggttaaccgtttacgggaacgggtaacgtccccgtaaggaccttaacttccgttaacggaaccgtaccgtaacggcccgttacttaagtttaccgtggtacgccggattaccgtcccgaaacggtcgccggttaagacccggtacccttgggaccacgggttccccggttactttacggtccctttgggaacccgggg

SEQ ID NO: 209647 - DNA, 928 bp, Homo sapiens
  misc_feature: GYAE6OF02GUCYU.17.25.C03.1.454.CMB.1.raw
  modified_base (188)..(188): a, c, t, g, unknown or other
  misc_feature (188)..(188): n is a, c, g, or t
  modified_base (195)..(195): a, c, t, g, unknown or other
  misc_feature (195)..(195): n is a, c, g, or t
  modified_base (222)..(222): a, c, t, g, unknown or other
  misc_feature (222)..(222): n is a, c, g, or t
  modified_base (272)..(272): a, c, t, g, unknown or other
  misc_feature (272)..(272): n is a, c, g, or t
  modified_base (303)..(303): a, c, t, g, unknown or other
  misc_feature (303)..(303): n is a, c, g, or t
  modified_base (313)..(313): a, c, t, g, unknown or other
  misc_feature (313)..(313): n is a, c, g, or t
tcagcgtagactagcacgaccggtgctcgatttagtagtgtagatttgggtttggggacgtcaacaaccacatctgtcctctagagaaaaccctgtgagcacagctcctccaccatggatcggacctggaggactcctcttcttggtggcagcagctacaagtcgcccactcccaggtgcagctggtncagtcgngggctgaggtgaagagccgtgggtccnacgtgaaggtcctctgcaaggtcttcgtggtacttccgtacgttttaccnccttagtaagtactactaaccgtggggttcnccggacccgngggtaccccggacgttcgggtaacccaaaaccggcccgttaggaggtagggtagttaccggggggagttacggggaacccggtaaaccccccttaacggtaaccggttcggggtttaccgacctaccggtaacgggttttcgttacccctttaccgaaccccctacgtttaccccggccccgggtaactaacgggtaaccctaccgtaagtacccgaaccgtaaccccgtaaccgtaccctttaacccgaaactttaaaacccgaaccgtaaccggtacccttaaacccgttaaacccgggtacgggttttacggtaacccgggaaaggggttacccgtaccccgtttacccgaaaacgtttaccggttacccgttaacccgggaaaccggtaccccggttaaacccgggggtacccccgttttaacgtttaaaccgtaccgttttacgggtccgtaacggggtaacccggttaccgtaaaccccgtacccggtacggttttacccggggaaccggttaaacccgccccggttaaacccggggttccggaaccgggtttacccggggttcccttttttacccggggtaccggtttaccgggtaaccccggggggg

SEQ ID NO: 209648 - DNA, 630 bp, Homo sapiens
  misc_feature: GYAE6OF02HLAO1.17.25.C03.1.454.CMB.1.raw
  modified_base (491)..(491): a, c, t, g, unknown or other
  misc_feature (491)..(491): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcgagtgaaggtctcgtgcaaggcttcgtggattcacgtttacctcctatagtatcaacgtgggtgcgccgacggccgctacgggacaacgacctggagtgggagtggggattcggggacaaacccgtaacgacgtggtcgtcaacgtaggttcgtccttccacccgtacttcccgtaccgggaactacggtacccttacgacgtccgaaccctacgaaccctcccgtaccaactaaacacacgtacctaacgagtggagttgaggacgccgtanactattcgacgtaccgaccgaccgggtccgttacgttacgttacgtcgtacggacgacgtacgtacccacggtcgtccggtagtccgacccgtaggccggacggtcccggttccgtttaccggacgttccggtccgggg

SEQ ID NO: 209649 - DNA, 1017 bp, Homo sapiens
  misc_feature: GYAE6OF02G1BID.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccacctcccaggtgcagctggtgcgagtcgtgggctggaggtgaagagccggtgggcctacgagtagacggttcctccgtgacgaaggtccttacgtaggtacttccgtaaccgttttacctaccgttaattacggtaacttacgtaacgtttcggggtacgcccgaccggtacgggtacccgtacggttaccgggaaacctaaacccggtaaccccggtaggtaacggggttgggtacggtttacggggggaacgggttccgggggtaaccccggtaaaacccccggttaaaccgtaccgggttcgggttaggtacccgtaaccgtaacggggtttcggtaccctttaaccccgggtaaccccgttaaccggttccccccgggttaacgggggtaaacccaaccgttaaacccgtttaacccgtacgtaacccggtaccgtaaaccccgttaaacccctttaccccgtaaacccttaaaacccttaaaacccgtaaaccgtaacccggtaaccccttaacggtaaaccggttacgggttaaacgggttacggtaacccggggaaccggttaacccggtaacgtaacccgttaaacgtttacccggaaaacgggtaccccgggtaaaccgtacccggggttaaccccgttttacccggtttaaaccgttttaacccggttacgggttaaccggtaaccgggttacggtaaccccggttaaccccgtaaccggttacccggtaacccgggggttactaaaccccgggtacccgtaccgggttaacccggtacgggttacccccgggtttaccccgtttttacgggacccgggttttacgggttacccccgggggg

SEQ ID NO: 209650 - DNA, 590 bp, Homo sapiens
  misc_feature: GYAE6OF02GNNXK.17.25.C03.1.454.CMB.1.raw
  modified_base (284)..(284): a, c, t, g, unknown or other
  misc_feature (284)..(284): n is a, c, g, or t
  modified_base (310)..(310): a, c, t, g, unknown or other
  misc_feature (310)..(310): n is a, c, g, or t
  modified_base (411)..(411): a, c, t, g, unknown or other
  misc_feature (411)..(411): n is a, c, g, or t
  modified_base (431)..(431): a, c, t, g, unknown or other
  misc_feature (431)..(431): n is a, c, g, or t
tcagcgtagactagcacgaccggtgctcgatttagtagtgtagatttgggtttgggggagtcagtctcagtcaggacacagcatggacatgagggtcccgctcagctcctggggctcctgctactctggctccgagctgccagatgtgacatccagatgacccagtctccatcctcctgtctgcctcgtggtgggggtcagacgtcaccatctacttgccggacaagtcaacggtacgttaaaacctatttaaattggtatcagacaagaaacctaggaaaacnccccaagacctcctagatctctggtncactccactctacgcggtaaggtcggccgtcccagtcgaaggttcaggtcgacagtggatcgtagggactagtattacaatctacactactacactactcngactacgtagagtagttgtnactactactactactatacaactagtacgttacgaccgttccgtcgtacttacgtttacggaccgtaacgggtaaccgtaagtaggtaacgtaacgtaacgtaaaccgtaacgttaggtacggtacgtacgtaccgtaccttacgtacttcgttacccg

SEQ ID NO: 209651 - DNA, 778 bp, Homo sapiens
  misc_feature: GYAE6OF02JT1BT.17.25.C03.1.454.CMB.1.raw
  modified_base (135)..(135): a, c, t, g, unknown or other
  misc_feature (135)..(135): n is a, c, g, or t
  modified_base (176)..(176): a, c, t, g, unknown or other
  misc_feature (176)..(176): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggagatcctnttcttggtggcagcagctacagtcgcccactcccgaggtcncagtctggcgctaggtcgtgggctggagtaggaacgacggtccgtaggggtcctacgaggttacggaacggttcctccgtacgaccgaagggttccttacgtaggtactttaccgtaaccgttttaccctacctaagttagtaactccgtaacggttgggtcgccggtccacgggtcgacgtggaacctaccgcgtaggtacggtacggaggtacggggtacgttccggggaaccaaacccgttagtaccggtggtaccgtaacgtacgtacgttccgttaccctaccccggtacccgaaccgttcccggtacgggaaacttccgtaaaccgttcaacggtaaccgaccgtaaccgtaaaccctccgtaacaaacgtaaaccgacgtaaccgtaccttagaacggttaggtaacgttacgggacgtacgtaccgttacgactacgttaccgtaacgaccgaaccgtcccggtacgttactaactcgggtacggcgaacgtaccggtaccgtacctacggttcccggttaggacccggtacggaccgtaacgggccgtaccggttaccgtttaacccggtacggtcccggttaggtacccggg

SEQ ID NO: 209652 - DNA, 710 bp, Homo sapiens
  misc_feature: GYAE6OF02FTFOM.17.25.C03.1.454.CMB.1.raw
tcagcgtagactagcacgaccggtgctcgatttagtagtgtagatttgggtttggggactcaacaaccacatctgtcctctagagaaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcgaaggcttcgtggtattcgacgtttacctcctatagtatcaacgttgggtgcgccaggcccgcgtggaccaacggaccctggaggtggagtggggagtcggggaccgtaaaccccgtaacgacgtgggttagtccgacgagttcgttccttacccgaccccacgttccccgtaccggggaacctacgtaacccttacccaacgtacgaacccgaaccgtaaacccgtcccctacctaaacgtaaaaccacccgaacgtaccctaaaccgagttacgggagtttaggaacggtacggcccgtagaacctactccggtacgaccggtaaccgaccgggtccttaccgttacttaacgtcgttcggtaccacggtaccgtaccccgacggtaaccgtcccgggtacggaccgtaccccggttaacgggccgaccgggttacccggtaccgttttcggacccgtttcgggtacccgggg

SEQ ID NO: 209653 - DNA, 760 bp, Homo sapiens
  misc_feature: GYAE6OF02IUXDQ.17.25.C03.1.454.CMB.1.raw
  modified_base (650)..(650): a, c, t, g, unknown or other
  misc_feature (650)..(650): n is a, c, g, or t
tcagcgtagactagcacgaccggtgctcgatttagtagtgtagattttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagccgtgggcctgaggtgaaggtcctccgtgacaaggtcttcgtggtacttcgtaccgtttacctacttataagttaataccgtaacggtggggtcgacccggaccgacgggcccgtacggtacgggaaccgtaaccggtaccgtggaaggttcgggaaggttcggggagtaccggggtaaccgtaaaccccgtaacgtcggttagggtcgtaccgaacgtaggtttacggtacccttaaccgtacccgtaaccgttcccggtaaccgggaccaaacgtaccttaaccacgtacggaaccctaaccgtaaccctcccgtaacaaaactaacaactacgaccctaagaggtagggtaaggttaggacggacgtaccgtagaacctaagttccgaacggtaaccgtaacccgaccgggttaccctttagtaaccgttttaacggnggttaccggacgtaggttacccgacccgtaacggtcgttacccgggagtaccggtaccggtacggaccgtaccgggtcccgtttcgttacggtacggttcggaccggggg

SEQ ID NO: 209654 - DNA, 714 bp, Homo sapiens
  misc_feature: GYAE6OF02FUP3J.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaacgcgtcggggcctcgagtaggaaggtctcctgcaaggtcttcgtggattctaccgtttacctcctattagtatacaacgtgggtcgcgccgacggccgcgtacggaaccaaccgtaccgtaggaggtggaagtgggtacgtgggacccgtaaccctaacgacgtgggtcgtacaacgtaggttcgttcctttaccgaacccctacggttacccgacgggtaacctacgtaacctacctacgtaccgaacccgaaccgtaacctacccttaaccaaacttaaaccaacgtacaaccctaacgtagtacggaagtttacggaacgggtacaccgtagtacctattaccggtaacgaccggtaaccggtacccgttaccgttacctttaacgttacgttcggtacgacgggtaacgtcccggacccgtaggtaccggtacccggtacgaccggtaccgtacccggtggaccggtccggttccgtttacgtccggtttccggtaccggggg

SEQ ID NO: 209655 - DNA, 961 bp, Homo sapiens
  misc_feature: GYAE6OF02HTJP2.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctgctccgagctgccagatgtgacatccagatgaccctagtctccatcccgtcccttgtctcgccttcgtggtcgggggtacagtacgtaccgaccaactcctacgttcggacccggaactaacggtaccgaaccgggtaaccgtttaaaaaacctttaagtttttaaaacgttggttaactaccgtaaacgaaccgtaaacggtaaaaacccgttaaggggaaaaaacccgcccccgtaaacggtaaccccccctttccgttaacggtaaccttttccccgtttacgttacgggggttacctacccgttaaaccgtttacccccgtaactttacccgggtacggttaaaccgggtaaacggggttcccgggttaccccccggttaaccccgtaacgggtttcccgggttaaaacggggtttttaccgtaacgggggtttccggggaacgtttaaacgggggttacggtttaaacccgtttccgggggtttaaaccgggaaacgtttttaacgggttaaccttttttaaacccgtaaaccgtttacccgtaacccgttaaaccctaaacgttaacccccgttaacccttaacccgtttacgaaccggtaaacccgttaaccgtaaggggacggtttaggtttacgtacgttaaacttaaccgttacttaaccgttaccgttacggtaaaccagttaaaccggttaccgttaccgttacccgttcccgtacgttaccttacggtttaccggacgtaacgggttaactacggtagtacgtaacgtaaccggtaaacgtcggtacgtccggactagacctacgtcgttacgtacgttacc

SEQ ID NO: 209656 - DNA, 818 bp, Homo sapiens
  misc_feature: GYAE6OF02HXEBJ.17.25.C03.1.454.CMB.1.raw
  modified_base (317)..(317): a, c, t, g, unknown or other
  misc_feature (317)..(317): n is a, c, g, or t
  modified_base (683)..(683): a, c, t, g, unknown or other
  misc_feature (683)..(683): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtcgcagcgtggtgcaggtcgtggggctaggaggtagaagacgccgtcggggcctcgagtgtaaggtctccgtgacaggtccgttcgtggtacttctaccgttttaccctaccttaatacgtactaccgtaacgttggggtacnccggaccgacgggcccgtacgttacgggaacccgaaaccggtacccgttgggtaacggttagggtaacggtacgggggtacggtacgggggaaccccgtaaaaccccgttaaacggaccggttcggggtacgttaccgaacgttacggttttccggttccctttacccaaccccgtacgtttccccgggtaccggggtaaccgttaaccgttaaccgtacgtaccggaacccctaaccgtaaaccccttcccgtaaccaaaaccttaaacccgaccgtacctaacctaactaggtaccggtaagttcggaaacgggccttaccgtacgacgtacgttcgtaacgaccggtaccgaccggtaccgtnttaaccgttaccgtggtagaccggtaacgaccgttacccgaagggtcccgttccgggttaacgaccggtaaccggccggtacgtaaccgggtcccgttacgtttaccggtccggtttccggggacggtacccggg

SEQ ID NO: 209657 - DNA, 619 bp, Homo sapiens
  misc_feature: GYAE6OF02F5Z8V.17.25.C03.1.454.CMB.1.raw
  modified_base (281)..(281): a, c, t, g, unknown or other
  misc_feature (281)..(281): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcgagtgaaggtctcctgcaaggcttctggattcacgtttacctctatagtatcaacgtgggtncgccaggccgctggacaacgacctgagtggatggggatgggacgaaaccctaacacgtgggtagtcacgagttgtacttcaacccattcccgtaccgggaactacgtacttaaccagtacgaccaacgaaccttccgtaccaataaaaccacgacgtcctaacagtggtagttaggaggacgtacctgactaagtctagaaccgtacaccgggtccttacgttagtttacctggtagtacggaacgtacgtacccgacggtacgttacccgggagtaccggaccgttaccggacgtcgggtacccggttccgttttacgaccgtttcggtaccggggg

SEQ ID NO: 209658 - DNA, 755 bp, Homo sapiens
  misc_feature: GYAE6OF02GJBYV.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgtagtcgtggggctgaggtgaagaacgccgtggggcctcgagtaggaacggttctccgtgaccgaaggtcttcgtggtacttcgtaaccgttttacctaccttaagttacgtactctaaacgttcgggtacgccgaccgacgggccccgtcgtacgggaacctaaccggtaccgtaggacgttagggacgtaggggacgtcggggaaccctaaacccgtaacgtaacgtggtcgtccacgtacgtcgttccgttaccaccctacgtccccggttaccggaaccgtaaccgtacctttaacccagtaccgaacccgaacgtaacccttaccccgtactaaataaaacccacgtaacgtaccctacgtagttacgggttagttacgggaacgtaccgtaccgtagtaacctagtccgtaacggaccggaacccgtaccgggtccttaacgttacgtttaccgtcgggttaacgacggtaacgtacccggtacccgagttacccggcccggtaagaccggtaccgtacggaccgacgtcccggtaccgtttacggtacgttccggaggtacccgg

SEQ ID NO: 209659 - DNA, 837 bp, Homo sapiens
  misc_feature: GYAE6OF02HGFD4.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactccaggtgcagctgtgcagtctggggctgaggtgaagacgccgtcgggcctcagtgaaggtcctcctgcaaggtcttgaggtattcctacgtttacctacctattagtactacaacgtggtcgcgccgaggccgcgtcggaacctaacgaccgtggaggtcggagtcgggaatcggggacctaaacccgtacgacgttggtacgtacctaacgtacggtttcggttacctttacccgaaccccttaccggttaccccggtacccggggtaacaacccggttaacccgtttaacccaagttcccggtaaaccccgtaacccgtaacccgttaaccccgttaaccccgaaaactaaaacccctaaccggtaacccttaaccttaaccggtaacggttaagggttaacggttaacggaaaccgggttaccggtacccttaacgggtaacccttacggttacccgttacggggaaacccgtaaccggttaccccggttacccgtttaacgtttccgttttaaacgcggttaacggtacccgggtaaccggtaccgttaaccccgtaaggttacccggtacccgggttaggtaccccggttaaccggtacccggtccggttaacccgggtccgggttaaccccgttttcggttaccggttcccggtacccgggggg

SEQ ID NO: 209660 - DNA, 712 bp, Homo sapiens
  misc_feature: GYAE6OF02FOMYI.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactccccaggtgcagctggtgcagtctggggctgaggtgaagaagcctgggcctcagtgaaggtctcctgcaaggcttcgtggaggcaccttcagcgacattagtttccaattgggtgcgacggcctcgtaggacaaggccttgagtcggatgggaagatcgtcctatcgtagacacaccaaactcgcacagacgttccgagggtacagtacctacgaaccaacgtaacccggaccgtaactaaacgttaaaccgaaaccgtaacctaaggttaaacttaccggtacggtaacgtaccgttacggaaacctacggtacccgttacggtacagtttaccgaggtaacgggaaccggtacgggtaccctttacgttacccgtttacgttcggttcggtaccgggaaggttaaccggttaaactttaaccggtaaacttaaaccgttaaccgtacggtaacccttttacccttttttaaaccgtaccccttttacccggttttacggttacccgtttacccggtttaccggggaccccgtttaaacccggg

SEQ ID NO: 209661 - DNA, 652 bp, Homo sapiens
  misc_feature: GYAE6OF02HRZXK.17.25.C03.1.454.CMB.1.raw
  modified_base (542)..(542): a, c, t, g, unknown or other
  misc_feature (542)..(542): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatctcttcttggtggcagcagctacagtgcccactcccaggtgcagcgtggtgcagtcgtgggctggaggtgaagaacgccgtgggcctcgaggtgaacggtctccgtgacgtacggtcttcgtggtacttcctaaccggttttacctaccttaagttacgtaatccgaacggttcgggtcgcccgtaccgacggtccgtcgtacgggaaccaaccgtaccgtggacgtaggcggtagggacgtcggggaacctaaacccgtaagtacgtagggtctacgaacgttagtcgttcctaccgaccctacgtccgtaccggaataccgtactaccgtagtccgaacccacttacctacccgtaacaagtaaccgactaacgtactacgagtacgtacggttagacgacgctacgnacgttgaccgactacggcgttactagttactacgtgacgtacgcacctccgacggtctcggacgaccgtccgaggcctcgggtcccttcggttacgaccgttggaccggg

SEQ ID NO: 209662 - DNA, 915 bp, Homo sapiens
  misc_feature: GYAE6OF02ILJSM.17.25.C03.1.454.CMB.1.raw
  modified_base (211)..(211): a, c, t, g, unknown or other
  misc_feature (211)..(211): n is a, c, g, or t
tcagcgtagactagcacgaccggtgctcgatttagtagtgtagatttggggtttggggggagtcagtctcagtcaggacacagcatggacatgagggtccccgctcagctcctggggctcctgctactctggctcgagctgcagatgtgacatccagatgaccagtctcctactcctcctgtctcgtcctgtgggtcgggacagcgtcacntacctacgtcggaccgaacgacgtaccgaaccggttaacgttaaaaacctttaatttaacgttggtactagaacgacgtaaaaccggaaaccgtaaacggaaaaccgccccgaacgttaccccttaccgtacgtaaccgttcgtaccggttcgggtacgacctaaccgttacccgtacttccggtacggacggttaaacgggccggttacccgttacccgtacggttaccggttaacggttaccggtacggggtcgggtaacggtacggtacggttacggtacggtaagggtaacgtaagtttaccttaagtaacccttaccttaacccaccgttaacccaccttaacccctccgttaacggttaaccggaccgttaaaccggtagggtaacggttacggttacgtaacggttaccgttaaacgttaacccgttaaccttaccgttaaacgtttaaccgaaagggttaaactttaccggttaacccgtttaaccccgggtttacccttaaccggttcggttttaaaccccggggtttaacccggggtaaaccggtaaaccggggggtttaaaaccttacggggtaaaccggttttaaacggaacctaaaccccgggttaaaagggttacccgttaacggggaacgtttacccggtaaccggttaacccggaaaccccgttttgttacccgttttgttaaccccg

SEQ ID NO: 209663 - DNA, 547 bp, Homo sapiens
  misc_feature: GYAE6OF02G8R1H.17.25.C03.1.454.CMB.1.raw
  modified_base (218)..(218): a, c, t, g, unknown or other
  misc_feature (218)..(218): n is a, c, g, or t
  modified_base (511)..(512): a, c, t, g, unknown or other
  misc_feature (511)..(512): n is a, c, g, or t
  modified_base (514)..(514): a, c, t, g, unknown or other
  misc_feature (514)..(514): n is a, c, g, or t
  modified_base (516)..(538): a, c, t, g, unknown or other
  misc_feature (516)..(538): n is a, c, g, or t
  modified_base (541)..(542): a, c, t, g, unknown or other
  misc_feature (541)..(542): n is a, c, g, or t
  modified_base (544)..(547): a, c, t, g, unknown or other
  misc_feature (544)..(547): n is a, c, g, or t
tcagcgtagactagcacgaccggtgctcgatttagtagtgtagatttgggtttgggggagtcagtctcagtcaggacacagcatggacatgagggtccccgctcagctcctgggctcctgctactctggctccgagctgccagatgtgacatccagatgacccagtctcatcctcctgtctgcctctggtgggggtcagagtcaccatcactgcgtanagtcacggtacttaaaacctatttaaatggtatcagcaagaaacctgaaaacgcccagacctccgttagacttctagtaggtcgacacgttcccacttcctagggtacgaagggttcggaccgttccccgtaagttcccggtaaggtttccacgggttagggactacggtcggtaactcgggtaggggaactaggtaacttttacgaactcctacgtactactacctacctaacctccgtacgaaccctaccgtaggtaacggttactcggtagtaacctaacttaacccttnnanannnnnnnnnnnnnnnnnnnnnnnacnnannnn

SEQ ID NO: 209664 - DNA, 766 bp, Homo sapiens
  misc_feature: GYAE6OF02G2JMG.17.25.C03.1.454.CMB.1.raw
  modified_base (291)..(291): a, c, t, g, unknown or other
  misc_feature (291)..(291): n is a, c, g, or t
  modified_base (693)..(693): a, c, t, g, unknown or other
  misc_feature (693)..(693): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcgaggtagaaggtcctccgtgcaaggtcttcgtggattctacgtttacctctaatagtatcaacgtgggtncgccaggccgcgtggaaccaaccgacctggacgtggagtgggagtcgggaccaaacccgtaacgacgtggtcgtacaacgtaggttcgtaccttaccaaccccgtacgttacccggttacccgggaactaccgtaaccgttaaccacgtaccggaaccctaaaccggtaaacccttacccctaaaccaaaacttaaacccgaacccgtaaccggtaacccttaaaccgaaggttacgggtaacggtttacgggaacggttacggtaccccttaagggaaccctaagttacccgtacggaaacccggtaccgtaaccggggtcccttaaacgtttactttaacccggtgggttaccgaacggtacgtacccggtaccctaagggtaacccgttcccggggaanacccgggtaccctaacgggaccctacggggtacccggttacccttttacgggtaccgttccgggtaccggggg

SEQ ID NO: 209665 - DNA, 687 bp, Homo sapiens
  misc_feature: GYAE6OF02GRZGZ.17.25.C03.1.454.CMB.1.raw
  modified_base (256)..(256): a, c, t, g, unknown or other
  misc_feature (256)..(256): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtgcccactcccaggtgcagctggtgcagtcgtgggctggaggtgaacgaggccgtggggcctacgagtagaggtcctccgtgacgaaggtcttcgngtacttcctaccgtttacctcttactagtactactaacgtgggtcgccgccgacggccgcgtacggaaccgaacgtaccgtacggaggtggtagtggggtacggtacggaccgaaccctaagtacgtggtgaccgtacgtagttcgttcctaccgaaccctcgtaccgtaccgggactacgtacttaccagtacaacccgacgtaaccctaccctaacaaataaacccgacgaaccgtaccctaagtacggtagggtacgttacggaggctaccgtgaccgtatcgacgtaacgtaccgaccggttcgtactttaacgttcgtaggtcaaccgttaacgacgttcccgaacggttccgggtacggttaccgacgttccggtacgggcaacggttccccggtttaactccggttaccggttgggtcccgggg

SEQ ID NO: 209666 - DNA, 804 bp, Homo sapiens
  misc_feature: GYAE6OF02II1MZ.17.25.C03.1.454.CMB.1.raw
  modified_base (623)..(623): a, c, t, g, unknown or other
  misc_feature (623)..(623): n is a, c, g, or t
tcagcgtagactagcacgaccggtgctcgatttagtagtgtagatttggggtttggggagtcagtctcagtcaggacacagcatggacatgagggtccccgctcagctcgtggggctcctgctactctggctccgagctgccagatgtgacatccagatcgacccagtcctccatccctcctgtctcgtcctcgtgggtcgggggtacagacgtaccaacctacttaccgtacgttcggaccgggaaactaacggtaccgtaaaccgggttaaaccgtttaaaaacctttaattttaaaaacgtttggtaaactacgaaacgtaaccgaaacggtaaaaaccgtaacgggaaaaacccctcccccgaaacgtaccccttcgaggttactccgttcgttcggacgactaacctccctacttacggtacgggtacgtaacgggtccggtacccgtaccgtagtacggtaaggttacgagggtcggacgtaggtacggacgttcgggtacggtactaacggttactttacgaaccgttctaacgaccctatacccgtaacctacgttacgtccgtaacttaaaccgggtaggtacgttacgtacggtaccgtaaactttaaccgtnttaaaccgttctaacgtaaacctaacggttaccgtaaacggtttaccctaccccgtttcccgtaaggttacctttaaccgggttacggaaacccgggtaacggtaaccgtacggttagaaccgtacttaaaccggaagtaacgttggtacgacctcgaaccgtccttacgttcttacgtcc

SEQ ID NO: 209667 - DNA, 688 bp, Homo sapiens
  misc_feature: GYAE6OF02JA4JK.17.25.C03.1.454.CMB.1.raw
  modified_base (313)..(313): a, c, t, g, unknown or other
  misc_feature (313)..(313): n is a, c, g, or t
  modified_base (417)..(417): a, c, t, g, unknown or other
  misc_feature (417)..(417): n is a, c, g, or t
  modified_base (502)..(502): a, c, t, g, unknown or other
  misc_feature (502)..(502): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtgcagcagctacaagtcgccactccaggtgcagcgtggtgcagtcgtgggactggagtgaagacgcctcgggacctgaggtgaacggtctccgtgaccgaaggtctttcgcggtactttcctaccggttttaacctccgttaattaaggtactaccgtaacgtgggtacncggaccgtacgggtccagttacgggacctaaacgggccttaggaagtggaggtacggacgtagggaccgtaaacctaacgacgtggtactcgaaccgtggttcnccttacgtaacccacgttccggaccgggtacaacgtaacctaccgtaagctaaccgaacgtaacctcctaacaactaaaacctanaaccgacttaccgaagtcgtacgttaggacgactaccgtcaactacgttcgacgaaccgtaccgaccgggtacctaacgttacgttaacgtgtacggtacgacgtcggttaaccacgaaacggttccgaagaccggtccgtaaaggcctaaggcccgtttacccgtaggttccgtacggtcccggg

SEQ ID NO: 209668 - DNA, 589 bp, Homo sapiens
  misc_feature: GYAE6OF02IKQUA.17.25.C03.1.454.CMB.1.raw
  modified_base (289)..(289): a, c, t, g, unknown or other
  misc_feature (289)..(289): n is a, c, g, or t
  modified_base (342)..(342): a, c, t, g, unknown or other
  misc_feature (342)..(342): n is a, c, g, or t
  modified_base (419)..(419): a, c, t, g, unknown or other
  misc_feature (419)..(419): n is a, c, g, or t
  modified_base (450)..(450): a, c, t, g, unknown or other
  misc_feature (450)..(450): n is a, c, g, or t
  modified_base (454)..(454): a, c, t, g, unknown or other
  misc_feature (454)..(454): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctcagtgaaggtctcctgcaaggcttctggattcacgtttacctcctatagtatcaacgtggtgcgccaggccncgtggacaacggacctgaggtggagtgggatggggctaaaccctacacgtggngtcacagtgtccttacaccctatcccgtacgggacagtaccttaccatcgaccacgaacctccctaccaataaaccncaacgcctacagtggagttgagcgcctgacntccngaccgacgaccgccgttactacttacgtgttcgacgtacgtacgtacccgaacggtacgttacccggtagaccggtcccgttaaccgggcgtacgggcccggttccgttttacggacccgtttcggtaccggggg

SEQ ID NO: 209669 - DNA, 758 bp, Homo sapiens
  misc_feature: GYAE6OF02FOYC6.17.25.C03.1.454.CMB.1.raw
  modified_base (184)..(184): a, c, t, g, unknown or other
  misc_feature (184)..(184): n is a, c, g, or t
  modified_base (442)..(442): a, c, t, g, unknown or other
  misc_feature (442)..(442): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtgccactccaggtgacagctggtncagtcgtgggctggaggtgaagaacgccgtggggcctacgaggttgaacgggttcctctaggactaaggtcttccgtggacttctaccgttttacctactatagtactaccgaacgttgggtacacggtaccgacgggcccgacgttacggaacgaccggtaccgtaggacggttacggagttcgggggaatcggggaccgtaaacccgtaagacgtcgggttacgacctaacgtcggttcgtccttaccgtaacccncggttcccgtaccgggtactaagtaacccgtttaaccagtttaccgaacccgacgtaaacccgttcccgtaaccctaacgtaaaacccgtacaccgtacttaaccgtacgtacgggttaagttaccggaaggtacgttacccgtacgaacgtcgtaacgagaccggtacgtaccggaccggttacttaacgttaccgtacggcgtaccgacgtacggtacccacgggttaaccgtccgggtacgtaccggtaacccgttacgggacgtaaccggttccggttaaccgtttcggttaccggttagttacccgggggg

SEQ ID NO: 209670 - DNA, 835 bp, Homo sapiens
  misc_feature: GYAE6OF02G8Z1Q.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcacgcagactaacaagtcgcccaacctcccgaggtcgacagcgtggtcgcagtcggtgggctagaggtagaaagaacgcgtggggccttcgagtaggaacggttcctccggtcgaccgtaacgccgttcgtaggtactttccaaccggttttaacccttaccccttaagttaacgttacgttaaccaacggttcgggtacgccggtaccgacgggcccgcgtacggaaccaacggaccctaggaggtacggaggtggggtaagccggacgtaaaccctaaccgtacggttaggtcgtacgacgtaggttctaccttcccgtaacccctaccgttcccggtaccggacgaacgtaccctacccgtaagaacctacccgaaaccgtaccctaccctacccgtaaactaaacctaaccgtaacccgtaaccgttaacgacggttaacggtagggttaccgggaacgggttacgtcccggtaagtaaccctaacgttacttaacccgggaacgaacccggtacccggtacccggttttaacttaaccggtttacgtcggttaacgaccgtaagggtacccgttacccggtaaccggtcggttacccgggtacggtaacccggtacccggtaccgggtaccgtacccgggtaccggttacccggtttcgtaacccggtttcgggttaaccgggg

SEQ ID NO: 209671 - DNA, 626 bp, Homo sapiens
  misc_feature: GYAE6OF02ITA7U.17.25.C03.1.454.CMB.1.raw
  modified_base (244)..(244): a, c, t, g, unknown or other
  misc_feature (244)..(244): n is a, c, g, or t
  modified_base (496)..(496): a, c, t, g, unknown or other
  misc_feature (496)..(496): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagcgtgggctgagtgaagtctctgcgaaggtcttcnggtattctacgtttcctctatagtatcaacgtgggtcgcgccgacggccgcgtcggaaccaacgtaccgtgacggtggaggtgggagtacgggaccgtaaaccctaagtcgtggtcgtacgaacgtgttcgtcctaccacctacgtccgacgacacgtacttacgatcgaccactacctacctacaataaaccacgactacctacgagttacgggattacggacggtactccgtagactagtcgacggaacnccggaaccggtcccttattaacgttacgtcgaggtcaacggcccgtaccgtcggtacgtccgggtacgaccggttacccggtaacgcgttacgggacccgtttccgttcggtaccgttccgggtccgggg

SEQ ID NO: 209672 - DNA, 799 bp, Homo sapiens
  misc_feature: GYAE6OF02H4HZ2.17.25.C03.1.454.CMB.1.raw
  modified_base (188)..(188): a, c, t, g, unknown or other
  misc_feature (188)..(188): n is a, c, g, or t
  modified_base (545)..(545): a, c, t, g, unknown or other
  misc_feature (545)..(545): n is a, c, g, or t
tcagcgtagactagcacgaccggtgctcgatttagtagtgtagatttgggtttggggactcaacaaccacatctgtcctctagagaaaccctgtgagcacagctcctcaccatggactggacctggagactcctcttcgtggtgcagcagctacgagtcgccctactccgaggtgacagtcgtggtcnctacggtcgtggggctggaggtaggaacggtacgccggttacgggaccctacggtaggtaggtaacggtcctaccggtagacgtaggttcctttacgtaggtactttaccgttaccgttttaccgtaccttaagtacgttactaaccgagtcggggtacgccggtcggaacgggtccgacggttacggaaaccgaccggttaccgtagggtcggtaaggacgggtacggggtaacggtccggggaaacccctaaacccgtaacggtaccggttcggtaccgttccgaacggtagttttccgtacctacccgaacccgtacccgtccggtaaccgggactaacggttaccttaaccgngtaaccgaacccgtactaccctacctaacgtaactaacgaaccacgtaacgtaacggtagtaggttacggacggtacgtaacgaccgtacgactaacggtacgacgaacccgaacggtccgtaaccgttccttagttaccgcgtaacgggtcgtaccgttaccgacccggtagtaccggtccggtacggtacccggtaccgtacggaccgttccgggtccgtttaccggttacgttccgggttcgggaacccgg

SEQ ID NO: 209673 - DNA, 722 bp, Homo sapiens
  misc_feature: GYAE6OF02H2M0G.17.25.C03.1.454.CMB.1.raw
  modified_base (143)..(143): a, c, t, g, unknown or other
  misc_feature (143)..(143): n is a, c, g, or t
  modified_base (175)..(175): a, c, t, g, unknown or other
  misc_feature (175)..(175): n is a, c, g, or t
  modified_base (220)..(220): a, c, t, g, unknown or other
  misc_feature (220)..(220): n is a, c, g, or t
  modified_base (257)..(257): a, c, t, g, unknown or other
  misc_feature (257)..(257): n is a, c, g, or t
  modified_base (295)..(295): a, c, t, g, unknown or other
  misc_feature (295)..(295): n is a, c, g, or t
  modified_base (609)..(609): a, c, t, g, unknown or other
  misc_feature (609)..(609): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggagatcctcttcttggnggcagcagctacaagtcgcccactcccaggtncagctgtgctagtctgggctggaggtgaagacgtccgtgggcctnagtcgaaggttctacctgactaggtcttctggtattnaccgttttcctctaactagtactacgtaacgtgggtcncggtccgtaacggccgactacgggaaaccgaaccggtacctagggaggttaggggaacctggggaacggttacgggggaccctaaaaccccgtaaacgtccggtagggttacgtccaaaggtcggttacgtccgttccaaccccctagtcccgttccggggaactacggacctttacgactacgtaccctaacgaaccctttcgaaccctaagtaaaacccactaacgtcccaacgtgtaggttaacgttgggacgtaacggtccctagaacctgtacgtaccgacgtacctaccggaccttactagtttacgngttacgcggtaacgaccgtacccctacggtaaccggtccgggttacgaaacggtcccgttaacgggaccgtaacgggtccctttacggtttacgtaccgttccggtacggggg

SEQ ID NO: 209674 - DNA, 678 bp, Homo sapiens
  misc_feature: GYAE6OF02HEK7W.17.25.C03.1.454.CMB.1.raw
  modified_base (339)..(339): a, c, t, g, unknown or other
  misc_feature (339)..(339): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagacgccgtgggcctcaggtgaacggtctccgtgacgaggtcttcgtgtattcctaacgtttcctccttaatacgttactacgaacgttggggtcgcctcggacggcgccgtacggacaaccgacctggagtcggngtcggagtcggggacctaaacctacgacgtcgggtctacgaccgtgtcgtctaaccaccctctacccgtcggaactacgacttaccgactacgaccaccgtacctcctaccaactaaaccactaccgtactacgacgttacgtacggttagacggtacgtacgtacgaactacggtacgtacgtacccgttacgaccggttacccgtttacgttaacgtttaccgtcggtacgacgtaaccgggtaccctaccggtaccgtaacggttccgggaacgaccggtccgtacgggtccgaacgggttcccgtaccggtttcgttacccggtcggtcccgggg

SEQ ID NO: 209675 - DNA, 838 bp, Homo sapiens
  misc_feature: GYAE6OF02H40W7.17.25.C03.1.454.CMB.1.raw
tcagcgtagactagcacgaccggtgctcgatttagtagtgtagatttgggtttgggagtcagtctcagtcaggacacagcatggacatgaggtccccgctcagctcctgggctcctgctactctggctcgagctgccagatgtgacactccagactcgacccagtcctccactcctcctgtctgcctgtggtggggcagtacgtaccaccatccgactcgccgacaagtcgacggtaacttaaacttagtttaaagttcggtatcgaagacacgtaaaccgtacggaaaaccgccccgtaacgtacccgttctaacggtcttacccggttggtagggtaccgtacctaccgttaccctacgttacctacgggaagttaaccgggtccgttaccgtaccccgttaacggtacggttaacggtcggtaagggtcggaaccggtaggttcggtaccgtcgggtacggtagtaaacgtttcgttaacaaccgttacctacgtaaccgtactacccgacctaactttcggaacctaacccttaacggtagggtaacgtttccggttaagtacgtaaccgtttaaccgtttaaccgtaactttacccgacgtaaaacctaccggggttaaacgttaaccccggttttaaccggtaccccgtttaccccgtacgtttaacccggtttttacccggtacccgtaaaacgggggaccgggttaaaacctttaacggtcgtaacggttaaaaacccgcccggtttaaaaccggtcgggtttaccgaccggttaaacccgtccgtaaccccgttaaacggtttccgttttaccctagtttaacccccgg

SEQ ID NO: 209676 - DNA, 800 bp, Homo sapiens
  misc_feature: GYAE6OF02IBSRR.17.25.C03.1.454.CMB.1.raw
  modified_base (156)..(156): a, c, t, g, unknown or other
  misc_feature (156)..(156): n is a, c, g, or t
  modified_base (176)..(176): a, c, t, g, unknown or other
  misc_feature (176)..(176): n is a, c, g, or t
  modified_base (215)..(215): a, c, t, g, unknown or other
  misc_feature (215)..(215): n is a, c, g, or t
  modified_base (563)..(563): a, c, t, g, unknown or other
  misc_feature (563)..(563): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtgcagcagctanaagtcgcccactccgaggtncagtcgtggtgcagtcgtgggctgaggtgaagagtccgngggcctagaggtgaggtctacgtgacgaaggtcttacgtggtacttaccgtaacctttacctaccttaagtaagttactacgtaacgtgggtcgtaccggaccgaacggtccgtcggtaacggaccgtaacgacgtacggtagtaggaggtcggtaagtccggggaacctaaaccgtaacgaccggttaggttaccgaacggtaccgtaggttaccgttaccttacccgaaccccgttacgttccccggttaaccggggactaaaccggtaccctttaaaccgacgttaccgaacccaaccggtaaccctaccgtaaaccaaacgtaaacacgtaaacgtccctaaanaggttacgacggttaacgtacgtacggtaccgtaagtacaacgttactaaggtacccgaaaccgtaccggtacctaccgttagttaacccggtgggtaaccgaccgggtacggtacccgtacccgggtacggtaaacccgggttacggtaaccggtaaaccggtcccgtaaacggttacccgacgggttacccggtttacgggtttaacggtaccccggttacggggttacccgggg

SEQ ID NO: 209677 - DNA, 684 bp, Homo sapiens
  misc_feature: GYAE6OF02HEOFK.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcgagtgaaggtctcctgcaggcttctggattcacgtttacctcctatagtatcaacgtgggtgcgccaggccgctggacaacggacctgaggtggagtgggatggggaccgaaccccgtaacgaccgttgggtacgttcaaccgtagttcgtacctttccgacccctacttccccgtaccggggaaccagtaacccttaaccagttacgacccgacgtaacccgttccctaccaactaaaaccaccaacgaccttaaccagttacgggaacgtttggaacgggtactccgtacgtacacgtcgtacggaacccggacgaccgggtccgttaccttaacgtttacgtggttacggaccgtaacggtaccggtacccgtacgggtacccgttccgggtagaacccggtaccgtacccggaccggacggtccggtcccgttttcggtacccggtttcgggtaccggggg

SEQ ID NO: 209678 - DNA, 655 bp, Homo sapiens
  misc_feature: GYAE6OF02IXT1L.17.25.C03.1.454.CMB.1.raw
  modified_base (161)..(161): a, c, t, g, unknown or other
  misc_feature (161)..(161): n is a, c, g, or t
  modified_base (199)..(199): a, c, t, g, unknown or other
  misc_feature (199)..(199): n is a, c, g, or t
  modified_base (329)..(329): a, c, t, g, unknown or other
  misc_feature (329)..(329): n is a, c, g, or t
  modified_base (449)..(449): a, c, t, g, unknown or other
  misc_feature (449)..(449): n is a, c, g, or t
  modified_base (531)..(531): a, c, t, g, unknown or other
  misc_feature (531)..(531): n is a, c, g, or t
  modified_base (575)..(575): a, c, t, g, unknown or other
  misc_feature (575)..(575): n is a, c, g, or t
  modified_base (611)..(611): a, c, t, g, unknown or other
  misc_feature (611)..(611): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttgggtggcagcagctacaagngtcccactcccaggtgcagctggtgcagcgtgggctgnggtgaagaagcctgggcctcgagtgaaggtctccgtgacgagtctctggattctacgtttacctacgttatacgtactcgaaccgtggtgaccggtcccaggtccgccgttggaacccaaccggtaccgngtagggtaggaacgttggggaacgttcgggacccgtaaccctaaacgccgttgggtacgtacgacgtaggttacttccttacccgaccctaacgtcccgtaccggaatacgtaccctacngtacgaccgaccgtaacctccgtacccaactaaaccaccgtacgaccctaacgactaggtacgttaagtaggaccggttacncgtaactcgtacgtcaacgacgtccgccttagttacctagtcgngacgagtaccgacctaggtacctccggttacggacnccgtacggacgacgggttcgtcctagttcccgttggtacccggg

SEQ ID NO: 209679 - DNA, 729 bp, Homo sapiens
  misc_feature: GYAE6OF02GCM74.17.25.C03.1.454.CMB.1.raw
  modified_base (312)..(312): a, c, t, g, unknown or other
  misc_feature (312)..(312): n is a, c, g, or t
  modified_base (504)..(504): a, c, t, g, unknown or other
  misc_feature (504)..(504): n is a, c, g, or t
  modified_base (574)..(574): a, c, t, g, unknown or other
  misc_feature (574)..(574): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagacgcgtcggggcctcgagtagaacggtcctccgtgcgaaggtccttcgtaggtacttccgtaccgttttacccgtcttagttagtactacgaacgtggggtacnccgaccgtacggcccgtcggtacggaccgaacgtaccgttggtacggtggaggtgggagtacgggacctaaaccgtaacgtagtcggtctacgagacgttctacctccgaaccctcgtcccggtaccggtaacgtacgtaccttaacgtcaccgaaccctacgtaaccctccctaacaaacctaacgaaccncgtaaccttacgagttgggtaacgttacggacgtacgtccctaggaacctactccggtaagaaccccggngttaacccgggcctttaagtttaccttcggttaggaccgtacgggtacctccggttaacccgaacgtacggttcccggtacggtacccgaccggttcgacccgggtaccggttcccggttacggttttaccggccgggttaccggggtaccgggg

SEQ ID NO: 209680 - DNA, 772 bp, Homo sapiens
  misc_feature: GYAE6OF02JAH4T.17.25.C03.1.454.CMB.1.raw
tcagcgtagactagcacgaccggtgctcgatttagtagtgtagatttgggtttggggggagtcagtctcagtcaggacacagcatggacatgagggtccccgctcagctccgtgggctcctgctactctggctccgagctgccagatgtgacatccgagatgacccagtctccatccctcctgtctcgtcctcgtggtgggggtacaggagtccaaccgtatcgaacttcggaccggaacgaacgttccgaaccgggtaccgtttaaaaaccttattttaaaagttggtaactccgaaggacaacggtaaaaccgtaacgggaaaaaccgccccctaaggtaccccttaccgtaggtacttccgtacgtggttacgactactaccgtaacttcgtacggtacggtaacggttccgggtacccgtaccccgtaaggttccggtaaggtttaccgagggttacgggacgttacgggtacgggtagttaccggtagggaactaaggttaaacgttttaccgaaactttccgtaaccacccgtaacgttcccgaacctaaccgttcgtacgtaaccgtaacgttagggacgtagttacgtacgtacttaaaccgttactacgttacgacgtacgaaacgtacgtaacgtttacccgtaccgttcccgtaatccgtttaacgttcgaaaccggtggtaaaccgtagttcggaaacgtgtaaaccgtaacgtacgtgtacggacgtacgtaccaaccgttacgttcgtacgtttaccg

SEQ ID NO: 209681 - DNA, 917 bp, Homo sapiens
  misc_feature: GYAE6OF02IUVL0.17.25.C03.1.454.CMB.1.raw
  modified_base (188)..(188): a, c, t, g, unknown or other
  misc_feature (188)..(188): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgccngtcgtgggctgaggtagaagaacgtccgtggggccttcgagtacggaaacggttcctccgtgcgaaaggtccttacgtacggtattaccgtaccgtttacctactacgttagtactactaacgtgggtcgcgtccgacggtccgcgtacggaaccgtaaccggtaaccgtggtaacggtcggtaacggtacggggtaagtacggggaacccgtaaaacccgttaacccggtaacgttcggggttacgtaccgtaaccgtacggtttaccgttaccgtttacccggtaaccctaacccggttcccggttaaccccggggtaaaccgtaacccggttaaacccgttacccgtaacgttaaccggtaaccccgtaaaccccggttaacctttacccctaaccccggtaaaaacttaaacccgaacccgttacgtaaccccgtagacccgttaagggttacggttaacggtacgggacgtaccgtaccgttacggactaacggttccaacccgggaacgttaaccccggacccggggttttaacaaccggtttttaccgttacggaacccgaggggttaacccgaccggtttaccccgggtaaaccccgtacgggtttccggggtttaacccctaacccgggaacccgtttttacccccggggaaacggttcccggtacccggggttaccccgttttcgggttaacccggttcgggtttaaacccccgggggg

SEQ ID NO: 209682 - DNA, 708 bp, Homo sapiens
  misc_feature: GYAE6OF02JIIJ8.17.25.C03.1.454.CMB.1.raw
  modified_base (194)..(194): a, c, t, g, unknown or other
  misc_feature (194)..(194): n is a, c, g, or t
  modified_base (204)..(204): a, c, t, g, unknown or other
  misc_feature (204)..(204): n is a, c, g, or t
  modified_base (257)..(257): a, c, t, g, unknown or other
  misc_feature (257)..(257): n is a, c, g, or t
  modified_base (537)..(537): a, c, t, g, unknown or other
  misc_feature (537)..(537): n is a, c, g, or t
  modified_base (560)..(560): a, c, t, g, unknown or other
  misc_feature (560)..(560): n is a, c, g, or t
tcagcgtagactagcacgaccggtgctcgatttagtagtgtagatttgggtttgggggtaggtcgagtctcagtcaggacacagcatggacatgacgggtcccggctcagctcctcgggctcctgctactctggctcgagctcgccagatgtgacatccagatcgacccagtctcactcctcctgtctcgcctntgtggggtcngagtcacatcactgaccggacaagtcgacgtacgttaaaactattaaatgtancagactaagtaaacctggaaaacgccccaagacccgtctacacgtactccgttaggtcgacacgtcctaaccgtcttacggacgtacggtacgggtcctacccgtaagtccggaaagtttcgaacggttcggacgtaggttcggaacttcggttaggggactaagttacttttaaccgaatttccgaccttaaccaccggttacaaccccgtattcggtacacccgtaacgttaggaacgtacgtttgggtcctaactaagttcctaacgttatccgtanaaccggtaaatcccgttttaacncccggttacctcccgttacgttagttttacccgggacccgtaaggggtaacctagggttcaaacgtaacgtttaccgaaaacggttaaccggttcgggttaacgtcccgggttaacaccgttaaaccctcgttacggttacttcccgg

SEQ ID NO: 209683 - DNA, 647 bp, Homo sapiens
  misc_feature: GYAE6OF02GERPT.17.25.C03.1.454.CMB.1.raw
  modified_base (284)..(284): a, c, t, g, unknown or other
  misc_feature (284)..(284): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagccgtggggcctcgagtgaaggtcctctgacaaggcttctggattcacgtttacctcctatagtatacaacgtgggtnccgccaggccgctggacaacgcctggagtggagtggggatgggaccgaaacctaacacgtggtcgtacacgtacgttgtccttaccaccctactcccgtccgggaacacgtaccttaccgactacgaaccacgtaacctcctaccaataaaccactacgaccctagactggagttgagtacgcctagacatcgtagaaccgtagtacccggtaccgttacttacgtttacgtggtacgaccgtaacggtaccgtaccccgaacggtaccggttcccgggtaggtaacccggtccccgttaacgggccgtaacgggttaccccggttaccgttttcggttaccccggtttggtaccccgggggg

SEQ ID NO: 209684 - DNA, 841 bp, Homo sapiens
  misc_feature: GYAE6OF02JMEW2.17.25.C03.1.454.CMB.1.raw
  modified_base (242)..(242): a, c, t, g, unknown or other
  misc_feature (242)..(242): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatccttcttcttggtggcagcagctacaagtgccactcccaggtgcagctggtgcagtcgtgggctgaggtgaagagctgggctcagtgagtctctgcaggctctgacttcncgtttactccgtatagtactacgacgtgggtcgccgtccaggcccgtcgtacggaacaacgacccgtgagtgggcgtagggcgtggggccgaaacccgtaactaccgtgggtagtccacgaagttcgttcgttaccaccccgaattcccggtaccggggtaacgtaaccgaaccgttttaaccacgttcgtaacccgtaaccgggtaaacccttccccgtttacccgtaaactaaaaacccgtaaccgtaaccggtacccccgttaaacgttaaccggtacgggtaaacggggttttacgggttaaccggggaacggttaaccccggttaacggggtaacctaaacgttccggtttaaaccggaaccggtaacccgtaaccgggggttaccccgttacggttttaaaccctttaccggttaccggtttagggaaccggggtacggtaaccccgggttacccccgtaacccgggtaacccggtttccggggtacgtaaccccggtaccccgggttaaccgggtacccggtaccgggttacccccgggggtttacccttttcccgggtttaccggttttacccggtttaaccccggggggg

SEQ ID NO: 209685 - DNA, 743 bp, Homo sapiens
  misc_feature: GYAE6OF02G74EY.17.25.C03.1.454.CMB.1.raw
tcagcgtagactagcacgaccggtgctcgatttagtagtgtagatttgggtttggggactcaacaaccacatctgtcctctagagaaaaccctgtgagcacagctccctcaccatcggactggacctggaggatcctcttcttggtggcagcagctacaagtcgcccactcccaggtgcagcgtggtgcagtcgtgggcgtggaggtgaagagccgtggggcctcgagtagtaacgggttcctccgtgacgtaggtccttcgtaggtacttcctaccgttttacctccttaagttaacgttactaccgtaacgttggggtcgccggcccgacggcccgtcgtacggaaccgaaccggaccgtggacggtggagtaggggacgtccggggaaccgtaaccgtaacgacgttacgggtcgtacgacgtacggttccgttaccttacccaacccgtaccgtcccggtacccgggactaaccgtaccgtacctaacgaccgaacccgaaccgtaccctccctaaccgaaactaaccgaacccacgtaacccgtacgtacggttacggtacgttggaaccgggctaccgtacgaacgtacgttaccgagaaccggaccgtaccggtccttaacttaacgttcgtagtcggacgacgttacccgtcccaaggttcccggtacgaggtacccgaccggttacgaccgttccgggaccggtttcccgttacggtaccgttccgggtacggg

SEQ ID NO: 209686 - DNA, 688 bp, Homo sapiens
  misc_feature: GYAE6OF02JI9FD.17.25.C03.1.454.CMB.1.raw
  modified_base (300)..(300): a, c, t, g, unknown or other
  misc_feature (300)..(300): n is a, c, g, or t
  modified_base (468)..(468): a, c, t, g, unknown or other
  misc_feature (468)..(468): n is a, c, g, or t
  modified_base (510)..(510): a, c, t, g, unknown or other
  misc_feature (510)..(510): n is a, c, g, or t
  modified_base (516)..(516): a, c, t, g, unknown or other
  misc_feature (516)..(516): n is a, c, g, or t
tcagcgtagactagcacgaccggtgctcgatttagtagtgtagatttgggtttggggacgtcaacaaccacatctgtcctctagagaaaaccctgtgatcacagctcctcaccatggactggacctggaggatctcttcttggtgcagcagctacaagtgcccactcccaggtgcagctggtgcagtcgtgggctgaggtgaagaacgccgtaggggcctcgagtgaaggtcctccgtgctaaggccttgtcggtattctacgtttaaccctccttacgtagtatccgtaaactggggtntccgccgaaggccgctcggaacaaccggacctggagtcggatggggaattcggggaccgaacccttaaacgcgttaggtcgtacaacctaggttcgtccttaccacccactcccgtacgggaacacgtacctacgatacgaccaccgtaacctcctactaacaaaccncaaccgtaccttagactagggtacgttaggacgactacccgngtaacncgttaccgtaggaacccgaacgtcccgggtaccttactttacgttacctagtcggaacgttaacggtccgtaaccccggttacgtaaacgggtccctagggtaaccccgtacccgttacgggacccgtaaggcccggtttacccgtttcggtacggtttcccgacggggggg

SEQ ID NO: 209687 - DNA, 907 bp, Homo sapiens
  misc_feature: GYAE6OF02F2MS8.17.25.C03.1.454.CMB.1.raw
  modified_base (243)..(243): a, c, t, g, unknown or other
  misc_feature (243)..(243): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagactacaagtcgcccactcccgaggtgcagctggtgctagtcgtgggctgaggtagaagaggcgcggggcctcaggtgaacggttcctccgngacgacggtcttcgaggtcttaccgttaccgttaccctacgttatacggtaacttacgtaacggtcgggtcgccggtaccggaccgggtccgtacggtaccggaaaccgtaacccggtccggtacgggtagggtacgggtagggtcgggggtaacggtacggggaaccccgtaaaaccccgttaacggtaacgttcgggttacgtacgtaacgttacggtttaccgttccgttaaccgtaacccctaaccggttacccggtaaccggggaccttaaaccggttaacccgtaaccgtaccgtaaccgtacccgtaaaccggtaacccgttaaccctaaaccgtaaactaaaccgtacccgaaccgtacccttaaccgtaaggtacgggttaaccggtaaggtaaccgggtccgtaaccggtaaccgtaccgtaaccgttaccgtagggtaaaacccggtccgggttacccggtaaaccggtttccttaaaccggtttacggaccgggtttaaacgggaccggtaaccgtttaacccgggttaccggaacccggtttaaccggggtacccgggttaacggtccccgggttaaccggacggtaacccgggtcccggttttaaccggggttcccttaaccggttcccggttacggggtaacccggggg

SEQ ID NO: 209688 - DNA, 1098 bp, Homo sapiens
  misc_feature: GYAE6OF02G014D.17.25.C03.1.454.CMB.1.raw
  modified_base (236)..(236): a, c, t, g, unknown or other
  misc_feature (236)..(236): n is a, c, g, or t
tcagcgtagactagcacgaccggtgctcgatttagtagtgtagatttgggtttggggactcaacaaccacatctgtcctctagagaaaccctgtgagcacagctcctcaccatggactggacctggaggatcctcttcttggtggcagcagctacagtcgcccactccaggtgcagctggtgcagtcgtgggctggaggtgaagacgccgtggggcctcgagtagacggtcctcgnggaccaggtccttcgtaggtactttccgtaaccgttttcctccttaagttaacgttacctacgtaacggttcgggggtcgcccggaccgtacgggtccccgaggttaccgggaaaccgtaacccggtaccgttaaggggtacgggttaacggggtacggtacggggggttaaccgtccgggggtaaaccccgtaaaccccgttaacgtaccgggtttcgggtaccgttaccgtaaacggtccgggtttccgtttaaccccgtttaccccggaaaaccccttccgggttacccccgggttaacccgggggtaaaaccttaacccggggttaaaaccccttttacccggaaaccttttacccgggtaaaacccccgtaaccccggttaaacccggttttcccccctaaaaccgttaaaaccccgtaaaccccgttaaacccggtaaacccgttaacccccgtaaacggttaaccggggtttacggttaaacgggttacgggtaaaccgggtaccggttacccgtaaccgtaaacccgttaacccggtttaccggtaaccgggtaaacccccggggtaacccggtttaaccccgggtaaccccgtttttaaccgttttaacccggtttaacgggtttacccgggttaaaccgggtaaccccgggttaaacccgggttacccccggtttaacccccgggtaacggtttaaccccccggggtttaccgggggggttaaaccttacccccgggggaacccccggttttaaccggggaccccgggtttaaccgggttccccccgggttttaaccccgggtttttagggttaccccccgggttttaacccgggggtaacccccggggggg

SEQ ID NO: 209689 - DNA, 863 bp, Homo sapiens
  misc_feature: GYAE6OF02J2D75.17.25.C03.1.454.CMB.1.raw
  modified_base (244)..(244): a, c, t, g, unknown or other
  misc_feature (244)..(244): n is a, c, g, or t
  modified_base (262)..(262): a, c, t, g, unknown or other
  misc_feature (262)..(262): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggaactcctcgttcgttggtggcagcagctacaacgtacccactccgaggtgcagcgtggtgcaggtcgtggggctggaggtagaaggacgccgtgggcctgaggtcgacgttccnccgtgcgtaggtcttcgnggtacttccgtaccgtttacctcttagtacgtactaccgaacggttgggtccgccgaccgacgggtccctacggtacggaaccgtaaccggtccgttaggacggttagggacggttacggggaagttcccggggaaacccttaaaccccgtaagtacccggttaggttccgaaccgtaacgtcggtttaccgttacccgtacccgaaccgttacccggttacccggttacgggaaacctaaccgttaacccttaacccggaacgtcccgggtaaaccctaacccggttaacttacccccgaaactaaaacgtaaacccgaccgttaacgtaccctaggttacggtaggttagttaaccgggaacgtacccgtacgtaacgaccgtactaccgggtaccgtaaacccggggtaccgtacccggttacctttaaggttcccgtttaggtaccgggtcgaaaccgggttaacccgtacccgtacccggtaacgtttcccgggtaacggtacccggtacgttaacccgggaccggttccgggttaccggtacccggtttaccggtttaaccggttccgggtaccgggggtcccgggtaaccgggg

SEQ ID NO: 209690 - DNA, 743 bp, Homo sapiens
  misc_feature: GYAE6OF02GAAOA.17.25.C03.1.454.CMB.1.raw
  modified_base (219)..(219): a, c, t, g, unknown or other
  misc_feature (219)..(219): n is a, c, g, or t
  modified_base (287)..(287): a, c, t, g, unknown or other
  misc_feature (287)..(287): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctggaggtgaagagccgtggggcctnagtgaaggtctcctgcgaaggcttctggattctacgtttacctccttatacgtatacaacgttgggtnccgccgaggcccgtcgtacggaccaaaccggcctggaggtcggaacgtggggacgtcggggaccgaaacccctaacgacgttgggtaccgtacgtacgtagttccggttaccttacccgaaccccgtacgttccccggtaccggggaaccctaaacgttacccgtttaaccacgttacgaacccgtaaccgtaaccctaccccgttaaccctaaactaaaacccgaccgaaccgtaccctaaccgtacgttcgggtaacggtttaggaacgggtaccgtcccgttaaggacctactacgtaccgaacggcccggtacggtccgttaacgttacgttacgtaggtcgacgtacgacccgttacccgtaacggtaccggtaccgggttcgaacccggtccggtaaccggcctacggggtcccgttaccggtttcggtaccggtttcgggtaccggggg

SEQ ID NO: 209691 - DNA, 809 bp, Homo sapiens
  misc_feature: GYAE6OF02IR3VR.17.25.C03.1.454.CMB.1.raw
  modified_base (155)..(155): a, c, t, g, unknown or other
  misc_feature (155)..(155): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtgcagcagctanaagtgcccactcccaggtgcagctggtgcgagtcgtgggctggaggtagaagacgccgtggggccctgagtggaaggtctcctggactaacggctttcgtggtattaccgtaccgttttaccctaccttaagtagttacaccgtaacggttgggtcgccggcccgaaggggtcccgacgtacggaaccaaccggccgtaggacggtggtaggtggggacgtacggggtaaccgtaaccccgtaaacgtcggttacgggtacgtaccaacgttacggttaccgttacccttcccgaaaccccgttacggttccccggtaccggggtaaccaaccgtttaaaccccgtaccgtaccgtaacccgtaacccgtaaacccgttaaccgtacccccgtaaacgtaaacccgtaaaaccaccgtaaccgttaacccctaacgtacggtaacgggtacgttacgggaaacgtaccgttcgtaccgaacgttaccgttcgtaccggaaccgtacggtacccgttacgtaacttacgttacgtaggttacccgacgtaccggtaccgacccgtaaccggtcgttacccgggtgtacccggtacccgtggtcccggtaccgggttacccgttaccgtttacggtcccggttacggtcccggggg

SEQ ID NO: 209692 - DNA, 699 bp, Homo sapiens
  misc_feature: GYAE6OF02GEW2A.17.25.C03.1.454.CMB.1.raw
  modified_base (148)..(148): a, c, t, g, unknown or other
  misc_feature (148)..(148): n is a, c, g, or t
  modified_base (185)..(185): a, c, t, g, unknown or other
  misc_feature (185)..(185): n is a, c, g, or t
  modified_base (263)..(263): a, c, t, g, unknown or other
  misc_feature (263)..(263): n is a, c, g, or t
  modified_base (277)..(277): a, c, t, g, unknown or other
  misc_feature (277)..(277): n is a, c, g, or t
  modified_base (523)..(523): a, c, t, g, unknown or other
  misc_feature (523)..(523): n is a, c, g, or t
  modified_base (606)..(606): a, c, t, g, unknown or other
  misc_feature (606)..(606): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtgccngcagctacaagtcgcccactccgaggtgcagctggtncagtcgtggggctgaggtagaagtagccgtggggaccttcgaggtgaaggtcctaccgtgaccgtaaggcttgtaggntttcacgtttcccncgttatagttatctaacgttcggtcgacgcgacggccgtacgtacggaacctaacggacccgtggtacggtaggtgtacgggtaacgtcgggaaccgtaacccgtaacgacgttggtaccgtacgtaacgtgtttaccgtaccttccgtaaccctacggttccgacccggcgtaaacgtcccttaagcctaacgaccctaaccgtaaccttccccgtaacgaaactaaaccgacactaccgtaacnggttaaccggaggttacgagggaacctctacgtaacagttcgacgacctcggtaaccggtcctacttagttccttgccggtanacggacccgttaccgagtttaaccggccgttacggcccgtacgtaccgggactacggttaccggtcgtttacgtacccgttgggtaacccggg

SEQ ID NO: 209693 - DNA, 628 bp, Homo sapiens
  misc_feature: GYAE6OF02G6ZBP.17.25.C03.1.454.CMB.1.raw
  modified_base (337)..(337): a, c, t, g, unknown or other
  misc_feature (337)..(337): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcctacgtttacctcctatagtatcaacgtggtgcgcgaggccgctggacacgacctggacgtggagtggggatcgggacaaccctaanacgtggtcgtcacagtcgtccttcaccctatcccgtccgggaacacgtaccttaaccgatacgaccgtaaccgacctaccctaccaaactaaacaacacgaccttaacaacgtcgggtaagttcggaacggtacgccgtgaactacttacgtcggaaccgaccggtaccggtccgttattacgttacgtaggttacgacgtaagtccgtccccgaagtaacggtccggtacgaaccggtccgtacggcgtacggtaccggttcccgtttacggtacgttccggtccggggg

SEQ ID NO: 209694 - DNA, 772 bp, Homo sapiens
  misc_feature: GYAE6OF02GPGTK.17.25.C03.1.454.CMB.1.raw
  modified_base (233)..(233): a, c, t, g, unknown or other
  misc_feature (233)..(233): n is a, c, g, or t
  modified_base (287)..(287): a, c, t, g, unknown or other
  misc_feature (287)..(287): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagagccgtgggcctcgagtgagtctccngcaggctgtgactctacgttacctctatagtatcaacgtggtgcgccaggccgngtcggaccaacgacctggagtggtagtggggagtcgggaccaacccgtacgtacgtggtacgtacgacgtagtcgttccttaccaccctacgtcccgtaccgggaactacgtacctaccgtactaccggaaccctaaccgtaacccttccctaacctaaacgtaaaacccaccgtaaacgtacccctacggtaaggttacgggtaaggtttaacggacggtaacccgtcccgtaagtacccggtaacttccggtaaacggaaaccccggtaccgggtacccgggttcccgtttaacgttttaaaccgtttccgtcgggttaacgaccggggttaaccgttacccggtaccccgtaaccggttcccgggttaccggggtaccgtaacccggttaccccggtaaccggggtacccggtaccggggttaccccgggttttacccgttttacccgggttacccgggttttcccggggaccccggggggg

SEQ ID NO: 209695 - DNA, 888 bp, Homo sapiens
  misc_feature: GYAE6OF02IB3JK.17.25.C03.1.454.CMB.1.raw
  modified_base (101)..(101): a, c, t, g, unknown or other
  misc_feature (101)..(101): n is a, c, g, or t
  modified_base (733)..(733): a, c, t, g, unknown or other
  misc_feature (733)..(733): n is a, c, g, or t
  modified_base (821)..(821): a, c, t, g, unknown or other
  misc_feature (821)..(821): n is a, c, g, or t
tcagcgtagactagcacgaccggtgctcgatttagtagtgtagatttgggtttggggactcaacaaccacatctatcctctagagaaaaccctgtgagcanagctcctcaccatggactggacctggaggactcctcttcgttggtcggtagcgagcctaacgaagtcgaccccaaccgttcccgaggtcgcagtccgttgggtgtctacggtccggtggggtcctaggacgggttagaaggaaccgtccggtacggggtcctacggtaggttacggtaacggttccttcgtacggaccgtaacggttcctttacggtaggtactttaccgtaccgttttaacccgtcttaaaggttacgttacttaccgaacggttcggggttaccgccggtacccggtacggtcccgtagttacggaacccgtaacggcccgttaggggagttacggaggtacgggtaccgttacggggaaccccttaaaacccgtaacggtccggttagggttaccgtacgtaacggttacggtttacgttaccctaaccgttaaccccggtcgttacccggggtaaccgggttaacctaaccggtttaaacccgttaaccggacctaacccgggtacctaaaccggtttcccgtacccgtaacctaaaccgtaaaccggaaccctaggttaacccgttaagacgttcgggtaacgttacgggaaccggtccgttaccgaagtttaaccnccgttacgaccgggtaccaacggtcccgtacgtttaagtacttcggtaggacctaggtaccgtccgaccggtacgttccggaaccggnggttacccgtacggtcggaacgttcccggttcgttaccgtttacggcgggtccggacggttacccgg

SEQ ID NO: 209696 - DNA, 582 bp, Homo sapiens
  misc_feature: GYAE6OF02HH0VO.17.25.C03.1.454.CMB.1.raw
  modified_base (184)..(184): a, c, t, g, unknown or other
  misc_feature (184)..(184): n is a, c, g, or t
  modified_base (264)..(264): a, c, t, g, unknown or other
  misc_feature (264)..(264): n is a, c, g, or t
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
  modified_base (442)..(442): a, c, t, g, unknown or other
  misc_feature (442)..(442): n is a, c, g, or t
  modified_base (446)..(446): a, c, t, g, unknown or other
  misc_feature (446)..(446): n is a, c, g, or t
  modified_base (452)..(452): a, c, t, g, unknown or other
  misc_feature (452)..(452): n is a, c, g, or t
  modified_base (466)..(466): a, c, t, g, unknown or other
  misc_feature (466)..(466): n is a, c, g, or t
  modified_base (471)..(471): a, c, t, g, unknown or other
  misc_feature (471)..(471): n is a, c, g, or t
  modified_base (474)..(474): a, c, t, g, unknown or other
  misc_feature (474)..(474): n is a, c, g, or t
  modified_base (478)..(478): a, c, t, g, unknown or other
  misc_feature (478)..(478): n is a, c, g, or t
  modified_base (506)..(506): a, c, t, g, unknown or other
  misc_feature (506)..(506): n is a, c, g, or t
  modified_base (515)..(515): a, c, t, g, unknown or other
  misc_feature (515)..(515): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtncagtctgggctgaggtgaagaagcctggggcctcgagtgaaggtctcgtgacaaggcttcgtggattcaccgttttaccncctaatagtatcaactgggtncgcaggccgntggacacgacctgaggtggagtgggatggggaccgtaaaccctaaacgacggttagggtctacgaacgtagttcgttcccttacaccctacttcccggtacgggacaacgtacttaccgatcgaccaagaccctcctacaataaacncaancctaangtgacgttgacggngctanacntcgngaacacgaccggccgttctaagttaccngtacgcgancgtacccaggtactccggtcgagccccgtaggcacggccggtactttcgggaccttcggtaccgggg

SEQ ID NO: 209697 - DNA, 757 bp, Homo sapiens
  misc_feature: GYAE6OF02GUY5L.17.25.C03.1.454.CMB.1.raw
  modified_base (507)..(507): a, c, t, g, unknown or other
  misc_feature (507)..(507): n is a, c, g, or t
tcagcgtagactagcacgaccggtgctcgatttagtagtgtagatttggggtttgggagtcagtctcagtcaggacacagcatggacatgacgggtcccgctcagcctccgtggggctcctgctactctggctcgagctgccagactgtgacatccagatcgaccagtcctccatcctcctgtctcgtcctcgtcggtgggggtacaggtacgtccacctatactaccgttcggacccggtaacgtaacgtaccgaacgggttaaaccctttaaaaacctttaagttttaaaacggtttcgttaactaccgaaacgtacgtaaacggtaaaacccgttaagggaaaaccccgccccgtaacggtacccttccgtacgtaccttcccttggtcggtacgacctactccctactggtaccggaacgtaggtccggtacctaccgttagtccggtacgttcgagggtctaccggtaggttacggtactcggtacggactaagtaccttanactcctacgctaccgactactactcgtctacgacgtaggtacgtcgtacgctactaacttacctactacgttactaacgtaaccgtagtaaccgtttccgtacccgttaccgtaccgttaccgttaccggtttaaccggtacccggtaaaccgggtaaccgttaacgggtacggtaacgtaaccggtaaaccggttaacgaacggttcgttacgtcgggtacctccgtaactcgttaccgtccgttaacc

SEQ ID NO: 209698 - DNA, 665 bp, Homo sapiens
  misc_feature: GYAE6OF02JHJ59.17.25.C03.1.454.CMB.1.raw
  modified_base (385)..(385): a, c, t, g, unknown or other
  misc_feature (385)..(385): n is a, c, g, or t
  modified_base (411)..(411): a, c, t, g, unknown or other
  misc_feature (411)..(411): n is a, c, g, or t
tcagcgtagactagcacgaccggtgctcgatttagtagtgtagatttgggtttgggagtcagtctcagtcaggacacagcatggacatgagggtccccgctcagctcctgggctcctgctactctggctccgagctgccagatgtgacatccagatgacccagtctccatccctccctgtctcgcctcgtggtgggggtcagtagtcaccatctacttcgccggacaagtccacggtaccgttaaaactatttaaagttggtactcagacaacgaaacctaggaaaaccgccccgaagtaccctccgtagaactccgtcgtggtcgctactccctactccgtgacgtaaggtcgccgtccagtacgtagttcaggtggacagtgntcgtaggacagtattacactcacacnctaccacctacgtcctacgtaccgtacctagggtagtagttcgcgactaatcccttataccgtacttaaccaacgtacgttaacgttaccgtacccgtttacccctcgtacctttaccggtttacccgggaacgggtaacccgggtaaccgttaaggttaacggaacggtaaccgtaaaccgtaaaccgttaacgggtacgttaccggaccgttacggaccccgttaactaaccgtttcgtacccggtttaccc

SEQ ID NO: 209699 - DNA, 792 bp, Homo sapiens
  misc_feature: GYAE6OF02F6GDM.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttgggtggcagcagcctaacaagtgcccactcccaggtgcagctggtgcaggtcgtggggctggaggtggaagacgccgtcggggcctcaggtgaacggtcctccgtggacgaacgggtccttcgtggtacttcctaacgttttacccgtccgttaattacgttaactacgaacggttggggtcgccggaccgacgggtcccgcggttacggaaccgaaaccgtcccgttaggagggtcgggaaggtacggggtacggtacggggtaccgtaaacccctaacgtacggttcgggttcggtacctacggtacggttcggtttacccttacccgtaaccccgttacgtccccggttacccgggggaaactaaccggtaaccgttaccctaagtacccgaacccgtaaccgttaaccttaccgtacctaaactaaaacctaacctacgacctaacgtacgtaggtacggttaggacggtaccgtaccgtacgaacgtttttacgccgttacgaaccgtacggacccgggttaccgttacgttaaccgttacgtggtaccgacggtacggtacctaaccgacgtaacggtccggaggtaacccgcggtaccggacggtacggtaccggttccgtttcggtaccgtacggtccgggg

SEQ ID NO: 209700 - DNA, 674 bp, Homo sapiens
  misc_feature: GYAE6OF02F6ZX7.17.25.C03.1.454.CMB.1.raw
  modified_base (333)..(333): a, c, t, g, unknown or other
  misc_feature (333)..(333): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgccactcccaggtgcagctggtgcagtctggggctgaggtgaagaagcctgggggcctcagtgaaggtctcctgcaaggcttctggatttcacgtttacctcctatagtatcaactgggtgcgccaggcccgctggacaacgacctgagtggatgggatggggcaaccctaanactggtgtcacagtgtcttcaccctatcctccgggacaggaccttaccatgaccacgaactcctaccaataaaccacacgtaccctaacgagtgggaagtttcgaagggtacgtccctagggaactagttccttggaaccggtacccgaacccgggtccggtttaaccttaacgtttaaaccgttcggttaggacccggttaaggtacccggttacccccgaacgggtaaacctttcccgggggtaacgtaaccgggtaccccgttaaaccggggcctaacggggtccccgggttacccctttttacggggttacccctttacccgggggtcccggggggg

SEQ ID NO: 209701 - DNA, 874 bp, Homo sapiens
  misc_feature: GYAE6OF02HHZ84.17.25.C03.1.454.CMB.1.raw
tcagcgtagactagcacgaccggtgctcgatttagtagtgtagatttgggtttgggggactcaacaaccacatctgtcctctagagaaaaccctgtgagcacagctcctcaccatggactggacctgggaggatcctctttcttggtggcagcagctacaagtcgcccacctcccaggtgcagctggtgcgtagtcgtggggtctggaggtaggaaggaaggccgtggggcctcgaggtaggtaacggtccttccgtcgacgtaaggtccttcgtacggtactttaccgtaaccgttttacccttaccgttaattaaggttaactaccgttaacggtggggttacgccggacccggaaccgggtcccggaccggtaccgggaaccgaaaaccggtacccgttagggacggggttagggtacggtaggggtacggtaccggggaaccgtaaaccccgtaacgtacggttcgggtcgtacacgtacggtttcgtaccttacccaacccgtacgtacccggtaccgggtaaccgtaacgtacccgttaaccgtaagtaccggtaaacccaaccggttaaccccttcccgtaaacccaaaactaaaaccgaccgtaaaccggtaacccttaacggtaacggtacggttaaacggttacgggaacggtaccgtaccgtaacggtaacctaggttaccgtacggtaaacccggtaacccggtaaccgggttaccgttacctttaacggttaaccgttggtaaccggacggtaaccggtaccgtaacccggaacggttcgtacccgggtaggtaacccggtaccggtaccggcggtacggtcccggttacccgttttacggtaccgttcggggtaccgggg

SEQ ID NO: 209702 - DNA, 710 bp, Homo sapiens
  misc_feature: GYAE6OF02JU0P1.17.25.C03.1.454.CMB.1.raw
  modified_base (335)..(335): a, c, t, g, unknown or other
  misc_feature (335)..(335): n is a, c, g, or t
  modified_base (393)..(393): a, c, t, g, unknown or other
  misc_feature (393)..(393): n is a, c, g, or t
  modified_base (404)..(404): a, c, t, g, unknown or other
  misc_feature (404)..(404): n is a, c, g, or t
  modified_base (454)..(454): a, c, t, g, unknown or other
  misc_feature (454)..(454): n is a, c, g, or t
  modified_base (641)..(641): a, c, t, g, unknown or other
  misc_feature (641)..(641): n is a, c, g, or t
tcagcgtagactagcacgaccggtgctcgatttagtagtgtagattttgggtttgggagtcagtctcagtcaggacacagcatggacatgacgggtccccgctcagctccgtgggctcctgctactctggctccgagctgccagatgtgacatccagatacgaccacgtctccatccctcctgtctcgcctcgtggtcgggggtacaggtactcacctatcctactcggacgaacaagtccgaaccggttaacgttaaaaccttatttaacgttgatcagacaaacgaacctaaggaaaacccgtcccacgtacctctgtactcgtcggtaggtnactactaccactcggccgaggtacggtccgacccttcccgaagtccgggtagttacgnggtcggtaagnggtacgtaggttcgggagaacgtacgtttaacttcaaaccctcccgtaanacctaacgtccccgactaaccttccgaacggtaacccggtagttcggtaaagggttaccttccggtaactaactaacccgtttacgaacccgttatccggttaaaacctcggtaaaggtttaccttacccggtccgttacctccggttaatttcgggttaaaccgacgggtaaacggtagttaacgngtaaacgtacgaacgtaaaccgttggtacggtacgccttaacgctttaaccgtcttacccttgtaaccc

SEQ ID NO: 209703 - DNA, 795 bp, Homo sapiens
  misc_feature: GYAE6OF02JT44Q.17.25.C03.1.454.CMB.1.raw
  modified_base (240)..(240): a, c, t, g, unknown or other
  misc_feature (240)..(240): n is a, c, g, or t
  modified_base (256)..(256): a, c, t, g, unknown or other
  misc_feature (256)..(256): n is a, c, g, or t
  modified_base (264)..(264): a, c, t, g, unknown or other
  misc_feature (264)..(264): n is a, c, g, or t
  modified_base (638)..(638): a, c, t, g, unknown or other
  misc_feature (638)..(638): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctctttcttggtggcagcagctacagtgcccactcccaggtgcagctggtgcagtcgtgggctgaggtgaagagccgtgggcctgagtgagtctcctgcaggtcttnggattcacgtttaccnctatagtntccaagtggtcgtcgaccgtaggccgtcgtacggaactaaccggaccgtggacggtaggtacggtggggtacgtcgggtaaccgtaacccgtaagtaccggttgggtacgtaccgtaacggttaggtcgttcccgtaccgtaacccgtaccgttacccgggtaccgaacgtacgtaaccctttaaccggacgttaccgaaacccgacccgttaaacccttcccgtaaccgtaaacctaaaccgacgaaaccggttcccttaaaagtcggttacgggtaacggttacggaaaccgggttccgtcggttaactacgtaccgttcggtaacgggacccgtaccgacccggggttactttagttaaccgtttaccggngttaccgggaacccgtaggtaccccgtttaacccggaaccggtttaccggtacccggttacggaaaccccgttttccccgggtaaaccgggtcggttaacccggggttccctttaacccggttttacgggttacccggtttccgggggaacccgggg

SEQ ID NO: 209704 - DNA, 677 bp, Homo sapiens
  misc_feature: GYAE6OF02H9U9I.17.25.C03.1.454.CMB.1.raw
  modified_base (158)..(158): a, c, t, g, unknown or other
  misc_feature (158)..(158): n is a, c, g, or t
  modified_base (178)..(178): a, c, t, g, unknown or other
  misc_feature (178)..(178): n is a, c, g, or t
  modified_base (194)..(194): a, c, t, g, unknown or other
  misc_feature (194)..(194): n is a, c, g, or t
  modified_base (387)..(387): a, c, t, g, unknown or other
  misc_feature (387)..(387): n is a, c, g, or t
  modified_base (453)..(453): a, c, t, g, unknown or other
  misc_feature (453)..(453): n is a, c, g, or t
  modified_base (484)..(484): a, c, t, g, unknown or other
  misc_feature (484)..(484): n is a, c, g, or t
  modified_base (486)..(486): a, c, t, g, unknown or other
  misc_feature (486)..(486): n is a, c, g, or t
  modified_base (567)..(567): a, c, t, g, unknown or other
  misc_feature (567)..(567): n is a, c, g, or t
tcagcgtagactagcacgaccggtgctcgatttagtagtgtagatttgggtttggggactcaacaaccacatctgtcctctagagaaaaccctgtgagcacagctcctcaccatggactggaccgtggaggatcctcttcttggtggcagcagctaanaagtgcccacctcccaggtncagctggtgcagtcgnggggtctaggagggtgaaagaacggtccgtaggggccctaccgaggttagaaacggttcctaccgtagtcgaaacgggtctttcgtggtacttactaccggttttacctaccgttaataggttaactactaacgtgggtgtcgacctaaggtccgacgtagaaccgaacgtaccgtgaagtggaagttcgggntacgggacctaaaccgtaagtcgtcggtatacgacgtagtcgtacctcaaccagtcccgtacgtanaacgtctacgtcacgtacactaacgtccaananaactgaactctaacagtcgtagtagacgacgtccgtagatacgtctagaccgtacgcggttacctacttaacgttaccgtntacgtaccgaaggtacctcccggtaaccgaggttacccggtagggtcccgacccgtttacgacgggtaaccggtcccggttacttttacgacccggtttggaacccgggg

SEQ ID NO: 209705 - DNA, 629 bp, Homo sapiens
  misc_feature: GYAE6OF02JJH3Q.17.25.C03.1.454.CMB.1.raw
  modified_base (297)..(297): a, c, t, g, unknown or other
  misc_feature (297)..(297): n is a, c, g, or t
  modified_base (340)..(340): a, c, t, g, unknown or other
  misc_feature (340)..(340): n is a, c, g, or t
  modified_base (352)..(352): a, c, t, g, unknown or other
  misc_feature (352)..(352): n is a, c, g, or t
  modified_base (356)..(356): a, c, t, g, unknown or other
  misc_feature (356)..(356): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggctcagtgaaggtctccgtgcaaggcttctggattccacggtttacctcctatagtagtctaaacgtgggtgcgccgaggtccnctggaccaacgaccctggacgtggatgggatgggcaaccctanactggtcgtcanagtntccgttacacccatccgtccggtacagtccttacatcgaccacgaacctccctcaagtaaaccacacgtacccgtactaatcgggaatttcggagggaactcccgtagtaccagttaccgtgaaccgacgtaaccgggtcccggtcttaagtttacgtacgtcgtacggtaagttaccgaccccaggtaaaccgttccggttggaaccggttaccctacgggtacccagggtaccccggtacccgtttttcggaccgttacccggtccggggg

SEQ ID NO: 209706 - DNA, 556 bp, Homo sapiens
  misc_feature: GYAE6OF02GLJ7A.17.25.C03.1.454.CMB.1.raw
  modified_base (260)..(260): a, c, t, g, unknown or other
  misc_feature (260)..(260): n is a, c, g, or t
  modified_base (280)..(280): a, c, t, g, unknown or other
  misc_feature (280)..(280): n is a, c, g, or t
  modified_base (329)..(329): a, c, t, g, unknown or other
  misc_feature (329)..(329): n is a, c, g, or t
  modified_base (409)..(409): a, c, t, g, unknown or other
  misc_feature (409)..(409): n is a, c, g, or t
  modified_base (439)..(439): a, c, t, g, unknown or other
  misc_feature (439)..(439): n is a, c, g, or t
  modified_base (443)..(443): a, c, t, g, unknown or other
  misc_feature (443)..(443): n is a, c, g, or t
  modified_base (546)..(546): a, c, t, g, unknown or other
  misc_feature (546)..(546): n is a, c, g, or t
tcagcgtagactagcacgaccggtgctcgatttagtagtgtagatttgggtttggggactcaaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaaggcttctggattcacgtttaccncctatagtatcaactgggtncgccaggccgcggacaacgctgagtggatgggatgggacaaccctaacncgtggtgtcacagtgtcttcacccatccgtaccgggacacgtaccttacatcgaaccacgaacctccctacaataaaccncacgcctaacatggattggagagcctgacntcgngaccacacggtcttactattacgtgtacgcgtaagtaccgtcccgacgtacgtccggagaccgccgtacggcgtacggtccggttaccttcggactttcgggngggtacccgg

SEQ ID NO: 209707 - DNA, 756 bp, Homo sapiens
  misc_feature: GYAE6OF02F466O.17.25.C03.1.454.CMB.1.raw
  modified_base (327)..(327): a, c, t, g, unknown or other
  misc_feature (327)..(327): n is a, c, g, or t
  modified_base (556)..(556): a, c, t, g, unknown or other
  misc_feature (556)..(556): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaaggtcgccccactcccaggtgcagcgtggtgctagtcgtggggctaggaggtagaagaacgtccgtcggggcctacgaggtaggaacggtcctccgtcggcgaaggtccttcgtaggtactttccgtacccgttttacctacctaattagtacttacgaacggttgggngccgccgacggccgtcgtaacgggaacctaaccggtaccgtacggtaaggtcgggtaagggtggggtaacgtccggggtaacccgaaaaccccgttacgacgttggggtacgtaccgtagtagtttccggttccttaacccgtacccgtacgttacccggtccgggaactacgttaccgtaccgataccggaacccgaaccgttaaccctacctacccaaagtaaaccncgaaccgtaacctagacggtggtaacgtcgggtaaagctaccggtaagtactaactcggaccgtaacggacccgaacggttcctttacgtaacttcgcggtacgacgtacgtacccggtccgaacggtacggtccggaagtacccggaactacgggacgtacccggacgtttcggtttaccgcggtttaccggaccgggg

SEQ ID NO: 209708 - DNA, 767 bp, Homo sapiens
  misc_feature: GYAE6OF02G1OYX.17.25.C03.1.454.CMB.1.raw
  modified_base (157)..(157): a, c, t, g, unknown or other
  misc_feature (157)..(157): n is a, c, g, or t
  modified_base (302)..(302): a, c, t, g, unknown or other
  misc_feature (302)..(302): n is a, c, g, or t
  modified_base (337)..(337): a, c, t, g, unknown or other
  misc_feature (337)..(337): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttggtggcagcagctanaagtcgcccactcccaggtgcaggctgggtcgcgtagtcgtcggggctaggaggtagaaggacgtccggtcggggcctcgaggtaggtaacggttcctccgtaggacgaacggtcttcgtggtacttcgttaaccgttttacccnccgttaagttacggtactaccgaacggttgggtcnccggaccgtacggccgtgtaacggaccaaccgtcctggaggtggagtgggacgtcgggaacccgtaacctaacgcgttggtacctacgtaagtggttcttcctaccctacccgaccgttcccgggtaccgggaaaccgtttacccttaaccgacggtaccgaaacccgtaaccgtaaccctacccgttaacccaaaacgtaaaccgcctaacccgtaccgttaacgaacggtttacgggtacggtttaacggaacggtaccgttaaccgacggttaaccttacgttaccggacgttaaccggaaccggttcccggttaacttacggtttacttaccgggttgcgtaacgtccgcccgttaccgacgtacggtccggacgtacgtaccgagtccgtaccgtcggtttccttaggtcgttcgggacgaccgg

SEQ ID NO: 209709 - DNA, 692 bp, Homo sapiens
  misc_feature: GYAE6OF02HYG4R.17.25.C03.1.454.CMB.1.raw
  modified_base (274)..(274): a, c, t, g, unknown or other
  misc_feature (274)..(274): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggactgaggtcgaagagccgtgggcctcgaggtgaacggtctccgtgcgtaacggtcttcgagtacttcctaccgtttaccncttaatacgtactacctaacgttgggcgtccgaccgacggcctacgtacggaccgaacgtacgtcggaggtacggacgtacgggacgtacggtaccgtaaccctaacgtaccgtggtaccgtacgagtacgttctcgttaccgaccgtagtcccgtacggactacgtaccgtactagtaccgacctaaccgacttccctaaaccgtaaacgtaacgactaccgtccctaactacggttcgaagttacggacgtacgtcgtacgactagacgttacaccggacgtaccgttacgtacgttacttacgcgttaacgacgtaaccgccttaaccggacgttacgtaccgggtaccaacggttacccgtaaccgggcgtaaccgggttccgttacccgttacgtcccggttagtacccgggg

SEQ ID NO: 209710 - DNA, 624 bp, Homo sapiens
  misc_feature: GYAE6OF02H4EC3.17.25.C03.1.454.CMB.1.raw
  modified_base (237)..(237): a, c, t, g, unknown or other
  misc_feature (237)..(237): n is a, c, g, or t
  modified_base (287)..(287): a, c, t, g, unknown or other
  misc_feature (287)..(287): n is a, c, g, or t
  modified_base (469)..(469): a, c, t, g, unknown or other
  misc_feature (469)..(469): n is a, c, g, or t
tcagcgtagactagcacgaccggtgctcgatttagtagtgtagatttgggtttggggactcaacaaccacatctgtcctctagagaaaccctgtgagcacagctcctcaccatggactggacctggaggatcctcttcttggtggcagcagctacaagtgcccactcccaggtgcagctggtgcagtctgggctgaggtgaagagcctgggcctcagtgaggtctctgcaggcttcnggattcacgtttacctctatagtatcaacgtgggtgcgccgacgggtccncttgggaacctaacggacctggaggtcggaagtggggatcggggacctaacccgtaactacgtggtacgtcaacgagttcgtcttcaccctactcccgtccgggaatacgtaaccttaccagtaccgaacccacgtaacctcctaaccaactaaacacacgtacacagtggagttgaggtcncttagactcgtctacgaaccgacgaccgggtaccgttacttaattaccgtggttcgccgaacgtaccgtaccccgacgtacggttcccggttggaaccgacccggtaacggccgtacgggtcccgtccgttttacggtccgttaccggtccgggg

SEQ ID NO: 209711 - DNA, 676 bp, Homo sapiens
  misc_feature: GYAE6OF02FLMJS.17.25.C03.1.454.CMB.1.raw
  modified_base (489)..(489): a, c, t, g, unknown or other
  misc_feature (489)..(489): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgccccactcccaggtgcagctggtgcagtctggggctgaggtgaagagcctggggcctcgagtgaaggtctccgtgcaggtcttctggtacttcacgtttacctctatagtactcaacgtgggtcgcgccaggccgcgtaggaccaacgacctggagtggagtggggagtcgggaccgaaaccctaacacgtcggtgtaccagtacgtgtccttccgaccctactcccgtaccgggactacgtaccttaccagtacgacccgaccgtaacctccctaccaaactaaaccgacaacgacctaactaggtacggtacgttgaacgggtacncccgtagacctacgttaccgtaggacccgaaccggaccggttccgtaccgttaatttaccggtcggtacggtaccgtaacggtacccgttacccgacggtaccggttaccggtaacggtccgtacccggtaacggccggtaaccgggtcccgggtttcctttaccggacggtttccggtaccggggg

SEQ ID NO: 209712 - DNA, 742 bp, Homo sapiens
  misc_feature: GYAE6OF02GDDYX.17.25.C03.1.454.CMB.1.raw
  modified_base (307)..(307): a, c, t, g, unknown or other
  misc_feature (307)..(307): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttgggtggcagcagctacaagtgcccactcccaggtgcagctggtgcagtcgtggggctaggaggtagaagaagccgtggggcctcgagtgaacggtctctgacaggtcttctggtacttcgtacgtttacctcctatagtatactaacgtgggtgcgccgaggccgngtcgacgacgaccgtgaggtggagtgggacgttgggaccgtaaccgtaacgacgtcggtgtacacgtacgtagttccttaccgacctacgttaccgtaccggggtacacgttaccttaaccgtacgtaccgacccgaaccgtaaccttaccctaaccgtaaactaaaccgaaacctaaccgtaccctaacgtacgtacgggttacggttaacggacgggtaaccgtccgttacgtacctaacgttaccacggtaaccggaaccgtaccgggttacccgtacttaacgtttaacgtcggtacggacggtaaccggtaccgtacccgaacggttaccgggtaccgggtaccggtaccggtacccggttaacccgggacgttaccgggttcccggtaccggtttttccggtaccgggtttaccggtaacccggggggg

SEQ ID NO: 209713 - DNA, 814 bp, Homo sapiens
  misc_feature: GYAE6OF02H5DWR.17.25.C03.1.454.CMB.1.raw
  modified_base (769)..(769): a, c, t, g, unknown or other
  misc_feature (769)..(769): n is a, c, g, or t
tcagcgtagactagcacgaccggtgctcgatttagtagtgtagatttggttttggggactcaacaaccacatctgtcctctagaagaaaaccctgtgagcacagctcctcaccatggactggacctgggaggatcctctttcgttggtggcagcagcctacaagtcgacccacctacccgaggtgcagcgtggtgcgagtcgtggggctggaggtagaaggaacgccggtggggcctacgaggtagtaacgtcctaccgtgagtaacggtcttacgtcggttattaccgtaaccgtttaccctacgttagttacgttaacttaccgtaacggtcgggtcgccggtaccggacgggtcccgacgttacggaacctaaaccggaccgttagggacgggttgaagggtcggggaacgttacggggaacccgtaaaccgttaacgaacggttcggtacgtacaacgtacgttcgttaccctaccaaccccgtacgtcccggtaaccggtacgtaaccttaccgttaacgacgtaacccgaacccgtaacgtaacccctttacccgaacctaaaacctaaacctaccgaccgtacccgtaactaggttaaggttacggtacggtaacggacgttaccgtagtaaccgtacgtccggtaacggaaccggtaaccgtacccggtacccgttactttaccgttacggtacggttcgggaccgttacgtacccgtcccgtaaggcccggttaaccggtcggacccgacggttacccgnggtaccggtcgggtttcccttaggtaccggttccgggtaccgggg

SEQ ID NO: 209714 - DNA, 670 bp, Homo sapiens
  misc_feature: GYAE6OF02JF4EE.17.25.C03.1.454.CMB.1.raw
  modified_base (183)..(183): a, c, t, g, unknown or other
  misc_feature (183)..(183): n is a, c, g, or t
  modified_base (233)..(233): a, c, t, g, unknown or other
  misc_feature (233)..(233): n is a, c, g, or t
  modified_base (487)..(487): a, c, t, g, unknown or other
  misc_feature (487)..(487): n is a, c, g, or t
  modified_base (625)..(625): a, c, t, g, unknown or other
  misc_feature (625)..(625): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtgcagcagctacaagtcgcccactcccaggtgcagctggngcagtcgtgggctggaggtgaagagccgtgggcctgagtgacggtctcgngacaggcttcgtagacttccgacgtttacccaccttaatacgttactaccgtaaggttgggtacgacggccgtaccggggacctcggtacgggaacctaacggaccgttaggacggtaggagtacgggggataccggggacctaaaccctaacgtcggtggtactacaacgtgtcgtacctccgtaaccacgttccctagggactaacgtaccttacagtcgaacccacgtacctaccgtaccaaactaaaccncgtaacgacctactaggtacggtagttcggacggtacaccgtagacgtataccgtacgaaccgacgtaccgtaccgttactagttaccgtcgtcgacgaccgacgttacccaggttaccggacgtacggacgtaccgnggtaccgtacgggtccttacccgttaggtacccttcgggaccggg

SEQ ID NO: 209715 - DNA, 597 bp, Homo sapiens
  misc_feature: GYAE6OF02GZICA.17.25.C03.1.454.CMB.1.raw
  modified_base (343)..(343): a, c, t, g, unknown or other
  misc_feature (343)..(343): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggcgaaccctaacactggtgtcanagtgtcttcacccagtcctccgggacacgacttaccatcgaccacgaacctcctaccaataaacacacgacctacagtcggagttggaacgggagccttgactacgtctacggaccgaccgtaaccgggccgttacgttaatttaaccgtgtcggtacgaacggtacgtccccgacggtacttaccgggtacgtacggtaccccgtacgggccgacggtccgggtacccttttcggaccgttcgtcccgggggg

SEQ ID NO: 209716 - DNA, 725 bp, Homo sapiens
  misc_feature: GYAE6OF02FO695.17.25.C03.1.454.CMB.1.raw
  modified_base (192)..(192): a, c, t, g, unknown or other
  misc_feature (192)..(192): n is a, c, g, or t
tcagcgtagactagcacgaccggtgctcgatttagtagtgtagatttgggtttgggggtacgtcaacaaccacatctcgtcctctagagaaaaccctgtgagcacagctcctcaccatggactggacctggagatcctcttcttgtggcagcagctacaagtgcccactcccaggtgcagctggtgcagtcnggggctgaggtgaagaaggccctggggcctcgagtcgaagggtctccttgactaaggcttctggtattcgaacgtttacctcctaattagtacttcaactgggttgacgccaagggcccgacgtggaaccaacggtaacctggacgttggaagtcggggtaatcggggacgaacccctaacgtacctggtacttcagtacggtgtacctttaccgacccaacttccgtacgggaacgtacgtacctttaaaccgattaccgaacctaaccgtaaacctaccctaccgaaacttaaaaccgaacgtaacgacccttaacgaacgttacggtaacggtttacgaagggtaacggtcccgtaacggtaaacctagtacccgttacggaacccgtaacccgaccggtaccgttaccgttaactttaacgttcggtagacccgtaggtaccgtaccgtaccggtaactaccgggtacttaccggtacccgtacggacgaccggttacgtacccgtttcggtaccgttccggtacgggg

SEQ ID NO: 209717 - DNA, 796 bp, Homo sapiens
  misc_feature: GYAE6OF02IMNZ4.17.25.C03.1.454.CMB.1.raw
tcagcgtagactagcacgaccggtgctcgatttagtagtgtagatttgggtttgggactcaacaaccacatctgtcctctagagaaaaccctgtgagcacagctcctcaccatggactggacctggaggatcctcttcttggtgcagcagctacaagtcgcccacctcccaggtgcagcgtggtgctagtcgtgggctggaggtagaaagaacgccgtggggccctcaggtaggaacggtctccgtgacgacggtcttcgtaggtacttccgtaaccgtttaccctaccttaagttagtactaccgtaacgtggggtcgccgaccgacggtccgtcgtacggaacccgaaccggtaccgtggacggtaggtacgtgggacgtacggggacccgtaaaacccgtaacgtaccggttggtccgtacgtaccgtagttccgttacccttacccgaaccccgtcgttaccccgtaccggggaacctacgttaacccgtttacccgagttaccgaacccgtaaccgtaacccgttacccctaaccgtaaaacgtaaacccgaacgtaccgtacccgttaaacgtacgggtacgggtaacggttacgggacggtacgtacccgttacgtaccaacggttacgtaccggaaccggtacccgtaccgggtaccgttacgttaaccgttcgtacggtacgtaccggtacgtacccgtacccggacggtacggtacccgggacgtaccggtccccgtaacggccgtaccggtccggttaccgttacgttcccggtcggtaccgggg

SEQ ID NO: 209718 - DNA, 698 bp, Homo sapiens
  misc_feature: GYAE6OF02GTM3M.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcagtgaaggtctcctgcaaggcttcgtggattcacgtttacctcctatagtatactactggtgccgccgacggccgcgtacggacgaaaccgtaccgtacggtaggcggtaggtcggggtaggtacggggaccgaaaccccgtaaccgtaacgtcgggtacggtacgtaccgtaggttcggttccttacccgtacccgtactcccggttacccggggtaaccgaaccgttaaccgtttaacccgacgttaaccggaacccgaacccgttaaacccgtcccttaaccccgaaactaaaacccgtaaacccaaccgtaccgttaacctaaggttaggtaaccggttaggtaacggacgtacctacgactactcgtacggacgacgtaccgcgttacgttatacgtgtgacgacgtcaccgagcgtacggtcgacgcccgtaacgcgtacggccgttaccgtttcggtaccgtggtacggg

SEQ ID NO: 209719 - DNA, 693 bp, Homo sapiens
  misc_feature: GYAE6OF02IFIYE.17.25.C03.1.454.CMB.1.raw
  modified_base (187)..(187): a, c, t, g, unknown or other
  misc_feature (187)..(187): n is a, c, g, or t
  modified_base (278)..(278): a, c, t, g, unknown or other
  misc_feature (278)..(278): n is a, c, g, or t
  modified_base (530)..(530): a, c, t, g, unknown or other
  misc_feature (530)..(530): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctaacaagtgacccactcccaggtcgacagctggngcgagtcgtgggctggaggtgaaagacgccgtgggcctcgaggtgaacgtctctgacaggtctcgtgtattctacgttactctatagttancgtacgtggtcgccgcgacggcctagtacggaacaaccgtccgtaggagtacggagtcgggagtcgggaaccctaaccgtaactacgtcgggtactacacgtgtacgtctaccaacccgtcgtcccggacgtaaccgacgttaccgttaaccacgtacgaacccgtacgtaactcccgtaacctaaaacgtaacccacgtaaccgtaccctaaaggtacggttaacggtagtaccgggaagtaccttaccgntaaacgattccggaagacccgtaccgaccggtttcctatttaacgtacccgtggtccgaaacggtccaacgtccccggaaggttccaccgggttacggacccgtacccggtaggcccgttaacgggtccttttccgggtaactacgggtcccgggtaacgggg

SEQ ID NO: 209720 - DNA, 287 bp, Homo sapiens
  misc_feature: GYAE6OF02G7WEG.17.25.C03.1.454.CMB.1.raw
  modified_base (189)..(189): a, c, t, g, unknown or other
  misc_feature (189)..(189): n is a, c, g, or t
  modified_base (256)..(256): a, c, t, g, unknown or other
  misc_feature (256)..(256): n is a, c, g, or t
  modified_base (274)..(274): a, c, t, g, unknown or other
  misc_feature (274)..(274): n is a, c, g, or t
  modified_base (281)..(287): a, c, t, g, unknown or other
  misc_feature (281)..(287): n is a, c, g, or t
tcagcgtagactagcacgaccggtgctcgatttagtagtgtagatttgggtttggggggagtcagtctcagtcaggacacagcatggacatgagggtcccgctcagctcctggggctcctgctactctggctccgagctgccagatgtgacatccagatgacccagtctccatcctccctgtctgcctntgggtgggggtcagagtcaccatcacttgccgacaagtcacggtacttaaaactattaattggtatnagcagaaacctagaaacnccacgtnnnnnnn

SEQ ID NO: 209721 - DNA, 725 bp, Homo sapiens
  misc_feature: GYAE6OF02IXDHB.17.25.C03.1.454.CMB.1.raw
  modified_base (268)..(268): a, c, t, g, unknown or other
  misc_feature (268)..(268): n is a, c, g, or t
  modified_base (313)..(313): a, c, t, g, unknown or other
  misc_feature (313)..(313): n is a, c, g, or t
  modified_base (336)..(336): a, c, t, g, unknown or other
  misc_feature (336)..(336): n is a, c, g, or t
  modified_base (603)..(603): a, c, t, g, unknown or other
  misc_feature (603)..(603): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttgggtggcagcagctacaagtcgcccactcccaggtgcagcgtggtgctagtcgtaggggctggaggtgaaagaacggccgtggggtaccctcgagtagaacggtctccgtgaccaggtcttctggtnttcctacgtttacctctatatactcagtggtgaccgccgagccgngtacggaccgaacggccgtaggnggtggaggtggggtagtcggggaaccaacctaaccgtacgtggtacgtcaacgtaggttcttcctccgtaaccctcgtacccggtaccggactactaacctaccgtagacccaccgtaaccgtaacccttccctaacgaaactaaacccgactaacccgtacttaaccgagttacggggtaagttggaacgtccgtaaccctagacctaacgttccgtacggaaccggtacccgaccgggtaaccgttacgtttaacgtttacccgnggtaccgttacggaacgggttacccgtaacccgtaccggggtaacggttcccggtaagggaacctccggtacggcgttaccggtccgtttaaccggttcgttaccggttccgggtaccgggg

SEQ ID NO: 209722 - DNA, 738 bp, Homo sapiens
  misc_feature: GYAE6OF02H1OYL.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctctttcttggtggcagcagctacaagtcgcccactcccaggtgcagctggtgcagtcgtggggctggaggtgaagaagccgtggggcctacgagtgaaggtctccgtgacaaggtcttcgtaggtacttacctaccggttttaccctccgttaagtagttaactaccgtaaccgtggggtcgccgaccgagggcccgcgtacggaaccaaaccggaaccgtggtaacggtgggaaggttaggggaagttcgggggaccctaaaccccgtaacgaccgttggtacgtaccacgtaggtttcgttaccgttacccgaaccctacgtcccggtacccgggaactacggtaacccttacgaacgtccgtaacccaacgtaaccctccctaacctaaactaaaccgacgacgaccctaactacgtagtacggttagacggtaccgtcgtacgactactacgtacgaaccgaccggaaccgtccggtacttacgttactacggtgtaacgacgtaccgtacccgtacggtacgtcccgggtaggtaccgtcccgtaaccggtcggacccggtcgggttaccctttcggtaccggtttcggaacccggggg

SEQ ID NO: 209723 - DNA, 654 bp, Homo sapiens
  misc_feature: GYAE6OF02GYPB5.17.25.C03.1.454.CMB.1.raw
  modified_base (152)..(152): a, c, t, g, unknown or other
  misc_feature (152)..(152): n is a, c, g, or t
  modified_base (254)..(254): a, c, t, g, unknown or other
  misc_feature (254)..(254): n is a, c, g, or t
  modified_base (304)..(304): a, c, t, g, unknown or other
  misc_feature (304)..(304): n is a, c, g, or t
  modified_base (310)..(310): a, c, t, g, unknown or other
  misc_feature (310)..(310): n is a, c, g, or t
  modified_base (364)..(364): a, c, t, g, unknown or other
  misc_feature (364)..(364): n is a, c, g, or t
  modified_base (371)..(371): a, c, t, g, unknown or other
  misc_feature (371)..(371): n is a, c, g, or t
  modified_base (425)..(425): a, c, t, g, unknown or other
  misc_feature (425)..(425): n is a, c, g, or t
  modified_base (486)..(486): a, c, t, g, unknown or other
  misc_feature (486)..(486): n is a, c, g, or t
  modified_base (516)..(516): a, c, t, g, unknown or other
  misc_feature (516)..(516): n is a, c, g, or t
  modified_base (562)..(562): a, c, t, g, unknown or other
  misc_feature (562)..(562): n is a, c, g, or t
  modified_base (620)..(620): a, c, t, g, unknown or other
  misc_feature (620)..(620): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctgggaggatcctcttcttggtggcagcngctacaagtcgcccactcccgaggtgcagctggtgcagtcgtgggctgaggtagaagaagccgtggggcctcgagtgaacggtctcctgcgaaggtcttcgnggtacttcctaccgtttacctctatacgtatcaacgttgggtgcgaccgnggccgngtcggaactaccggaccgtgaggtggagtgggagtcgggaccgtaaccgtaacncgtggtntaccagtagtcgtcctaccacccgtactcccggtacggaactactacctaccgngtaccgacccgtaacgtaaccctccctaaccgtaaactaaaccgaactccgtaccttaagngttacggtggttaagacgggtctaccggtnaaccttagcgtagaccgaaccgtcggtccgttaattaacttcggtntacggcgaacgtcctaaccgcggtccgtacggtacgtacccggtactcggaccggtcncccggttaccgttcgtaccggttccgggaccggg

SEQ ID NO: 209724 - DNA, 688 bp, Homo sapiens
  misc_feature: GYAE6OF02GNZ16.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtagaagagccgtggggcctcagtgaggtctcctgcaggtcttgtggattctacttacctctatagtatcacgtggtgccgccgacggccgtcgtacggaaccgaaccgtaccgtggacggtggaaggtggggagttacggggaccgtaaacccgtaacgtacgtcgggttacgtacgtacgtaggttcgttaccttaccgtaccctaccgtccggtacccgggtaaccgtaccttaccgactaccgacccaaccgtacctccctaacaaacctaaacacgaccgtacctaacgtacgtaggtagtaggacgacgcgtacgacgtatcgacgaacggaccgtaccggtaccgtcgttacgttacgtagtcgacgtacggtacccgtaccacggtaccggtaccggtaggacccggtaccgtaacccggtggtaacccgggtccggttacccgtttacgccggttttaccgggccggggtaacccggg

SEQ ID NO: 209725 - DNA, 791 bp, Homo sapiens
  misc_feature: GYAE6OF02GLS2Y.17.25.C03.1.454.CMB.1.raw
  modified_base (189)..(189): a, c, t, g, unknown or other
  misc_feature (189)..(189): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttggtggcagcagctacaagtcgcccacctcccaggtcgcagcgtggtncgacgtcgtggggctggaggtagaagacggccgtgggcctgaggtagacgtctccgtgacgtaggtctcgtcggtacttccgttaccgtttacctactaatacgtaactaccgtaacgttcgggtcgaccgtaccgacggaccgtcggtacggaaccgtaacgtaccgttaggacggtacggtaacgggtgggtacggtaccgggaacccgtaaacccgtaacgtaccggttacgggtaccttacgacggttacggttccgttacccgtaccctacccgtacggttaccccggtaacgggtacctaaccggttaaccttaacccacgggtacctaacccgtaaccgttaccctaccctaactaaaccgtaaaccgaaccgtaccgtaaccttacgaggttacgggtacgtaacggtaccggttacgacccgttaagcctaacgttccgaggtaaccccgaccggtaacccgttccggttacttaactttaccggacgtaccggacggtaacgtaccgtaaccccgacggtcgggttaccgtacgaccggttaccctagggaccgtacggtcccgtttaccgtcggtacgttcccgggtacgg

SEQ ID NO: 209726 - DNA, 759 bp, Homo sapiens
  misc_feature: GYAE6OF02GKOLU.17.25.C03.1.454.CMB.1.raw
  modified_base (184)..(184): a, c, t, g, unknown or other
  misc_feature (184)..(184): n is a, c, g, or t
tcagcgtagactagcacgaccggtgctcgatttagtagtgtagatttgggtttggggactcaacaaccacatctgtcctctagagaaaaccctatgagcacagctcctcaccatggactggacctggaggatcctcttcttggtggcagcagctacaagtgcccactcccaggtgcagctggtncagtcgtggggctggaggtagaagaacgccgtggggcctcagtgaaggtctcctggaccgaaggtcttcgtggtacttccgtaccgttttaccctccttatagtactacaacggttgggtgccgtaccgacggtcccgcgttacggaacctaaccggaccttgtaacgttgggaacgtggggacgttcggggaacctaaaccccgtaacgtaccgttgggtaccgtacaacgtcgttcgttccttaccacccgtaccgttcccggtaccgggaacctaacgtaaccttacccgagttaccgaacccgtaaccgtaaccctaccctaactaaaactaaccgacgacttacccgaagtaggtacgggtaagttacggacggtaccgtaccgtacgaccgttacgtacggtaaccggtaccgtaacccgggacccgggtttcccttaacgtttaacggttaaccgttcggacggttaccgaccggtacccgaccgtaaccgtaccgggtaccgtacggtacccgaccgtaccggcgtccggttacggttcccttaggttcccggtacgggtaccgggg

SEQ ID NO: 209727 - DNA, 592 bp, Homo sapiens
  misc_feature: GYAE6OF02FPOWB.17.25.C03.1.454.CMB.1.raw
  modified_base (131)..(131): a, c, t, g, unknown or other
  misc_feature (131)..(131): n is a, c, g, or t
  modified_base (162)..(162): a, c, t, g, unknown or other
  misc_feature (162)..(162): n is a, c, g, or t
  modified_base (176)..(176): a, c, t, g, unknown or other
  misc_feature (176)..(176): n is a, c, g, or t
  modified_base (207)..(207): a, c, t, g, unknown or other
  misc_feature (207)..(207): n is a, c, g, or t
  modified_base (231)..(231): a, c, t, g, unknown or other
  misc_feature (231)..(231): n is a, c, g, or t
  modified_base (277)..(277): a, c, t, g, unknown or other
  misc_feature (277)..(277): n is a, c, g, or t
  modified_base (290)..(290): a, c, t, g, unknown or other
  misc_feature (290)..(290): n is a, c, g, or t
  modified_base (301)..(301): a, c, t, g, unknown or other
  misc_feature (301)..(301): n is a, c, g, or t
  modified_base (308)..(308): a, c, t, g, unknown or other
  misc_feature (308)..(308): n is a, c, g, or t
  modified_base (313)..(313): a, c, t, g, unknown or other
  misc_feature (313)..(313): n is a, c, g, or t
  modified_base (315)..(315): a, c, t, g, unknown or other
  misc_feature (315)..(315): n is a, c, g, or t
  modified_base (328)..(328): a, c, t, g, unknown or other
  misc_feature (328)..(328): n is a, c, g, or t
  modified_base (336)..(336): a, c, t, g, unknown or other
  misc_feature (336)..(336): n is a, c, g, or t
  modified_base (354)..(354): a, c, t, g, unknown or other
  misc_feature (354)..(354): n is a, c, g, or t
  modified_base (572)..(572): a, c, t, g, unknown or other
  misc_feature (572)..(572): n is a, c, g, or t
tcagcgtagactagcacgaccggtgctcgatttagtagtgtagatttgggtttggggactcaacaaccacatctgtcctctagagaaaccctgtgagcacagctcctcaccatggactcggacctggaggntcctcttacttggtggcagcagcacaagtcncccactcccaggtnccagcctggtctcagtctgggctgacgtganagccgtggggcctgagtgaggtcncgtgacagtccttgagactcacttacctctactagtatcaagtggngcgcctagccgtncgacacgacgngtagtgngaggngnggaccgaacctanacgtgtcncagtagctctccaccgtntccgtacggactagtacttacccgataccgaccgtaccgaactccctaactaactaaacccacgaaccgtacctaaccgtagtacggtagttagacgggtacctaccgtcgtactagttccaacgacgtcccgtaccggtacttacgtctaacgtcggtagccgtaagtcccgacccacgtacggcgacggtccaccggtgtaccgcggtacccgttntaccgttcgagtacccgggg

SEQ ID NO: 209728 - DNA, 933 bp, Homo sapiens
  misc_feature: GYAE6OF02HGEOC.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctgggaggactcctcttcgttggtggcagcagctacaagtacccactccaggtgcagcgtggtgcagtcgtggggctggagggtagaaggaacggccgtcggggtcctcgtaggtaggacggttcctcgtgaccgtaaggtccttacgtaggtactttaccgtaaccgttttaccctaccttagttaacgttacgtaccgtaacggttcggggtcgtacccggccggtaacggccccggtacggttacgggaacctaaacccggtacccgtaggggtaaggttacggggtaaggttcggggaaggttacccggggaaacccgtaaaacccgttaaccgtaccggtagggtacctacgtaaacggtacggttacgttacccttacccgtaaccgtacccggtaccggaccgggtaacctaacggttaaccttaaccgaacgtaccgaacctaaccgtaaccctccgtaaccaaacgtaaacccacgtaaccgtaaccgtacgtaacggttacgggtaaggttaacgggaacggtaccgaccgttacgtaactaaccgtcggtaaccggaaccggtacccgtacccgggttaccgttaaccgtttaaccggtttaccggttacgggtaaccggtaccgggtaacggtaaccccggtaccccggtaacgggttacccgggttaacgggtcccgggttaaccggtaaccccgggttaaccgggaacccggttacccggggtttacccgggtttacccggtttttaaaccggggtacccggttttaccgggggtaccggggggttaaaccccggg

SEQ ID NO: 209729 - DNA, 941 bp, Homo sapiens
  misc_feature: GYAE6OF02IKJHD.17.25.C03.1.454.CMB.1.raw
  modified_base (131)..(131): a, c, t, g, unknown or other
  misc_feature (131)..(131): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctaaaggnggactcctcttcttggtggcagcagctacaagtcgcccactcccgaggtgcagctggtcgcacgtcgtgggctggaggtcgaaagacgccgtagggcctacgtaggtacgtaacgttccgtccgtagaccgaacggttcttcgtagggttacttaccgttaaccgttttaccttaccgttaagttaacgttacttaccgtaaacggttcggggtccgtaccggtacccgaaacggggttccccgaacggtttaccgggtaaaccgtaacccggtaccgttagggtaaacgggtttccggggaaggtttaccgggggtaacgttccggggggtaaacccttaaaacccccgtaaaacggttcgggtttaccgggttacgtaccccgtaaacggttccggttacgggtttacccctttaacccgaaccccgtttaccgtttaccccgggaaccggggtaaactaacccggggtttaaacccttacccgtaaaacgtttccggtaaaaccccgaaacccgttaccccgttacccctaaccggttaaaacctaaacccggtaaccgtaaaccgttaccgtttaaaccgcggttaaaccgggtttaaggttaacccggaacgggtaccgtaaccgttcgaaccgtaacgttaccggtaccgaaccgaccgtacgggtaccgttacgtttaacgtacgtttacgacggtaccgttaacgccgttaacccgacgtacggttacccggcggttacccgtacgtacgggtacctccggggtacccgttactttaccgggtacccgttaggtacccgggg

SEQ ID NO: 209730 - DNA, 691 bp, Homo sapiens
  misc_feature: GYAE6OF02IGHKF.17.25.C03.1.454.CMB.1.raw
  modified_base (269)..(269): a, c, t, g, unknown or other
  misc_feature (269)..(269): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtcgcagctgggtgcagtctggggctggaggtgaagagccgtgggcctgagtggagtctctgcaggtcttctgtattctactttacctctatagtanctaagtggcgccgccgaacggccgtctacggacgaaccgacgtaggaggtacggaggtacgggtcgacgggtaacccgaaaacccctaacgtacggtggttacgactacgacgttcgtacgttcccaacctaccggtccgtaccggaactacgtacccttacgagtaaccgaacccaacgtaaccgtccctaacgaactaaacaccgtacacctaacgagtaggtacgtaggaccgtagtacctagtaaccgattacgtaccgacggaaccgaccggttcccgttaacttacgtaccgttacggcgtaacgaccgtaccgtaaccccggtagtaacccggtaccgggttaccgaccgttaacccgtacggacccggtaacgggttcccgttacccggtcggttaccgtacggtacccggggg

SEQ ID NO: 209731 - DNA, 586 bp, Homo sapiens
  misc_feature: GYAE6OF02FY6M8.17.25.C03.1.454.CMB.1.raw
  modified_base (365)..(365): a, c, t, g, unknown or other
  misc_feature (365)..(365): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcacgtgaaggtctcctgcaaggcttctggattcacgtttacctctatagtatcaactgggtgcgccaggccgcgtcggacaacggacctgagtggatggggatgggcgaaccctaacgactggtgtcacagtgtcttcacccatccncgggacagactaccatcgacacgtaactcctccaataaacacacgccctacaagtggtaagttaggagtacgcctgactactcgtagaccgtagaccggccgtcttacgttactcggttcgcggacgtagtccccgaacggtctacccgggttggaccggttacccgtacgggccgacggcccgggttcccttttacggacccgtttcggtacccgggggg

SEQ ID NO: 209732 - DNA, 826 bp, Homo sapiens
  misc_feature: GYAE6OF02HLNCW.17.25.C03.1.454.CMB.1.raw
  modified_base (157)..(157): a, c, t, g, unknown or other
  misc_feature (157)..(157): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctacttcttggtggcagcagctanaagtgcccactcccaggtgcagctggtgcaggtcgtgggctggacggtgaagagccgtggggcctcgacgtagacggtctaccgtgactacggacttcgtaggtacttccgtacgtttacctccgtaataggttactacgtaacgtgggtcgaccgccgtacggccgtcgttacgggaccaaccgtacctaggacgtagggtacgtagggtacgtacgggggaaccctaacccgttaactacggtcgggttacgaccgaacggttaggtttaccggtaccctttacccgtaaaccccgtaacgttcccggtacccggggtaactaaccggttaaccttaaccgtaacgtaccgaaacccgtaaccggttaccctacccgttaaacccgaaacttaaacccaccgtaaccgtaacccgttaaacggtacgttacgggtaacgggttacgggaacgggttacccgtacccgtaaggtacctacggttaccgacgggttaaacccggtacccggtaacccgttccgggttaacttaacggtttaccgacggtaacggtacgacggttacccggtaaccgtacggttaccggtaccgggtacgtaacccgggtccgtaccggtacgaccggttccgttaccggtttacccggtaccgggttcgtacccggggg

SEQ ID NO: 209733 - DNA, 668 bp, Homo sapiens
  misc_feature: GYAE6OF02H0GJI.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctctttcttggtggcagcagctacaagtgcccactcccaggtgcagcgtggtgtagtcgtggggctggaggtgaagaacgccgtggggcctcagtgtaaggtcctcctgcgaaggtcttcgtggtacttctaccgtttacctccttatacgtatacacgttgggtcgccgtccgacggcccgtcgtaggaccaacggaccgtggaggtggagtgggagtcgggaccgtaacccgtacgacgtcggtcgtaccgacgtacgttcgttccttcgaccctacgtcccgtaccgggacacgtacttaccagtaccgacctaaccgtaccttaccctacctaactaaaccaccgactaccctaacgaaggtagggtagttacggagggtactaccgtacgaactacgtccgtagaccgaaccgtacccgggtaccttattacgttacttggcgaccgtagacccgtccgacgtacgtccggtcgacgccggtaacgccgtaggtcccgtaccgtttacggacgttccgggacggtaccgg

SEQ ID NO: 209734 - DNA, 697 bp, Homo sapiens
  misc_feature: GYAE6OF02FH55V.17.25.C03.1.454.CMB.1.raw
  modified_base (305)..(305): a, c, t, g, unknown or other
  misc_feature (305)..(305): n is a, c, g, or t
  modified_base (652)..(652): a, c, t, g, unknown or other
  misc_feature (652)..(652): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtagaagaacgccgtggggcctcgaggtagaaggtctccgtgacgaacggtcttcgtggacttccacgtttaccctcctaagtagttactacaacgttggggtcnccgccgaggtccgcgttacggaaccaaaccgtaccgtggaaggttggaacgtgggggtactcggggaacccaaaccccgttaagacgttgggtcgtacaacgtcggtcgttccttacgaccctacgttcccgaccgggaactacgtaacctttacccgagtaccgaaccgtaaccgtaaccctcccgtaacgaaactaaaacccgactaacgtaccctacacgttaggttaacgtggacggacgtcccgtagtaactacgtacctacggaccgtaccaccgggtccgtatttaacgtcgtgtaccggacgtacggaccgtaccgaaccgtacggtcccgtggtaccnccggtaacgcgcggtaccggttccttacggtccttaggcccgggg

SEQ ID NO: 209735 - DNA, 632 bp, Homo sapiens
  misc_feature: GYAE6OF02F014H.17.25.C03.1.454.CMB.1.raw
  modified_base (312)..(312): a, c, t, g, unknown or other
  misc_feature (312)..(312): n is a, c, g, or t
  modified_base (483)..(483): a, c, t, g, unknown or other
  misc_feature (483)..(483): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtgcagcagctaacagtcgcccactcccgaggtgcaggcccgggtgctagtccgtggggtctggaggtaggaagagccgtcggggcctacgaggtgtaacggtcctccgtgaccgaggtcttcgtaggtacttcctcgtttacctccttagtagtactctaacgtggtcncgccgcgcgctacggacacgcgtggagtggagtgggagtacggacccgtaacctacgtacgtgttcgtcaacgtcgtcgttcctcccaccgtcgtccgacggactacgtactcgatcgacctactaccgtacctacaacaacgactcgtaccacgtagttcggaagggttnaaggaccgttcgacgaccgtgtcgtaccgaacggtaacgtcccggtttactactttacgtacgttggaccgtaacgtaccgacgttaccgagtcccggtggtcgtacgccgtacgtgaccgttcggtctacggtcgttcgcgggtaccg

SEQ ID NO: 209736 - DNA, 775 bp, Homo sapiens
  misc_feature: GYAE6OF02G73OV.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatgactggacctggaggatcctcttcttggtggcagcagctacaagtcgcccactcccaggtcgcagctggtgcagtcgtgggctgaggtagaagagccgtgggcctcgaggtagacggtctccgtcgacgaacggtcttcgtaggtactttacctaccgttttaacctcctaataacgttactacaacggtggtcgccgaccgtacgggcccgtacgtacggaacctaaccggaccgtaggaggtggtaggtgggaagtcggggaacccgtaaacccttaacgtccggtaggtacgtaccgtaagtacggttccgttaccttaccgaacccgttacgtccccggtaaccgggtacaaaccggttacccttacgaacgtttaccgaacccgtaaaccgtacctaccctaaccgtaaactaaaccgactaaccgtaccctaaggtacgttagggtaagttcggacggtacgtaccgtaactacctagttaccgtaacggtaacccgtaccggtaccgggttccgttaacttacgtttaaccgtcggtaccggtacgtaccgtaccgtacccgtaacggtccgggttccggtaacgtacccggttaccggtaaccggtcggtaccggtccgtttaccgggttacttaccgggtacgtacccgggg

SEQ ID NO: 209737 - DNA, 640 bp, Homo sapiens
  misc_feature: GYAE6OF02GQ5LE.17.25.C03.1.454.CMB.1.raw
  modified_base (248)..(248): a, c, t, g, unknown or other
  misc_feature (248)..(248): n is a, c, g, or t
  modified_base (287)..(287): a, c, t, g, unknown or other
  misc_feature (287)..(287): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacagtgcccactcccaggtgcagctggtgcagtcgtggggctgaggtgaagaagccgtgggcctcgagtggaacggtctcctgcaaggcttcgnggattcacgtttcctactatagtatactaacgtgggtcnccgccgacggccgctcggacaaccgtaccgtagacggtggagtcgggagcgggacgaaacccgtacgacgtggtcgtacacgagttcgtcctaccgaccctacgtcccgtaccgggactacgtaccgttaccgagtcgaacctaccgacctccaccaaactaaacaccgtacgacctaacgacggtaggtacgttaggacgacgtcccgtagacctatcgtacggaccgtaccgaccggtcccgttattaacttcgtaggtcgaccgacgacgtacccgaggtaccgtccggtagaacccgtccgttaccggcgtaccggtcccggttcgtttacgtacgtccggtaccgggg

SEQ ID NO: 209738 - DNA, 652 bp, Homo sapiens
  misc_feature: GYAE6OF02GRO37.17.25.C03.1.454.CMB.1.raw
  modified_base (351)..(351): a, c, t, g, unknown or other
  misc_feature (351)..(351): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaaggcctggggcctcgagtgaaggtctcctgcaaggctttcgtggacttcgtaccgtttacctcctaagtagttatacgaacgtgggtacgtcgaccgaggtcccgctaggacgtaacggccttggagtggagtaggggaaggnttccgtcctagtcgttacgaccgacaaccaactacgcaacagacgtcgaggacactacaccacacgaacgacgaactaaactaacaacgaactaacgttaactacgtaggacgtacgtacgaacacgaccgtagtactattacggtacgacggacgaccggttacgtttaccttacgttccgttacgtggaacgggtacgtaagttaacttaataacgttaaactacgttacgtcttttacccgttttaccttaccgtttaccctttagttacctttacggttaccggtccgtaacccggg

SEQ ID NO: 209739 - DNA, 788 bp, Homo sapiens
  misc_feature: GYAE6OF02GOSN6.17.25.C03.1.454.CMB.1.raw
  modified_base (248)..(248): a, c, t, g, unknown or other
  misc_feature (248)..(248): n is a, c, g, or t
tcagcgtagactagcacgaccggtgctcgatttagtagtgtagatttgggtttgggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcgagtgaaggtctcctgcaggcttctggnttcacgtttacctcctatagtatcaatgggtgcgccgaggccgctggacaacgacctggagtggagtgggatgggaccgaaacccctaagacgtggtcgtaccacgtagtcgttccttccaaccccacgttcccgtaccggggaacctacggtaaccctttacccgaagtttaccgaaccccgtaaaccgtaaaccccttacccgttaaccccaaaacgttaaaaacccaacccgtaacggtaccccttaaaccgacgtttacggggtaacggtttaacgggaacgggtaaccggtacccgttaacggtaacctacgttaccgttacggaacccggtaacccgtaacccggggttcccttacgtttaaacgtttccgttacggttaccggaccggtaacggtacccggttaccccggaacggttaaccggttccccgggttaggtaacccggtaccccggttaacgggacccgttacggggtaccccgggtttccccgtttttaacgggtccccggttttaccgggtaccccgggggggg

SEQ ID NO: 209740 - DNA, 832 bp, Homo sapiens
  misc_feature: GYAE6OF02I5QP8.17.25.C03.1.454.CMB.1.raw
tcagcgtagactagcacgaccggtgctcgatttagtagtgtagatttgggtttggggactcaacaaccacatctgtcctctagagaaaaccctgtgagcaccagctcctcaccatggactggacctggaggatcctcttcttggtgcagcagctacaagtgcccactcccaggtgcagctggtgcagtcgtgggctggaggtagaagaacgccgtgggcctgagtcgaacggtcctccgtgcgaaggtcttcgtggtacttaccgtaccgttttaccctactagttagtacttaccgaacggttgggtcaccggccgtaacgggcccgaccgtaggaacccaacgtccgtaggaggtcggaagtgggtaacgtcggggacccgtaaacctaacggtcgttacgggacttaccgagtaggtttaccgtccttacccacccgtaacgttcccggtacccggggaactacggtaccccgtttaacccgagtttaacccgaaaccccgtaaccgtaacccgtttacccctaaaccgtaaaaccttaaaacccgaacccgtaaccgtaaccccgttaacgaacggttccgggtaaaggtttcggaaaccgggtacctaccccgttaagacccttagttacccggtaagggtaaaccccggtacccggtacccgggtttaaccggttaacccgtttaaacggttaaccgttcggttaaacggacccggtacgtaacccgtacccggtaaccggtaacgtccccgggttaagacccgttacccggagggaaccgtcgggttacccgtttccgttaccggttcgtacccgggtaacgggg

SEQ ID NO: 209741 - DNA, 696 bp, Homo sapiens
  misc_feature: GYAE6OF02H732A.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggacggtgaagagccgtggggcctcagtgaaggtcctctgacgaaggtctttacgtggtacttaccttaccgttttaccctaccgttaattacgttacttaccgtaaccgttggggtcgccggaccgtacggcccgtacgtacggaaccgaaccgaccgtcggaggtcggaagttcggggagtcggggaccgtaaaccctaacgtcgtggtacgttacacgtagttcgtccgttaccaaccctcgtcccgtaccgggaactacgtaccttaaccacgtaccgtaaccgaccgtaacccgtaccctacctaaacctaaaccaaccgacgtaccctaacgtacgtacggtagttacggaggtacgccgtgactactcgtacgacgacgtaccgtccgttacttacgtcgtgcgtacgcgtaccgacccgtacgaacggtccggtacgaccgtcccgacggacgtacggtcccggttcgtttacgtccgttcgggtacccggg

SEQ ID NO: 209742 - DNA, 725 bp, Homo sapiens
  misc_feature: GYAE6OF02JVTEP.17.25.C03.1.454.CMB.1.raw
  modified_base (185)..(185): a, c, t, g, unknown or other
  misc_feature (185)..(185): n is a, c, g, or t
  modified_base (334)..(334): a, c, t, g, unknown or other
  misc_feature (334)..(334): n is a, c, g, or t
tcagcgtagactagcacgaccggtgctcgatttagtagtgtagatttgggtttggggactcaacaaccacatctgtcctctagagaaaaccctgtgagcacagctcctcaccagtggactggacctggaggctcctcttcttggtggcagcagctacagtgccccactcccaggtgcagctggtncagtcgtggggctggaggtgaagatccgtggggcctacgaggtcgaaggtcctcctgaccgaggtctttcgtggtacttacctacggttttacctccgttaagttacgtacttaccaaggttcgggtcgcccgtacccgagggtccccncggttaacgggacccaaaacccggttccgtaagggtccggttagggaggttaccgggggtagtaccggggaacccgtaacccctaaaggtccggttgggtccgttacgaaccgttgtaccggttcctaccggaccctacggtccgaaccgggtacacgttacctaccgtactcggaaccctaacgacctccgtaacctaagtaacccacgtaacacctaacgtaggtaaggtacggttacgacggtacccgtcgtacgtacctcgtacgtacgaaccgtaccgaccgggtccttacgttaaacttcggttacgacgagtaacccgtcgtaccgtacgccgttacgtcgaacgtccgcgtacgcgtaccgtcgttacgtcgtacggtccggg

SEQ ID NO: 209743 - DNA, 723 bp, Homo sapiens
  misc_feature: GYAE6OF02GEHOT.17.25.C03.1.454.CMB.1.raw
  modified_base (250)..(250): a, c, t, g, unknown or other
  misc_feature (250)..(250): n is a, c, g, or t
  modified_base (361)..(361): a, c, t, g, unknown or other
  misc_feature (361)..(361): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctgaggtgaagagccgtggggcctcagtgaaggtctccgtgacaaggtcttcgnggtacttcgacgtttacctcgtatagttactcaacgtgggtgccgtccgacgggccacgtacggaacaacgacctggacggtgggatcggggagtcgggacaacccgtaanacgtggtacgtacacgtagtcgtaccttacgacccgtatcccgtcgggaactaagtaccttaacgataccggaaccaaccgtaacctccgtaacctaaagtaaaccgactacgaccctaacgaagtcggtaacgttacggacggagtcccgtaagtacctagttccgtacggtaacccgaccgtaccggtaccgtttacgttaacgtttacggtccggtaacggtaccggtaacgtaacccggtaccccgtaaggggtaaacccgttccgggtacgggtaacccgtacccgggttacggaacccggaacggggttccccgttaccggtttttaccgggtaaccttccgggggtacccggggg

SEQ ID NO: 209744 - DNA, 761 bp, Homo sapiens
  misc_feature: GYAE6OF02H1IEW.17.25.C03.1.454.CMB.1.raw
  modified_base (254)..(254): a, c, t, g, unknown or other
  misc_feature (254)..(254): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggactcctcttcgttggtggcagcagctacaagtcgcccactcccaggtgcagctggtgctagtcgtgggctggaggtagaagagccgtgggcctcgagtgagtctccgtgacgaaggtcttcgnggtattccgttaccgtttactactagtagtactctaaggtgggtgtccggaccgtaacggcccgacgttacgggaaccaaccgtacggtggtaacggtgggtaacgtcgggggtagtaccgggggaaccaaaccccgtaacgtacggttcggttacgaccgtaacgtacgttccgttcgtaccctaaccccgtacgttaccccgggtaccggaaccgtaaccgtaccgttaaccacgtaaccgtaacccgaaccgtaacctaccctaacgtaaacttaaacccacgtaacgtaccctagtacgtggtaacgtggaacggtactaccgtaagacgtaccgttcgtaccggaaccgaccggtcccggttaaccgtcgttaaccgttggtacggtcttaacgggaccgtaccgtaccggtaccgtaacgggtccggacggttaccgtaccggtacccgggcgtacccgggttccgttaccgtttacggttaccggtcggggtaacccggg

SEQ ID NO: 209745 - DNA, 603 bp, Homo sapiens
  misc_feature: GYAE6OF02JTTP0.17.25.C03.1.454.CMB.1.raw
  modified_base (305)..(305): a, c, t, g, unknown or other
  misc_feature (305)..(305): n is a, c, g, or t
  modified_base (318)..(318): a, c, t, g, unknown or other
  misc_feature (318)..(318): n is a, c, g, or t
  modified_base (380)..(380): a, c, t, g, unknown or other
  misc_feature (380)..(380): n is a, c, g, or t
  modified_base (416)..(416): a, c, t, g, unknown or other
  misc_feature (416)..(416): n is a, c, g, or t
  modified_base (455)..(455): a, c, t, g, unknown or other
  misc_feature (455)..(455): n is a, c, g, or t
  modified_base (485)..(485): a, c, t, g, unknown or other
  misc_feature (485)..(485): n is a, c, g, or t
  modified_base (489)..(489): a, c, t, g, unknown or other
  misc_feature (489)..(489): n is a, c, g, or t
  modified_base (522)..(522): a, c, t, g, unknown or other
  misc_feature (522)..(522): n is a, c, g, or t
  modified_base (543)..(543): a, c, t, g, unknown or other
  misc_feature (543)..(543): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacgaagtgcccactcccaggtcgcagcgtgggtgcgagtcgtggggctggaggtagaagaacggccgtcggggcctcgaggtgaaggtctcctgcaaggtcttcgtggtacttcctacgtttacctctaagtagtatcgtaacgtgggtanccgcgacggccgngtcggaccaaccgcgtagaggtggagtcggagtacgggaccaaccgtaacgacgtcggtacnctagtacgttctcctacacctacgtccgtaccgganacgacctacgatccgacaacgtacctcctaacaacaacnctacgactacagttgagttgaacgctcganaacngtcgtagacccgacgccgtcttaccagtttacngtcgactacggacctaccggngtacggtacgtcgacgtcccgaagccgtacgcccgttcgtttcgaccgttggtaaccggg

SEQ ID NO: 209746 - DNA, 793 bp, Homo sapiens
  misc_feature: GYAE6OF02H3ML9.17.25.C03.1.454.CMB.1.raw
  modified_base (351)..(351): a, c, t, g, unknown or other
  misc_feature (351)..(351): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcgagtgaaggtctcctgcaaggtcttcgtggattcacgtttacctccttatagttatcaacgtgggtcgcgccgaggccgcgtcggacaacgacctggaggtggagtgggagtcgggaccgtaaccctaancgttggtcgtcacgtagtttgttccttaccaccctacttcccggtaccgggaactacggtacctttaaccgagttaccgaaacccctaacgtaaccccttcccgtaaccctaaacttaaaaacccgacctaacggtaacccccttaaagaacggtttacggggtaaacggtttacggggaaacgggaccgtacccgttaaggaaccctaagtttacccgtacgggaaacccgtaacccggtacccggggttaccccgtttaacttaacgtttaaccggtcggttacgggaaccgggtaacgttaccccggtacccccggtaaggtaaccggtttccccggggtaatacccgggtaaccccggttaaccggggaccctaaccggggttccccgggtttaaccccgttttttagggaccccgttttccgggggaacccgggggg

SEQ ID NO: 209747 - DNA, 610 bp, Homo sapiens
  misc_feature: GYAE6OF02F6J1B.17.25.C03.1.454.CMB.1.raw
  modified_base (279)..(279): a, c, t, g, unknown or other
  misc_feature (279)..(279): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaggtctcctgcaaggcttctggacttcacgtttacctctatagtatcaacgtgggtncgccgaggccgcgtggaacaaccgtacctggaggtggatggggatcggggaccgaaaccctacgacgtgggtcgtacaacgtgttcgtccttaccaccccacgttacccgtacccggggaacacgtacctttaaccagtaccgaccgaaccgtaactcccgtaccaaactaaacaccacgacctaacgagtaggtagttgaggacgcctagactatcgtagacgacgaccggtcctacttagttacgtcgtgaccgtagaccgtacccgaggtcggtaccggtgaaccgtcccgaggcacggtccgtacctttcggacgttcggaccgggg

SEQ ID NO: 209748 - DNA, 835 bp, Homo sapiens
  misc_feature: GYAE6OF02HWWOC.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggagcatccttttcctggtgcagcaggcacaggtgcccacgcccaggttcacgttggtgcagacgtggggtctggtaggtgcgaggaacgccggtggggctagtcgagtgacgttcgtctccgtgacgaaggccaggttaggactagttactacttacaacgtaaaagtattaggtaagttagtaacggttttgggacgtaccggtaacgtaccgggtacccccggtaaacgtaaggggtcctttagggtaagggttcgggggttggggggtcggtaaccgtagggttccggttaccggtttaggggtaaccgggtaacggtaccggtaaacgttaggtaacggtaccggaacccgtaaccgggtaaaggtacgttaacgggggaaaccggaggtaaacggtacggtaaccgtttaacccggtaacggttaacccgtaaaccgggaaccccgtaacccccggtaaacccggaaaccgtaccgtaacgttaaccgtaacgttacgtaccgtaacggaaccgtacgacggtaccgacgtacgacggtacgacgacgtacggaaccgaccggtaccgttactaaccgttaggttacggtacggtacgtacgttaacggtttcgttttacggtaccgttacgtaaccggtttacccgttaacgtttacgtttacggacggttaaccggtttacgttaccgttaggttacccggg

SEQ ID NO: 209749 - DNA, 861 bp, Homo sapiens
  misc_feature: GYAE6OF02H9P9N.17.25.C03.1.454.CMB.1.raw
  modified_base (190)..(190): a, c, t, g, unknown or other
  misc_feature (190)..(190): n is a, c, g, or t
  modified_base (242)..(242): a, c, t, g, unknown or other
  misc_feature (242)..(242): n is a, c, g, or t
  modified_base (313)..(313): a, c, t, g, unknown or other
  misc_feature (313)..(313): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctctttcgtggtgcagcagctacaagtcgcccactcccaggtgcagtcgtggtgacngtcgtgggctggaggtgaagacgcgtgggcctacgaggtgaacggtctaccngacgaggtcttcgtaggtacttccgtaaccgttttacctacgttaatacgttacaccgtaagttggggtcnccgacgacggccgtacgtaacggaacctaaccgggtacctaggaggtggtaggtacggggtaacggtcggggaaaccctaaacccgtaacgtcggttacgggtactaccgtacgtaggtccgtttaccgtacccgtaaaccccgtcgtaccccgggttaccccggggaaactaaccgtaaccgttacccgtaagtacccggaaacccgtaaccgtaacccttaccctaaaccggttaaacaaaaacccgtaccgtaaccgtacccttaacggtacttaacggttaacgggtacggtacggtaccgtacccgtaggtaactaccgttacgaaccggtaacccggacgtaacccgggttaccgttaacgtttcccggtttaccgttacggttaccggaagtttacccggacccggttaccccgttaacgggaccccggttaaccgggtccggtaaacccggtacccggtttacccgggaaccggtttaaccggttccccgggtttaacccgttttacggttaaccccggtttgggggtaaccccgggggg

SEQ ID NO: 209750 - DNA, 820 bp, Homo sapiens
  misc_feature: GYAE6OF02JGK76.17.25.C03.1.454.CMB.1.raw
  modified_base (184)..(184): a, c, t, g, unknown or other
  misc_feature (184)..(184): n is a, c, g, or t
  modified_base (304)..(304): a, c, t, g, unknown or other
  misc_feature (304)..(304): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtncagtctgggctgaggtgaagaagccgtgggacctcagtgaaggtcctcctgcgaaggtcttctggtattacctacgtttacctaccgtactagtatcaacgtggtagcgccacgggcccncgtacggacaacggtaccctggtaacggtgggtacgttagggacgttacggggaacccgtaaaccccgtaacgtaaccgttcgggtacggtacctaacgtacgggtttacgttccgtttccgaaccccctacggttaccccggttaccccggggaacgtaaacggttaaccccgtttacccgaacgtttccggtaaaccccgaacccggttaaacccgttccccttaaccccgaaacttaaaacccgacgtaccgaacccgttacaacggttacggacggtttagggaagtacccggtcctaacgtacctattaccggtaacggtaaccggaacccggtaccgggtcccggttaactttacccggttaaacggtcggtaccgggtaacgaacgggttaccgttacccccggaacgtaaacccggttcccggtaaggtacccgttacccggtaggtacccggtaccgggtacccggtttaccccttgggttacccccgtttggggtaaccccggggg

SEQ ID NO: 209751 - DNA, 696 bp, Homo sapiens
  misc_feature: GYAE6OF02ICJJ3.17.25.C03.1.454.CMB.1.raw
  modified_base (178)..(178): a, c, t, g, unknown or other
  misc_feature (178)..(178): n is a, c, g, or t
  modified_base (384)..(384): a, c, t, g, unknown or other
  misc_feature (384)..(384): n is a, c, g, or t
  modified_base (423)..(423): a, c, t, g, unknown or other
  misc_feature (423)..(423): n is a, c, g, or t
  modified_base (528)..(528): a, c, t, g, unknown or other
  misc_feature (528)..(528): n is a, c, g, or t
  modified_base (632)..(632): a, c, t, g, unknown or other
  misc_feature (632)..(632): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagactacaagtcgcccactcccaggtncagctggtgcagtcgtggggctggaggtgaagacggccgtgggcctgaggtgacggtctcctggacgtaaggtcttcgtggtactttaccgtaccgttttacctcctaatagtatcgtaacgtggggtcgccggccgacggcccgtgacggaacctaaccgaccgtggacgtggaagtcgggagtacgggacccaaaccgttaacncggttggttcgaccaacgtgtcgttcctacccgtacccncgtttcccggaccggaactacgttacccttacgacgtcgaaaccctacgtacctcccgtaactaaactaaccagacctaccaacaggtggtaagtacggacggtntaccacgactagtcgtacggaacccgtaccgtaccgggtccttacgttacgttacggtcggtacgacggtacggacccctcccggacgttacggtcccgggtanacccgggttaaccgaccgggcgaaccgggttcccgtttactttcggtaccgttgggacccgggg

SEQ ID NO: 209752 - DNA, 701 bp, Homo sapiens
  misc_feature: GYAE6OF02JDML7.17.25.C03.1.454.CMB.1.raw
  modified_base (292)..(292): a, c, t, g, unknown or other
  misc_feature (292)..(292): n is a, c, g, or t
  modified_base (359)..(359): a, c, t, g, unknown or other
  misc_feature (359)..(359): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacttaaaacctatttaaattggtatcagcaagaaacctaggaaaacgccccaagaccctccngaactctctggtgcatccactctagacgtaagtcggtccgtacccagtccgaggtttcaaggtgganaggtggacttcgtaggggaactaggtacttttacaaacgttcctactaacccactaccaaccctaccttccgtacgacctaaacccgtacgggtaaggtaacgtttacggtacggttaacctaagttacctttaaacgtaccgttacgtaaccgtaaacgtaacgtaacggtttaaccgtaaccgtttacccccgtacgtacccgttaaccgtttttacgggacccgtaacgggggtaaccctaaagggtttacgaacggtaacgttaacccgtaaaaccggtaaaccgttaggtacggtacgttacgacccgtaaccgtaacgttaccgttcgtttaaccg

SEQ ID NO: 209753 - DNA, 606 bp, Homo sapiens
  misc_feature: GYAE6OF02FZNEE.17.25.C03.1.454.CMB.1.raw
  modified_base (281)..(281): a, c, t, g, unknown or other
  misc_feature (281)..(281): n is a, c, g, or t
  modified_base (362)..(362): a, c, t, g, unknown or other
  misc_feature (362)..(362): n is a, c, g, or t
  modified_base (375)..(375): a, c, t, g, unknown or other
  misc_feature (375)..(375): n is a, c, g, or t
  modified_base (463)..(463): a, c, t, g, unknown or other
  misc_feature (463)..(463): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactccaggtgcagctggtgcagtctggggctgaggtgaagaagcctggggcctcgagtgaaggtctcctgcaaggcttctggtattctacgttacctctatagtatcaacgtgggngcgccgacggccgtcgtcggaccaacgaccgtggaggtggagtcgggagtcgggaccgtaacctaacgactggtcgtcacngtctcttcacccncgtccgtccggacacgtacctaccactagacccacgtaaccctcctacaactaaccactacgtactacacgtggagttagacgggacncccgtagacctagtccgtagaaccgtaccgaccgggtcttaccgttattacgtcgtacgacgacgtacgtcccgacgtacggtaccggtcggacacccgtacggcgttcggccgtttacgtccggtacgttcggtacccgggg

SEQ ID NO: 209754 - DNA, 709 bp, Homo sapiens
  misc_feature: GYAE6OF02JA844.17.25.C03.1.454.CMB.1.raw
  modified_base (233)..(233): a, c, t, g, unknown or other
  misc_feature (233)..(233): n is a, c, g, or t
  modified_base (295)..(295): a, c, t, g, unknown or other
  misc_feature (295)..(295): n is a, c, g, or t
  modified_base (494)..(494): a, c, t, g, unknown or other
  misc_feature (494)..(494): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacagtgcccactcccaggtgcagctggtgcaggtcgtggggctggaggtgaagagccgtgggcctgagtgaggtctccngacaggtcttcgaggtacttcctaccgtttacctaccttatacgtactactaacgtgggtcnccggtaccgacgggtccgtacgtacggaaccaaccggtacctggaggtgggtagtacggggagtcgggacccgaaccctaacgacgttggtcgacacgtagttcgtcttaccacccgtacgtcccgtacggactaacgtaccttacgactcgaaccaccgtaacctccctaacaactaaacctacaccgtacctaacgngtaacgggtacggtttaggaacggtacgtaccgtaccgactaccgtcggtaacggaacccgtacccgtaaacggtcccgtttaacgtacgttaccggtaggtaccgacggtaccggaccgttacccgaacggtacgttaccggtcggtaaccggacccgtacggaccgtacggtccggttacccggtttacgtacccggttacgggtacccgggg

SEQ ID NO: 209755 - DNA, 839 bp, Homo sapiens
  misc_feature: GYAE6OF02FZFA6.17.25.C03.1.454.CMB.1.raw
  modified_base (156)..(156): a, c, t, g, unknown or other
  misc_feature (156)..(156): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtgcagcagctanaagtgcccactcccaggtgcagctggtgcagtcgtggggtctggaggtgaagaacggccgtcgggggcctcgagtaggaacggtccttccgtagaccagggtcctttcgtgggtactttccgtaccgttttacccctccttaagttaacggttacttacgtaaccggttggggtcggaccggtcccgaccgggccgtcgggtacgggaacccaaccggtaccccgtgggtacgggtacggtaggtacggggtagttaccgggggaacccgtaaaccccgttaaccgtaaccggtcgggttacgtaccgtaaccggttaggttccgttacccctttcctaaccccgtacccgttaccccgggtaaccgggtaacgtacccgttaaccgtttaacccgaacgtacccggaacccgtaaacccgtaacccttacccctaacgaaactaaaaccgacctaaccgtaccctacgtaggtggtacggttaggacgaccgtaccgaagtacctagtccgtaacggaccgtaccggtacccggtccgttaacttaacgttcgttaggccgtaacgggttaacgtccgccccggaagggttaacccgtcggtaacccgacggttaccccgggacgaacgttccgggacccggtttttacccgtacgggttccggtacccggggtacccgggg

SEQ ID NO: 209756 - DNA, 634 bp, Homo sapiens
  misc_feature: GYAE6OF02JHKNU.17.25.C03.1.454.CMB.1.raw
tcagcgtagactagcacgaccggtgctcgatttagtagtgtagatttgggtttggggagtcagtctcagtcaggacacagcatggacatgagggtccccgctcagctccgtggggctcctgctactctggctccgagctgccagatgtgacatccagatcgacccagtcctccatccctcctgtctgcctcgtggtggggtcagacgtcacatcactgccggacagtcgacgtacttaaactattaatgtatcagcaagaacctaggaaacgcccaagaccctctgactcctgtggtcgccactccgctcgtgacgtaggtcggaccgtccagtcggtacgtacgtggtcggacgtaggtacggtactggtacgggtaactagtacgttactaacttcctaaccgtaccctactaccacccgtactcgtaccgacccgtacgtacggtagttacgtgtacgtacttaactcttaacctacgtactactaacgacgttacgttaccgtaacccgtttcccacgttccgttaccgttacggaaccggtacgggtaaccttaggttacgagtaacgttacaaaccgggttgtacggtacgtaccgtacgtaccctaacgttacttaccgttcttacc

SEQ ID NO: 209757 - DNA, 738 bp, Homo sapiens
  misc_feature: GYAE6OF02GOJ6P.17.25.C03.1.454.CMB.1.raw
  modified_base (271)..(271): a, c, t, g, unknown or other
  misc_feature (271)..(271): n is a, c, g, or t
  modified_base (294)..(294): a, c, t, g, unknown or other
  misc_feature (294)..(294): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgcagatgtgacatccagatcgaccagtctccatcctccctgtctcgcctctggtggggtcagagtccaccatcctacgttcggccggacaagtccaacggaccgttaaaaaccttagttttaaatggttactanagcgaagaaacctaggaaaaccnccccagtaccctcctgacttctacgtggtcgacactcactcgtggacgtaagtcggaccgtcctacgtggtacgttcgaggtcggactaggtggtaacttcggtaggtaacgtaagttacttttaaccacgtttccctaacaaccctacttacccgaccctaacctttcgtaaccgtacgttaaccggttaggaccgttacggttcggtacggtacttaaacgttacgtttaacctaccgttacgtaacccgtaacgttaacggtaacggttttaccctacccggtttaccccgtaccggttttaccgttaaccgtttccgggtaacggaacccgggtaaccgttaacggttacggaacttaaacgtaacccgtaaaaccggtagttaacggttaccggtaacgtcggtaaccctaccgtacgtttaccgttcgttttaccccg

SEQ ID NO: 209758 - DNA, 720 bp, Homo sapiens
  misc_feature: GYAE6OF02JFWZ1.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctgaggtgaagacgcgtgggcctcgagtgacggtcctcctggacgaaggtccttcgtaggtacttaccgtaccgttttaccctacctaagttagtactacgtaacgtgggtcgaccgaccgaggcccgtcgtacggaccaacgtaccgtggacggtggtacggtggggacgtcgggaccgtaaacccgtaacgtacgttcggtctccgacgtgtcgttcctaccacccgtacgtacccggtaccggacctaacgtaccgtaccgtacgtcgaaccctaccgtacctacccttaacaaactaaacccacgtacgtacctaacgagttacgggtaggtagaacggtcgccttagacctacgttcgtaccgacgacccgtaccgttccgtacttaaccgttcgtcggtagacgtaccggtaccccgtacccgtaacggttccggtaccgggtactacccgggttaacccgtacggtccggtaacggttccccggttaagttttcccgtacgtttcccgggtaacgggg

SEQ ID NO: 209759 - DNA, 834 bp, Homo sapiens
  misc_feature: GYAE6OF02JDF31.17.25.C03.1.454.CMB.1.raw
  modified_base (160)..(160): a, c, t, g, unknown or other
  misc_feature (160)..(160): n is a, c, g, or t
  modified_base (182)..(182): a, c, t, g, unknown or other
  misc_feature (182)..(182): n is a, c, g, or t
tcagcgtagactagcacgaccggtgctcgatttagtagtgtagatttgggtttggggactcaacaaccacatctgtcctctagagaaaaccctgtagagcacagctcctcaccatggactggacctgggaggactccttcttcttgggtgcagcagctanaagtcgcccacgtcccgaggtncagctggtgacacgtcgtgggctggaggtagaaggacgcggtcgggcctcgaggtacggaacggttcctacgtacgacgtaacggtcttcgtacggtacttacgttaccgtttacctacgtaattacgtacttacggtaaacggttcgggtaccaccggaccggaccggtcccgtacggtaacggtaaaccgaaccgggtaaccggttagggaacggttacgggaagggttacggggttaaacggacccggggaacccgtaaacccgtaaccggttacgttacgggttacctaccgttaacgggtacgtttacgttacccgttaacccgacccgtacgtttacccggaaccggtaaaccgtcttaaaccgttaccgacgtaacccgaacccgaacctaacccttacccgtaaaccgtaaactaaccggtaacctaccgtaacctaacgtaggtaacggtacggtaacggaacggtaccgtaccgtaacggtactcgtaccgtaacgaccgtaacccgggtaccgttacgttaaccgttacgttacggtcgacggtacgaccgtaccggtaccgaacgggttcgtaccgggtactccggaaccgtacggacgtcccgttaccggtactttccgggtaccggtaggtcccgggg

SEQ ID NO: 209760 - DNA, 614 bp, Homo sapiens
  misc_feature: GYAE6OF02FIW3O.17.25.C03.1.454.CMB.1.raw
  modified_base (285)..(285): a, c, t, g, unknown or other
  misc_feature (285)..(285): n is a, c, g, or t
  modified_base (323)..(323): a, c, t, g, unknown or other
  misc_feature (323)..(323): n is a, c, g, or t
tcagcgtagactagcacgaccggtgctcgatttagtagtgtagatttgggtttgggagtcagtctcagtcaggacacagcatggacatagagggtccccgctcagctcctggggctcctgctactctggcctccgagctgccagatgtgacatccagatgacccagtcctccatcctccctgtctcgcctcgtggtgggggtcagacgtccaccatcacttgccggacaagtcacggtaccttaaaacctatttaaagttggtatcagcagaaacctaggaaacnccccagaccctccagactctcgtgtgctatccacttcnggacgtaaggtcggcctcccgatcggtagttcaggtcggctaggtggactcgtagggactagtactttcaacttcctacacctactccaccctactctcgacctaaccgtagacgtattcgtacgactaacttctaacctactacgtacgaacgtaggtaaccgtttacgtaccgttacccgtacgtaccgttacgtttacgaccggtacgggtaacctaggttcgacgtaactaccgaaaccgtagtcggtacggaccgtacgacccgtacgacgttaccgtacgttacc

SEQ ID NO: 209761 - DNA, 663 bp, Homo sapiens
  misc_feature: GYAE6OF02IL3HV.17.25.C03.1.454.CMB.1.raw
  modified_base (187)..(187): a, c, t, g, unknown or other
  misc_feature (187)..(187): n is a, c, g, or t
  modified_base (261)..(261): a, c, t, g, unknown or other
  misc_feature (261)..(261): n is a, c, g, or t
  modified_base (636)..(636): a, c, t, g, unknown or other
  misc_feature (636)..(636): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtagacatccagatgacccagtctccatcctcctgtctgcctntggtggggtcagtcgtcacctatcagttgccggaataacgtcgacggtacttaaaacctatttaaagtggttancgagtacagtaaaccgtacggaaaacgccctaagaacccttccgtaggaacttctaccgttagggctactaacttccctacgttctacgggtacaacgggttcgtacccgtaccgttaagtcccggtaaggttaccaggtacggtcgtaagggtacgtgtaccggtaggaaccgtagtaatttcaaattccgtactaacgactaccgaacttaccgtacgtgaaccctacgttacgacgggttacttacgggactaaccgtaacttaccgttaacgtacgtacgttaaccaaccgtaagttaacgttacctaccggttaccctccttaacgcgtttacgacgacgtaaccgtagtagacgaatacgaaacgtacncgtagacttcgatacctgtatataccg

SEQ ID NO: 209762 - DNA, 807 bp, Homo sapiens
  misc_feature: GYAE6OF02I7OYO.17.25.C03.1.454.CMB.1.raw
  modified_base (170)..(170): a, c, t, g, unknown or other
  misc_feature (170)..(170): n is a, c, g, or t
  modified_base (188)..(188): a, c, t, g, unknown or other
  misc_feature (188)..(188): n is a, c, g, or t
  modified_base (195)..(195): a, c, t, g, unknown or other
  misc_feature (195)..(195): n is a, c, g, or t
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
  modified_base (292)..(292): a, c, t, g, unknown or other
  misc_feature (292)..(292): n is a, c, g, or t
tcagcgtagactagcacgaccggtgctcgatttagtagtgtagatttgggtttggggactcaacaaccacatctgtcctctagaagaaaaccctgtgagcacagctccctcaccatggacgtggacctgggaggactccttcttcgttggtggctagcagctacgagtcncccacgtcccgaggtgcngctggtnacngtcgngggctggtagngaagacgcgtcgggcctacgaggtgtaacggtcctccgtagacgaaggttcttcgtgtaacttccgtaacgtttaccncgttaacgtagtataccaacggttggtcggaccgcgtacggcctcgtacggcaaccgtcacggtgcggtaagtcgggtagaccgggtccaaacccgtactcggtaacggtcgtaaccgtacggtaacgtttccggtaccttaccccgtaacgtaccgttacccccgggtaagggaccttaaacggtaaaccgttcccgaagtttaaccgaacccgaaccggtaaacccctttccctaaacccgtaaaacccgttaaaccaaccgtaccctaacgaaccgtttaacggtacggtacgggtttaacggacggtaaacgttacccgagttaaccgtacttacccgggttaacgacccgtaaccggtaccggtaccccgtttaacgtttaacgttcgttaccggttacgaaccgtccgtttacccgggacctaccggtaacggttcccggtacaaccggtaccgtaaccggccggccgttccggtttcccggttacgttaccggtacggtaacccgggg

SEQ ID NO: 209763 - DNA, 582 bp, Homo sapiens
  misc_feature: GYAE6OF02FS8LN.17.25.C03.1.454.CMB.1.raw
  modified_base (283)..(283): a, c, t, g, unknown or other
  misc_feature (283)..(283): n is a, c, g, or t
  modified_base (294)..(294): a, c, t, g, unknown or other
  misc_feature (294)..(294): n is a, c, g, or t
  modified_base (341)..(341): a, c, t, g, unknown or other
  misc_feature (341)..(341): n is a, c, g, or t
  modified_base (486)..(486): a, c, t, g, unknown or other
  misc_feature (486)..(486): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagccgtggggcctcagtgaaggtctcctgcaaggcttctggattcacgtttacctcctaatagtatcaacgtgggtncgccaggccgntggacaacgactgagtggatgggatgggaccaaccgtacacgtggtntcacgtagtcgtcttacacccatccgacggacagaccttacgatcgacctacgaacctccgtaccaataaacacacgaccttacagtggtacgttagagcgtctagactactcgacggacaccgcggacttacctaaggttaccnggtcggacgaaggtaccgtacccaggtaacggtccggagaaccgtccgtaacgggctacggtccggttaccttttaggaccctttcgggaccgggg

SEQ ID NO: 209764 - DNA, 857 bp, Homo sapiens
  misc_feature: GYAE6OF02JH2W6.17.25.C03.1.454.CMB.1.raw
  modified_base (187)..(187): a, c, t, g, unknown or other
  misc_feature (187)..(187): n is a, c, g, or t
  modified_base (740)..(740): a, c, t, g, unknown or other
  misc_feature (740)..(740): n is a, c, g, or t
tcagcgtagactagcacgaccggtgctcgatttagtagtgtagatttgggtttggggactcaacaaccacatctgtcctctagacgaaaccctgtgagcacagctcctcaccatggactggacctggagatcctcttcttggtcgcagcagctacgaagtcgcccactcccgaggtgcgagctggtnacagtcgtgggctgaggtcgaagacgccgtcgggcctcgagtgacggtcctcctgaccaaggtccttcgaggtactttaccgtaccgttttaccctctaagttacgtacgtcctaacggttgggtacgtcccgaccgaacggtcccggacgttacggaacccgtaaaccggttccgttggaacgggttaacggggtaacgtagggggttaaccggtacccgggggtaaaccctaaaacccccgtttaacggtaaccggttcggggttaaccgtaccgtaaccgggtaacgggtttcgtttaccccgttaccccggtaaaccctaccggttaccccgggtaacccggggtaaccttaaacggtaaacccgttacccgtacgtaaccggaccctaacggtaacccctaccgtacccgtaaaactaaccgtaacgtaccgtaacgtaccgtaacgggttcgggaagtttacgggaaaccgttcgtaccttacggaacctagttacctacgggaaccgtaccgtacccggtacgttaacccgttacgggtttaccgnggtaccgtaccggaaccgtttcgaaccccggtttaggcccgggtttacggacgtaaccccggtcgtaaaccggcctacgtcccgggtttaccgttacgtaccgtcgggtaaccgggg

SEQ ID NO: 209765 - DNA, 801 bp, Homo sapiens
  misc_feature: GYAE6OF02HY3XJ.17.25.C03.1.454.CMB.1.raw
  modified_base (553)..(553): a, c, t, g, unknown or other
  misc_feature (553)..(553): n is a, c, g, or t
tcagcgtagactagcacgaccggtgctcgatttagtagtgtagatttgggtttgggagtcagtctcagtcaggacacagcatggacatgagggtccccgctcagctcctgggctctgctactctggcctcgagctgccagatgtgacatccagactcgacccacgtctcccagtcctccctgtcgtcgtccttcgtgggtcggggtacaggacgtacacctactacctacgttcggaccggaactaacgtccgtaaccgggtaacgtttaaaaccttaattttaaacgttggtaactcgaacgtacgaacggtaaacctacggaaaaccgtccccgaaggtacccttccgtagtaccgttctggtacggtctacaccttacctgtccgtaggtaccgtaaggtccggccgtacccgtaggtaccggtacggtacgtacggtcggaccgtaggtacggtaacgttccgggaagttaccgaagtttacttaacggactaccgttaccaacttacgcctaaaccgtcgttcacggtacctaacggtagaaggtttnacgtcgaacttaacttaccgtacgtaacgttggaaaccctaaagttacgttaacgttaccgtccccgtttaaccgtaccgttacgttaccggttaacggaacccgggttaaaccgggtaaccgtaacgggtttcgaaaacggttaaccgaaacccgggtttaaacgtaaacggtttcgggttaaacccgttcggtaaaaccccgtacccgtttaaccgggtctttaccccggtttacgtttaaccccg

SEQ ID NO: 209766 - DNA, 799 bp, Homo sapiens
  misc_feature: GYAE6OF02HGEJH.17.25.C03.1.454.CMB.1.raw
  modified_base (273)..(273): a, c, t, g, unknown or other
  misc_feature (273)..(273): n is a, c, g, or t
  modified_base (298)..(298): a, c, t, g, unknown or other
  misc_feature (298)..(298): n is a, c, g, or t
tcagcgtagactagcacgaccggtgctcgatttagtagtgtagatttgggtttgggggagtcagtctcagtcaggacacagcatggacatgagggtccccgctcagctccgtgggctcctgctactcgtggctccgagctcgccagatgtgacactccagatcgacccagtcctccactccctcctgtctcgcctcgtgggtggggtcagacgtcacatcacgtcggaccgacaacgtcgacgtaacttaaacttatttaaagtgtatacganacgaaagtaaaccgtacggaaaccnccgacgtaccctctacgtacttccgtcgtacggtctacctaccttaccgtacgtacgacggtacggtaacggtccgggtacccttaccccgtagggtccggttacggttacgtacggggttcgggaacgtagggtacgtacggttacggtacgggtaattacggtttaacttaacctaaccgtacgttacctaaccgtaaccttaccgtaccccgttaacgtttcccgtaccggaaacccgttaaacccggtttaaggggtaaccgttttagggttaccggttaattaaacccttaaaccgttttacctaaccgtttaaccggtacgaaacctttaaaccggaccggtttttaacgttaccccgtttacccgggttcccttaaccggttaccgtttaccggggttaaccggaacgggtaaacggttacgtaaggtcgacgtaaccgtaacgtaaccggtagtcggtacgtactcgtaaccttacgtacgttctacgttccg

SEQ ID NO: 209767 - DNA, 784 bp, Homo sapiens
  misc_feature: GYAE6OF02I5B6K.17.25.C03.1.454.CMB.1.raw
  modified_base (176)..(176): a, c, t, g, unknown or other
  misc_feature (176)..(176): n is a, c, g, or t
  modified_base (191)..(191): a, c, t, g, unknown or other
  misc_feature (191)..(191): n is a, c, g, or t
  modified_base (574)..(574): a, c, t, g, unknown or other
  misc_feature (574)..(574): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggagatcctcttcgttggtggcagcagctacgagtcgcccactcccaggtncagctggtgcagtcnggggctggaggtgaagtacgccgtggggcctcgagtagaaggttcctcctggacgaaggtccttacgtacggtatttccgtaccgtttaacccgtcctaagttacggtactacgaacggttgggcgtccgtaccgtacgggcccgtagtcgggaacctaaacccggtaccgtggacggttacgggacgggtttggggaacgttccgggggaacccgtaaaaccccgtaaacgtaccggttggggtaccgtaaccgtaccggtaacggttcgttacccgtttacccgaaccccgtaacgttccccggtaaccgggtaactaaccggtaaccttaccctacgtacgaacccgtaaccgtaccctactaaccctaaagtaaaaccncgtaaacgtacctaactacggtgtacgtaggagaccgtcctaacgaccacgttcgtaaccgtaccgacggtaccggttaccttaccgttaagttaacccgacgggttcgaacggtccgttaaccggtcccgaacggtaccggttacggaccgttcggaacccgacgggcgaccggtccggtttaccgtccgttacggttccggtacgggg

SEQ ID NO: 209768 - DNA, 597 bp, Homo sapiens
  misc_feature: GYAE6OF02INI5Y.17.25.C03.1.454.CMB.1.raw
  modified_base (283)..(283): a, c, t, g, unknown or other
  misc_feature (283)..(283): n is a, c, g, or t
tcagcgtagactagcacgaccggtgctcgatttagtagtgtagatttgggtttggggagtcagtctcagtcaggacacagcatggacatgagggtccccgctcagctcctggggctcctgctactctggctccgagctgccagatgtgacatccagatgacccagtcctccatccctccctgtctgcctctggtgggggtcagagtcaccatcacttcgccggacaagtcacggtacttaaaacctattaaattggtatcagacaacgaaacctaggaaaacnccccaagacctcctagactcctcgtggtcgctactccactcgtaggaccgaagttcgggccgtcccaagttccggtaggttccaggtcggacaggtggatcggtagggacagtactttacaactctaccacctactaccaacctactctcgacctaacctaggaaggtattagtcgactaacttcttaactactagtacaacgagtaacgttaccaccgttccctcgtacttacgtttcggaccgtaacgggactaagttcgaagtactaacgtaacgtagtgtacgctacgacctaacctattcctagttacc

SEQ ID NO: 209769 - DNA, 588 bp, Homo sapiens
  misc_feature: GYAE6OF02GKG1B.17.25.C03.1.454.CMB.1.raw
  modified_base (291)..(291): a, c, t, g, unknown or other
  misc_feature (291)..(291): n is a, c, g, or t
  modified_base (468)..(468): a, c, t, g, unknown or other
  misc_feature (468)..(468): n is a, c, g, or t
  modified_base (473)..(473): a, c, t, g, unknown or other
  misc_feature (473)..(473): n is a, c, g, or t
  modified_base (478)..(478): a, c, t, g, unknown or other
  misc_feature (478)..(478): n is a, c, g, or t
  modified_base (507)..(507): a, c, t, g, unknown or other
  misc_feature (507)..(507): n is a, c, g, or t
tcagcgtagactagcacgaccggtgctcgatttagtagtgtagattttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagccgtggggcctcgagtgaaggtctccgtgcgaaggtcttactggtacttctacgtttacctcctatagtatacaacgtggcncgccaggccgacgtggaaccaacgaccgtaggagtggagtgggatcgggacaaccctaagacgtggtcgtacagtagtcgttactacaccctatccgaccggacacgtacttaccgataccgacgaacgacctccctacaaactaaaccactacgactacatacgggattggaggcncctanactanctagaccgaccgacgtcctattactgtgngacaccgactcccacggtctaccggtagaaccggttccgaacggccacggtcccgttacgttcgaccgttcggtaccgggg

SEQ ID NO: 209770 - DNA, 708 bp, Homo sapiens
  misc_feature: GYAE6OF02FWDA5.17.25.C03.1.454.CMB.1.raw
  modified_base (185)..(185): a, c, t, g, unknown or other
  misc_feature (185)..(185): n is a, c, g, or t
tcagcgtagactagcacgaccggtgctcgatttagtagtgtagatttgggtttggggactcaacaaccacatctgtcctctagagaaaaccctgtgagcacagctcctacaccatggactggacctggaggatcctcttcgttggtggcagcagctacaagtgcccactcccaggtgcagctggncagtcgtgggctgatgagaagacgtccgggtagggccacgtagtaggtacgtcctaccgtggacgaacggtcttgagtactttaccgtacctttaccgtaccttatacgttacctagtacgtggggctacccgccggacggtccctagtacggaacccgaacgtacggttgaacggttcggaggtacgggtagtaccgggaacccctaaccgtacgtacggtggtaccgtatacgtagttctacgttacccaccgtctccgtaccggacttacgtacctaaccgcgtaccgaaccgtacgtaccgtaccctacctaacaaaccacgtaaccgtacaaccgtagtacgggttaacttcgggaacgctcgtacacgtaccttggacgacgtaaccgacgttacccttagttaacctggtacgcgtaacgtacgtaccgtacccgtaacggtcgttacccgggtagacccggttaccggaaccgtcgggtaccgtacccggtttacggttaccgtaggttcccggg

SEQ ID NO: 209771 - DNA, 721 bp, Homo sapiens
  misc_feature: GYAE6OF02FNYP7.17.25.C03.1.454.CMB.1.raw
  modified_base (239)..(239): a, c, t, g, unknown or other
  misc_feature (239)..(239): n is a, c, g, or t
  modified_base (248)..(248): a, c, t, g, unknown or other
  misc_feature (248)..(248): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtggaagaagccgtggggcctcgaggtgaaggtctctgnaaggtcttnggattcaccgtttacctcctatagtatactaacgtgggtgcgtccgagggccgcgtcgggacaaaccgaccgtgacggtggagtggggacgttcggggaccgaaccccgtaacgaccgttgggtacgtaccgacgtaggttcttccgttaccgaaccccgtacgtcccggttaccgggaacctaacgttaacccttaaccgaacgtaccggaacctaaccgtaaacccgtccctaaccgaaaactaaacccaaccgtaaacgtaccctaaacgtacgtagggtaacggttaggacggacgtaccgtcgtaacgtacgttacgtccggaaccgtaccgacccggttacccttcctttaactttaccgtacggttacggacgtacgtaccggtacccgaaccggtacctccgggtacgtaccgtacccgtacggaccgtacggtccggttcctttcggtacctttcgggccgggg

SEQ ID NO: 209772 - DNA, 958 bp, Homo sapiens
  misc_feature: GYAE6OF02GS8KV.17.25.C03.1.454.CMB.1.raw
  modified_base (188)..(188): a, c, t, g, unknown or other
  misc_feature (188)..(188): n is a, c, g, or t
  modified_base (251)..(251): a, c, t, g, unknown or other
  misc_feature (251)..(251): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctgggaggactcctctttcttggtggcagcagctacgaagtgcccactcccaggtgcgagctggngcagtcgtgggctggaggtagaagagccgtgggcctcagtgacgtctcctgcgagtcttacgnggtacttccgtaccgtttaccctcttaagtacgtactaccgtaacggttgggtacgccggtacccggacggtcccgtcgtaacgggaacccgtaaaccggtcccgtagggtaaggtaggggtaacgttacggggggtaacgtacgggggtaacccccgtaaaaccccggtaaccgtaccgggtttgggtaccgtaccgtaacgttacgggtttccgttacccttacccgaaccccgttaccgttacccggggtacccggtaacgtaaccgttaccccgttaaccgaacgtttacccggaaccccgtaacccgttaaaccccgttccgtaaaccctaaaccgtaaaacccgaaccgtacgttaaaccctaaggtaccgttaacggggtacggtttaacgggacgggtaacctaccgggttacgtaaaaccgttaccgtttacggaaccggtaacccggttaacccgggtaaccccgggtttaccccgttttaacgttaccgttttaacccggtacggttaaacgtaaccgggggaacccgtttacccgaaccccccggggtttaaggtccccgggttaacccggacgggtttaaacccccggaacccggggttaccccggaacggggtttaccccgggtttaccccgggttttaacccgttttaaacccggggttccccgggtacgggggggtttaaccccccggggg

SEQ ID NO: 209773 - DNA, 738 bp, Homo sapiens
  misc_feature: GYAE6OF02GJC13.17.25.C03.1.454.CMB.1.raw
  modified_base (574)..(574): a, c, t, g, unknown or other
  misc_feature (574)..(574): n is a, c, g, or t
  modified_base (693)..(693): a, c, t, g, unknown or other
  misc_feature (693)..(693): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctgggtgcagttcgtggggctggaggtgaagacgccgtgggcctgagtgaggtcctcgtgcaacggtcttcgtggactttccgtaacgttttaccctccttagttaacgtactaccgtaacgttgggtcgccggcccgtagggcccgtacgttacggaaccaaccggtaccgtaggtaacggttggaaaggtttcgggggaagtttcgggggaaccctaaacccgtacgtacggttagggtactccgacgtaggttcgtacctttaccgacccctacgtcccgtaccggggaactacgtaacctttaccgacgtacgaaccgaacgtacctacccgtacgaaattaacccaccgataccctagaacggtcggtagttaggacggtacgcccttanacctaacgttcgacgacggtaccgaccggtacctttactaagttccctagggtccgaacggtacctacgggtacccctaagggtccttacccgggctaacgggttccccagggtacccncggggtacccgtttcgtttaccggtacccgggttggacccggggg

SEQ ID NO: 209774 - DNA, 662 bp, Homo sapiens
  misc_feature: GYAE6OF02IKZJW.17.25.C03.1.454.CMB.1.raw
  modified_base (287)..(287): a, c, t, g, unknown or other
  misc_feature (287)..(287): n is a, c, g, or t
  modified_base (398)..(398): a, c, t, g, unknown or other
  misc_feature (398)..(398): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcgagtgaaggtctcctgcagtctgtggattcctacgtttacctcttaatagtatactaacgtgggncgccgacggccgcgtacggaacgaacgccgtggagtcggaggtagggagtcggggacctaaaccctacgacgtggtactcagtagtcgtaccttcacctctccggccgganacgtactacgatacgaccacgtactcccaacaactaaaccgactacgacctaactgtagggtaagttcggacgtaacgtccaagtaccagttcgtacggaaaccgtaccggtaccgggtaccttacttaacgttaccgttaggaccggtaacggtacgtacccggtacccggtagtaacccgggttccggtacggaacccggttaccgtaaccggacggtacgggtcccggttaccgtttcggtacccggttcggtaccggggg

SEQ ID NO: 209775 - DNA, 925 bp, Homo sapiens
  misc_feature: GYAE6OF02F1026.17.25.C03.1.454.CMB.1.raw
  modified_base (194)..(194): a, c, t, g, unknown or other
  misc_feature (194)..(194): n is a, c, g, or t
  modified_base (257)..(257): a, c, t, g, unknown or other
  misc_feature (257)..(257): n is a, c, g, or t
  modified_base (320)..(320): a, c, t, g, unknown or other
  misc_feature (320)..(320): n is a, c, g, or t
tcagcgtagactagcacgaccggtgctcgatttagtagtgtagatttgggtttgggggactcaacaaccacatctgtcctctagagaaaacccgtgtgagcaccagctcctcaccagtggactggacctggaggatccgtcttcttaggtggacagcagctacaagtcgcccactcccaggtcgcagcgtggtncgtaggtcggtggggctggacggtagaagacggtcgtggggcctgaggtgaacggtcctcgtnacgaggtcttatggacttacgtaccgttacctccgttaagtactactacgaacgttgggtacncgtaccgaggcctacggtacggaacctaacggtaccgtaggacggttggaacgtggggacgcgggtaaccgtaaccgtaaccgtggtacggtacgtaactaacgtaggtttcctaccctttacccgaaccccgttacgtaccccgtaaccgggggtaactaacccggttaaaccctttaacccggtaacgggtaacccttaaaccccgtaaacccggttaacccgttaaccccgttaaaccgtaaaaaccgtaaaacccggttaaaccgtaaaccggttaaacccgttaaaccgttaaacggttaacgggttaacgggtttaacgggtaaccggggtaaacccgttaaccgggtaaaccgtaaaccggttaccttaaccggttaaccggtaaccggtaacccggtaaccggggttacccggttaacgttttaaaccgttaaccgtacggttaacgggtacccgtaaacgggtacccgttacccggtaaccgggtttaccgtaacccgggtttacggaaacccgttacccgggaaccggtacggttaacccggtaccggttttacccggttttaccggtaccggtttcccgggtaacccggggggg

SEQ ID NO: 209776 - DNA, 708 bp, Homo sapiens
  misc_feature: GYAE6OF02G8ZQJ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctgaggtgaagaacgcgtgggcctcgagtgagtctctgacgagcttcgtggtacttctacgtttacctctatacgtactacgaacgtcgggtacgcgccgacggccgtcgtaggaaccaaccgaccgtggaggtggaggttaggggagtacggggaaccgtaaaaccgtaacgacggttggtacgtacgtaacgtagttcgtacttaccacccgtacgtcccgtaccgggactaacgtaccttacgacgtacgaccaaccgtacctcccgtaactaacgtaaaccacacgtaccctaacgtacgtggtaacggttacggaacgggaccgtcctaaggtacctacgtccgtaacggacccggtaccgaccggttcccgttaacgtttacttacgggtgtaccgacgtacggtacccgtaacccgacggtccggttacggtacggaccgtacccggtacgggccgttaacgggtccggtttacccgttcgttacccgggttccgggtacccgggg

SEQ ID NO: 209777 - DNA, 729 bp, Homo sapiens
  misc_feature: GYAE6OF02HQ7FH.17.25.C03.1.454.CMB.1.raw
  modified_base (304)..(304): a, c, t, g, unknown or other
  misc_feature (304)..(304): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatctcttcttggtggcagcagctacaagtcgcccactcccaggtgcagcgtggtgctagtcgtggggctggaggtgaagaacgccgtggggcctcgagtggaacggtctcctcggacgaaggtcttcgtaggtacttcgtaccgtttacctctatagtactctaacgtgggtcncgccgaggccgtcgtacggaacctaaccgactaggtaggtagtacggtaggggtagtacggggacctaaacccgtaacgtacggtcggtacgtacgtactagtcgttacctaccacccgtacgtcccggtacggaacacgttacctaccgtacgtaccgaaccgaaccgtaccctacctaaccgtaaactaaaccgtaacgacgtacccgtaagtacggtagggtacttagggaacggtacgtccgtaacgacgtacgtacgtaaccggtaacacccggtaccgttacccgttacttaacgttaccgtcgtacggtaccgacgtacccgacccggtacggtacggtacccggttacgaccgtacccgggtaagtcccggtacgggtcccgtttacggttccggttacccggtccgggtaccgggg

SEQ ID NO: 209778 - DNA, 724 bp, Homo sapiens
  misc_feature: GYAE6OF02FY3H9.17.25.C03.1.454.CMB.1.raw
  modified_base (245)..(245): a, c, t, g, unknown or other
  misc_feature (245)..(245): n is a, c, g, or t
  modified_base (282)..(282): a, c, t, g, unknown or other
  misc_feature (282)..(282): n is a, c, g, or t
  modified_base (617)..(617): a, c, t, g, unknown or other
  misc_feature (617)..(617): n is a, c, g, or t
  modified_base (661)..(661): a, c, t, g, unknown or other
  misc_feature (661)..(661): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggtcttcgnggtattcacgtttacctctaatagtatcaacgtgggntcgccaggccgcgtggacaacgcctaggaggtcggagtggggatcggggaccgtaaacccgtaacgtacgttgggttcggttacaacggtacgttggtttaccttacccggtaacccctacggttccccggttacccgggggactaaaccgggttaacctttaaccccgaattaacccggtaaccctaaaccggtaaaccttcccctttaacccgaaaaacgttaaacccgacgaaccggttaccccttaaagacgttaggggtaacgtttagggacggtacgcctacggactagtcacgaacggcaccggggtcttaccgttaacgtttaacgnggtcgacggtacgtaccgtcccgaaggtaaccttcccggggtanacccggtaccgttaaccggcgtacgggtcccgttcggttttaccgccgttttcggaccggggg

SEQ ID NO: 209779 - DNA, 681 bp, Homo sapiens
  misc_feature: GYAE6OF02F4LGA.17.25.C03.1.454.CMB.1.raw
  modified_base (289)..(289): a, c, t, g, unknown or other
  misc_feature (289)..(289): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttgggtggcagcagctacaagtgcccactcccaggtgcagctggtgcagtcgtgggctgaggtgaagagccgtggggcctcgagtggaaggtctccgtgcaggtcttcgtggtattcctaccgtttacctcttactagttactactacgngggtttttttgcgtccgcggccgcgtacggaccaacgaccgtggagtcggtagtgggagtcgggaccgaaccgtaactacgtggtcgtacacgtagtcgttccgtacctacctaccgtcccgtaccggactacgtacctcacgtcgacctaccgtaacctccctaaccgtaactaaaccaaccaccgtacctactaacggtcggtaaggttaccggaagggacggtccgtacgactacgtacgacgtaaccgaccgggtaccggtaccgtacttacgttacgtgtacgacgacgtaccgtacccgaccggtaacgtccgggacgggtaacctacccggttaccggcgaccgggtcccgttacgtttacccggtacggttcccggtaccgggg

SEQ ID NO: 209780 - DNA, 809 bp, Homo sapiens
  misc_feature: GYAE6OF02ICO2Q.17.25.C03.1.454.CMB.1.raw
  modified_base (296)..(296): a, c, t, g, unknown or other
  misc_feature (296)..(296): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctaacaagtcgccccacctcccgaggtgcagctggtgcagtctggggctgaggtagaagaagccgtgggcctcgagtagaaggtcctcgtgacgaagcttctggacttcgtacgttacctctatagtactctaacgtgggtcncgaccgtacgggccgtcggtaggtaacccaacggtaccgttcggaaggttcgggaacgtgggacgtcggggacctaaaccccgaacgtacgttcgggtcgtacgtaacggtaacgttcgtccttacctaccccgtaacgttcccggaacccggggtaagtaacccgttaaccgttaaaccgtaacgtaaccggtaacccgtaaaccgtaaaccccttcccgttaacccctaaacggttaaaacccaaccggtaccgtaccgtaacccgtaagtacgggtaacgggttaacggtaaaccgggacgttaccgtacggtaaccctagttacccgtaacgggtaacccggttaaccggacccgggttacccgttacttaacggtttcgaaccggtacggtacccgtaaccggtaccggtacccgtaaccggttccggttaccgggtaacggtaccgtaccgtacgggaaccgttacgggtacccgtttaccgttggttacccgtgggtaccccgggg

SEQ ID NO: 209781 - DNA, 643 bp, Homo sapiens
  misc_feature: GYAE6OF02GCOSF.17.25.C03.1.454.CMB.1.raw
  modified_base (309)..(309): a, c, t, g, unknown or other
  misc_feature (309)..(309): n is a, c, g, or t
  modified_base (475)..(475): a, c, t, g, unknown or other
  misc_feature (475)..(475): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactccaggtgcagctggtgcagtcgtgggctggaggtagaagaaggccgtcggggcctcgaggtacgaacgggtctccgtaggacgtaacggtccttcggtgtacttccgtaccgtttacctctatagtatacgtaacgtggtncgccgacgtccgacgtcgacgaacgccgtggacggtcggagtgggcgtacggaccgaaacctacgtcgtgggtcaccgtaagtgtcgttactaccgaccctacgtccggtacggaacctaagtacccttagacgtacgacctacaaccctccgaactaacgaaccnaccgtaccacgtagtcggtagttagacgtcgacctagactactcgtacgaccgaccgtacgtaccgtactaacgtacgtcgacgcgacgtaccgccgtacggtcgtacggtcgaaccgtccgacggtcgtaccggttacgtaccgtttggtacccggtggtaaccggg

SEQ ID NO: 209782 - DNA, 731 bp, Homo sapiens
  misc_feature: GYAE6OF02IAKZ6.17.25.C03.1.454.CMB.1.raw
  modified_base (189)..(189): a, c, t, g, unknown or other
  misc_feature (189)..(189): n is a, c, g, or t
  modified_base (492)..(492): a, c, t, g, unknown or other
  misc_feature (492)..(492): n is a, c, g, or t
  modified_base (696)..(696): a, c, t, g, unknown or other
  misc_feature (696)..(696): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcaggcagctacaagtcgacccactcccgaggtgcagcgtggtncagtcgtgggctggaggtgaagacgccgtgggcctgagtgacggtctcctgacacggtcttcgtggtacttacgtaccgtttacctacgtaattagtactcgtaacggtgggtcgccgccgacgggtcccgtacgtaaccgggaacaaacccggtaccgtaggtacggttagggtacggacggggtacgtaccggggaacccgtaaaccccttaacgtacggttgggtaccttacgaaggttccgttacgttccttaacccaaccgttcgtacccggtacgggaacctacgtacccttaacgngttaccggaccctaccgtaaccctaccgtaaccaacgtaaaccacgaccgtaccaacgtacggtacggtagttacggaacggtacgaccgttacgacttacgttccggaagtaacccgaccggtaccggtaccttacgtacgtttaacgtcggtagtaccggtaacgccgtaccgaggtccggttcgacgtaccgacgtacggngtaccggtcgttccgtaacgttcggcggtaccggg

SEQ ID NO: 209783 - DNA, 799 bp, Homo sapiens
  misc_feature: GYAE6OF02H5BYS.17.25.C03.1.454.CMB.1.raw
  modified_base (196)..(196): a, c, t, g, unknown or other
  misc_feature (196)..(196): n is a, c, g, or t
  modified_base (240)..(240): a, c, t, g, unknown or other
  misc_feature (240)..(240): n is a, c, g, or t
  modified_base (255)..(255): a, c, t, g, unknown or other
  misc_feature (255)..(255): n is a, c, g, or t
tcagcgtagactagcacgaccggtgctcgatttagtagtgtagatttgggtttggggacgtcaacaaccacatctgtcctctagagaaaccctgtgagcacagctcctcaccatggactggacctggaggatcctcttcttggtggcagcagctaacaagtcgcccactcccaggtcgcacggctggtgcagtcgnggggctggaggtcgaagaagcctggggcctcgaagtgaaggtcncctgacaggcttcgnggattcacgtttacctcctatagtactacacgtagggtgccgacgacggccgcgtaggtaccaacggtaccaggacggacggtagtaggggacgttacggggaccgttaaacccccgtaaaacgaccgttacggtacgggttaacctacccggtaaagggtttccggttaatttacccccaacccggtaaacgtttccccggttacccggggaaaccgaacggttaaacccttacccggtaaattacccgaaacccgttaaccggaaaaccctttaccttaaccccgaaaacttaaaaacccgaacgtaccgaaacccttaaaccacgtaaggtaaccgtttaagggaaacggtaaccggtaccgttacggacctaaaccggcgtttaacggaaccgacccgaccgggaccctacttaaccgttacggtacgttacggacgtacgtacgttaccccgaacggtcgtacccgggtaggtacggtccgtaaccgggacgtaccgggtaccggttacccgtttcgtaaccggttcgtacccgggggg

SEQ ID NO: 209784 - DNA, 658 bp, Homo sapiens
  misc_feature: GYAE6OF02IC4HX.17.25.C03.1.454.CMB.1.raw
  modified_base (357)..(357): a, c, t, g, unknown or other
  misc_feature (357)..(357): n is a, c, g, or t
  modified_base (364)..(364): a, c, t, g, unknown or other
  misc_feature (364)..(364): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcaggtgaacggtctccgtgacaaggtcttcgtggattcacgttttacctccttataggtatacaacgtgggtgcgccgacggccgcgttaggaccgaacgacctggacgtggatggggatcggggcgaacctaacncgttggngtacacgagtcgtcttcaccctacgtcccgtccgggaacacggaccttaccacgtcgaaccaccgtaaccttaccctccaaactaaaccaccaacgtaccctaacgactagggtagtttggaacggtacggcctagacctacgtcgtaccggaccacgtaccggccgttacttaactttcgacggtcgaccgagacccgtaccccagggtaccttaccgggagaaccgtcccggtaaccggccgtaacgggtcccggttacccgtttacggaccccgtttcgggtacccggggg

SEQ ID NO: 209785 - DNA, 811 bp, Homo sapiens
  misc_feature: GYAE6OF02FP5EL.17.25.C03.1.454.CMB.1.raw
  modified_base (167)..(167): a, c, t, g, unknown or other
  misc_feature (167)..(167): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctgaggatcctctcttggtgcagcagctacaagtcgccctaccnccccaggtgccagctcgggttgcaggtcgtggggctggaggtagaaagaacggccgtgggggcctcgaggtagaacgggttcctccgtgacaaggtcctttctgggatttccaccggttttacctaccttattagtataccaacggttgggtcgccgcccgacgggcccgtcgtacggaaccaaaccgtaccgttaggacggtaggattcggggagtacgggacccgtaaaccccgtaacacgttcggttagccctagaccgtggttccttaccgaaccctcgttcccggaccggggaactaacggttacccttaaccgtaacgtacgaaccccgtaacgtaaacctacccgtacaactaaaaccgtaccaacggtccttaacgaccgtagggttacggttaggacggtaacgtacccgtacgaacgtacttcgtaaacggccgggtaacccgcccgggtttaaccggttactttaaacgtctttaacgggtcggtaacccggtaagttacccgacccgttaacccggaaaccggttccccgggtaaaccggtacccggttcccgtaaaccgggcccggttaacccgtaccccgggggtttccttttaaccgggttacccttttaccgggggtaaccccggggg

SEQ ID NO: 209786 - DNA, 737 bp, Homo sapiens
  misc_feature: GYAE6OF02GW307.17.25.C03.1.454.CMB.1.raw
  modified_base (214)..(214): a, c, t, g, unknown or other
  misc_feature (214)..(214): n is a, c, g, or t
tcagcgtagactagcacgaccggtgctcgatttagtagtgtagatttgggtttggggactcaacaaccacatctgtcctctagacgaaaaccctgtgagcacagctcctcaccataggactggacctggagtactcctcttcttggtggcagcagctacaagtcgcccactcccgagtgcagctggtgcagtcgtgggctagaggtagaagaanccgtgggacctcgagtacgaagtctaccgtagcgaaggcttcgtaggtacttacgtaaccgtttacctaccgtaataggttactacctaacggtgggttcgaccgtaccgtaacgggtcctacgtacggaaccaaacggtacccttaggacggtacggtaagtacggggtagtaccgggacctaaacccgtaagtaacgtggtaacgtacaaccgtagtcgttccgtacctaaccgtctaccgggtaccggaactaacggaacccttaacgaaccgtccgaaacccgtaaccggtaaccttacccgtaaacttaaaaccgaaaacctccgtaaacggtaacccttaacgaagtaggttacggtacgaacggtactgtaacacgtacttcgacgaccgacccgtccgggttaactacggttacctacgtacggtcaaccgtacgactaccgtaagtccgggtactaacggaccgtaacgtaccggacgttcggtacgtcccgttcgtaccggttacggaccggg

SEQ ID NO: 209787 - DNA, 804 bp, Homo sapiens
  misc_feature: GYAE6OF02GVXKN.17.25.C03.1.454.CMB.1.raw
  modified_base (244)..(244): a, c, t, g, unknown or other
  misc_feature (244)..(244): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagccgtgggcctcagtgaaggtctcctgcaaggcttcgnggattcacgtttacctctatagtatcaacgttgggtgccgccgaggcccgcgtggaacctaacgaccgttggaggttagggacgtaggggtagttcgggggacccgtaaacccctaacgtaaccggttgggtacgttaccgaacgtacgggttcggttccttaccaaccccctactcccgttacccggggaacctaaccgtaacctttacccgaagttcgaaccccgtaaccggtaacccttaccccgtaaccctaaacgttaaaaaccctacccgtaaacgtaccccttaaaccaacgttcgggtaacggtttacgggaacgggaccgtacccggttagaacccgtaacgttacccgtagggtaaacccgggaacccgtacccgggggtaccctttacgtttaaaccgttttaaccggttcggtacggtacccgggtaacgggtacgttacccccgaaccggttaacgttaccccggggttagaaccccggttcccgtaacccgggtacgcggtcccggtttacccgtttaccggtacccggtttcccggtaccggggg

SEQ ID NO: 209788 - DNA, 1025 bp, Homo sapiens
  misc_feature: GYAE6OF02FQV4H.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagtctacaagtcgccctactcccaggtgcagcgtggtgcagtcgtggggctggaggtgaagaacgccgtggggcctcgaggtgaacggtcctccgtgacgaacggtcctttcgtaggtactttccgtaaccgttttaccctaccttaattaggtaactaccgtaaaccgtttgggggtacgccggtccccggtaacgggtccccggtcggttacggggaaacccgtaacccggtaccccgttacgggtaaagggtttcggggaagttacgggggggtaacggttaccgggggtaaccccggtaaaaacccccgttaaaccggtaaccggttcggggtttaaccggttacccgttaaaccgggttaacgggtttccgggtttaccccttacccgtaaaccccccgttaacgttttaccccccgggttacccgggggaaaccgttaacccgttaaaccctttaaccccgtacggttaaccccgttaaaccccggtaaaccggttaaacccccttaccccttaaacccgtaaaacccttaaaaccaaaccccggaaacccgtaccctttaaaaccggtaaccgggttacggggttaaacggtttaacggggaccgggttaaccggtacccgtaccgggaacctaaccggtttacccgaccggtaaacccgggaacccgttacccgggtttacccggttaaccgtttaaacggttttaccgtcggttaacggtaaccggtaacggttaccccggtacccgtaacccgggtaaccggttaaccccggggtaccggtaacccggtaccccggtaccgggaccgtaccgggttcccggtttacccggtttcggtacccggttttccgggggtaaccccgggg

SEQ ID NO: 209789 - DNA, 831 bp, Homo sapiens
  misc_feature: GYAE6OF02ID3FN.17.25.C03.1.454.CMB.1.raw
  modified_base (137)..(137): a, c, t, g, unknown or other
  misc_feature (137)..(137): n is a, c, g, or t
  modified_base (384)..(384): a, c, t, g, unknown or other
  misc_feature (384)..(384): n is a, c, g, or t
  modified_base (462)..(462): a, c, t, g, unknown or other
  misc_feature (462)..(462): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctnttcgttggtggcagcagctacaagtcgcccactcccaggtgcagctggtgctagtcgtggggctggaggtagaagaagccgtggggcctcaggtgaaggtctctgctaaggcttcgtaggtacttctacgtttacctccttaatagttatacaaacgtgggtacaccggtccaagggtccacgttaggaacctaaacggaccttaggagtacggagttggggaattcggggaccaaacccgttaaanccggttaggtacgtcgaaccggtaagtttcgttacccgttaccaaaccccgtacgttacccggtaaccccggggtaanaaaccggttaacccgtttaaacccgaggtttaacccgggaaaccctaaacccgggtaaaccccctttacccggttaaccccaaaagtttaaaaaccccgaaccgtaaacggtaacccctaaacgtaacgttacgggtaacggttacgggaaaaccggtacggtacccgttaacgaaacgtaacttaccggttagaaacccggtaccgtaaccggtacccggtttacttaaccgtttacgacgttcggaacgtaaccggtaccgggtaaccaacccgggtaggtttaccccggtacggtaaccgtcccgttaacgggccgtaaacgtcccgggttaccctttacggttacccggttcggtaacccggggg

SEQ ID NO: 209790 - DNA, 804 bp, Homo sapiens
  misc_feature: GYAE6OF02I3FA2.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagaagccgtgggcctcgagtgaaggtctcctgacgaaggtcttcgtggtacttcgtaccgtttacctacctattagtaactacgtaacgtgggtacgccggccgacgggtccctcggtacggaacctaaaccggtaccgtaggtaaggtacgggacggtgggggtaacgtacggggtaacccgtaaaccccgtaaccgtaccggttacgggtcgtaacgacgtacgttacgtaccctttaccaaccccgtacgttccccggtaaccggtacctaaccgttaaacccgtttaaccacgttaccgaacccgtaaccgtaaacccctcccgtaaacctaaacgttaaaacccaaccgtaacgtaacccttaaaccgaggttacgggaacggtttacgggaacggtaccgttaccgtaggtaacctaccgtacgtacggtaaacccggacccggtaaccgggtcccgtttaacttaacgtttacggttcggtacgaccggtaacggtacccgtacccgtaacggtccggttccggtaggacccgtacccgtacgggtacgaccggtccggttccgtttacgtaccgggtttccggtaccggggg

SEQ ID NO: 209791 - DNA, 737 bp, Homo sapiens
  misc_feature: GYAE6OF02IZBC4.17.25.C03.1.454.CMB.1.raw
tcagcgtagactagcacgaccggtgctcgatttagtagtgtagatttgggtttgggagtcagtctcagtcaggacacggcatggacatgagggtccccgctcagctcctggggctcctgctactctggctccgagctgccagatgtgacatccagatcgacccagtctccatccctccctgtctgcctcgtggtggggtcagagtcaccatcacttgccgacaagtcacggtacgttaaaactatttaaatggtatcgagcaagaaacctaggaaaacgccccaagccctctagacttccgttctggtacgctactccctactcgtcggacggtaaggttccgggccgtacccgtagttcggtaacgggttcaggttcgacgtaggtaggtacttcggtacgggaactagtactttacaacgttcctacctaccctactaccaaccctaccttcctacgaccctaaccgtaggacggttattacggtcaaccgtaacgtttaccttaaccttaaccgttacgttaaccgtaaccgttaacgtagtttacccgttaacccgtttccccttaccggttacctttaccggttttaccggacccgttaaacgggggtaaacccgttaacggttacgtaagttaacccgtaaaccggttaaaaccgttaacgggttacggttacggtacgttaacccgacctaaacccgttaccgttacggtttaccgtttaccgttacccg

SEQ ID NO: 209792 - DNA, 758 bp, Homo sapiens
  misc_feature: GYAE6OF02H7PW8.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctctttcttggtggcagcagctacaagtgcccactcccaggtgcagctggtgcagtcgtggggctgaggtgaagacgccgtgggcctcgaggtgaaggtctccgtgacgaaggtcttcgtggtactttccgtaaccgtttttacctccttaatacgttactaccgaacgttcgggtcgccgccgacggccgcgtaggacctaacgaccgtagaggtggagtgggagtcgggacccgtaaaccctaacgacgtggtacgtaccaacgtacgttcgtcttacccaccccgttacgtcccggtccggacctaacgtaccttaccagtacgacccaacgtacccttacccgtaaccaaactaaacccacgactacccgtaactagtacggaacggttacggacggtactaccgttacgaccgttactacggtaccgaaccgtacccgtacccgggttacccttacttttaacgttaccgtcgggtaaccgaccggtacgttacccgtaccccggttaaggacccggtttacccgggcggtaaaccccggttcccggtaacccgggtaccgaaccggggttccccgtttacccgggttttacggtaccccggttacgggtaccccggggg

SEQ ID NO: 209793 - DNA, 683 bp, Homo sapiens
  misc_feature: GYAE6OF02IXU62.17.25.C03.1.454.CMB.1.raw
  modified_base (571)..(571): a, c, t, g, unknown or other
  misc_feature (571)..(571): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagcctggggcctcagtgaaggtctccgtgcaaggcttcgtggattcacgtttacctctagtatagtcaacgtgggtcgcgccaggccgcgtaggacaacgaccgttggacgtaggagtgggagttggggaccgaaccctaaacgtcgtgggtcttacgactaggtcgttacgttccaacccgacgttccgtaccggaacgtacgtaaccttaaccgagtacgaaccctaccggaaacccttcccgtaacctaactaaaacgcctaacgacctaacgacgttaggaactttggaaacggactacccgtagaaccgtacttaccggtagtacccgggaacttaccggtccgttaacttaacgtttacncggttaagacgtagtaccggtcccgaacggtaaccgttaccgggtacggacccgtaccttacgggacctacgggtcccggtaccgttttcggtaccgttcggtacccggggg

SEQ ID NO: 209794 - DNA, 897 bp, Homo sapiens
  misc_feature: GYAE6OF02FJSTG.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaacggaagccgtggggcccttcgaggttcgtaacggtcctccgtgtaccgaacgggtcctttcgtacgggtactttaccgttaccggttttacccttccgttaacgttaacggttacttaccgtaaaccgttgggggttacggtcccgtacccggtacggtccccggtacgtacgggaacctaacccggtaaccgttacgggtacggtacgggtacggtacggggtacgtacgggggtaccccgtaaaccccgttaaccgtacgttagggttccgtacgtaacgtacgggtttacgttaccctttacccgaaccccgttaacgtcccccggttaacccgggggtaactaaaccggttaacccctttaacccgtaacgttaacccggtaacccgtaacccgtaaacccttccccgttaaccgaaaactttaaaccgaccgtaaccgtacccgttaaacgtcggtacgggttacggttaacggacgggtaccttccgagtaccgtacgttccggtaacggtaacccggaccgtacccgggttaacttaccgtttaacgtttcgtacggtaccggcgaaaccggttccgtaccccgtaggtaacccgttccgggaacgtaacccggtaccggtaccggacccgtacggttaccccggttccgtttaacggtacccggtttaccgggtaacccggggg

SEQ ID NO: 209795 - DNA, 676 bp, Homo sapiens
  misc_feature: GYAE6OF02HM8VP.17.25.C03.1.454.CMB.1.raw
  modified_base (257)..(257): a, c, t, g, unknown or other
  misc_feature (257)..(257): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcgttggtgcagcagctacgaagtcgcccactcccgaggtcgcagcgtggtcgcgtagtcgtgggtctggaggtaggaagacgcgtgggcctcgagtgagtctccgtgacgagtctcgnggtacttacctaccgtttacctctatagtactacgtacggtggtcgcgtaccgacgggtccgacgtcggaacaccgcgtggagtggtacgtggggtacggacggaccgaaccgtactacggtggtcgaacgtgtacggttcctccgttacgaccctacggtcccgacggtaactagacccttacgacttaccgacccaacgtacctaccgacaaacgtaacacgaccactacgtagtacgtacgtagggacgacgtcccgaagtacctacgttacggaccgtaaccggtacgcccgttacggttacttaggttacggtcgaacgacgtaccggaccgtacccgacggtaaccggtcgccgaaccggtccgtaaccggcgaccggttccggttacctttacggtccggtacggtcccggg

SEQ ID NO: 209796 - DNA, 811 bp, Homo sapiens
  misc_feature: GYAE6OF02H4DND.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctctttcgttggtggcagcagctacaagtcgccccacgtcccgaggtgcagcgtgggtgcgagtcgtgggctaggaggtagaaggaacgccggtggggcctacgaggttggaaggtctccgtagacgaacggtcttcgtaggatttccgtaccgtttacctccgtaatagttactaccgaacgtcgggtacgccggaccgacgggtcccgtaccgtaacggaaccgtaaaccgtaccgtaggtacgggttaggaacggttagggggtaacgtcggggaaccgtaaaacccgttaaacgtacggttcgggttaacgtaccaacgttcggttcgtacccttaaccacccttaaccggtccccggtaccggggtaacctaaacggttacccttaaaccgagtttacccggaaccccgtaaacggttaaacccttcccgtaaaaccgtaaaactaaaacccgtaaccgaacgtacccttaacgaaggttaacgggtaagttaccgggaaggtaccgtaccgtaacgactaacgtccgtaacggaacgtacccggcgttacccgttaacgttagttaaccgtggtaacgtacggaaccgtaccgtacccgtaggtacctccgggtgaacccggtaccgaccggcgtacggtccgttacgttcggtaccggttcggaacccggg

SEQ ID NO: 209797 - DNA, 767 bp, Homo sapiens
  misc_feature: GYAE6OF02HEXPB.17.25.C03.1.454.CMB.1.raw
  modified_base (184)..(184): a, c, t, g, unknown or other
  misc_feature (184)..(184): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtncagtcgtgggctgaggtgaagacgcctggggcctcgaggtcgaaggtcctaccgtggacaaggtcttacgtaggtacttacgtaccgtttaccctaccgttagtagtactacgtaacgtgggtacgcgaccgaggccgtcgtacggaccgaaccgtaccgtaggtacgtacgggagttacgggtagtacgggaccgtaaaccctaacgtacgtgggtcgtacgtaacgtacgttacgttccttaccaacccgtctacccggtaccggtaacgtacgtacccttaacacgtacgacccgtaacgtaaccttcccgtaactaaacgtaaacaccgtaacgtacctaactaacggtacgggtacgttacgggaacggtaccgaccgtacgtaaacctacgttaacgtacgggaaccgtaaccgaccgggtaacccgtttacgttaaacgtttccggtacgttacggacggtaaccggttaccgtaaccgtacccggaacgggttcccgtaacgggtacccgtacccggtaacgaccgggttacgacccggtttccggtttaactcccggtttacgggtaccggggg

SEQ ID NO: 209798 - DNA, 788 bp, Homo sapiens
  misc_feature: GYAE6OF02G9T5X.17.25.C03.1.454.CMB.1.raw
  modified_base (512)..(512): a, c, t, g, unknown or other
  misc_feature (512)..(512): n is a, c, g, or t
tcagcgtagactagcacgaccggtgctcgatttagtagtgtagatttggggtttggggggagtcagtctcagtcaggacacagcatggacatgagggtccccgctcagctccgtggggctcctgctactctggctcgagctgccagatgtgacataccagatcgacctagtctccactcctccctgtctcgcctcgtgggtcggggtacagtacgtccgaacctatcctacgttacggacccggaacaacggtaccgaaccggttaaaccgtttaaaaaaccttaattttaaaacgtttacggttaactactaacggaacgtaaaacggtaaaacccttaacggaaaaaccgcccccaacggttaccctaccgtacgtacgttcgtacgtcgggtacaccgtactacccgtactcgtaggaccggtaaggtcgtccgttaaccctcggttacggtaacggttacgacggtacggacgtggtacggtattacggaggtaactagttaccttanaactcgtacaaccgtatacccacctaatccgtacgaccgtaacgtggtaacggtcttggaaccgtaactaacgtttcctaaactacggttaactaaccgtaaacgtacggttaacgttaccgttacccgttaaccccttgtaaccgtttacggttacccgggaaaaccggacccgggttaaattaacgggttaacgaaccggtaataaaccggaagttaaacgttcggtacggtacggtacctacccgaagtttacttcccggtagtttaaccccg

SEQ ID NO: 209799 - DNA, 767 bp, Homo sapiens
  misc_feature: GYAE6OF02F0RJP.17.25.C03.1.454.CMB.1.raw
  modified_base (247)..(247): a, c, t, g, unknown or other
  misc_feature (247)..(247): n is a, c, g, or t
  modified_base (287)..(287): a, c, t, g, unknown or other
  misc_feature (287)..(287): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggtcctcagtgaaggtctcctgcaggcttcgnggattcacgtttacctcctaatagtatcaacttggggtcncggccagggccgcgtcggaacaacgaccgttgacgtggatcggggtatcggggaccaaacccgtaacgacgttaggtcgtcacgtaggtcttccgttaccaccccgtagttcccgtccggggaacctaacggtacctttaacccgacgttccgaaacccgtaaccggtaaccctacccctaacctaaagttaaaacctaaccgaaacgtccccttaaacgtaaccgtagggttaacggtttagggaaccgggtacggtaccccgttacgaaaccttaaccgttacgttaccggaaaccggtaaccggacccgggttacccgtttacccttaacgtttaacgttacggaccgtacggtacgttaccggtaccccgaacggtaccgttacccggggttaacggaacccggtcccgttaacggggccgtacgggtcccccggtttaacggttttaccggtaaccgtttcgggttacccggggg

SEQ ID NO: 209800 - DNA, 700 bp, Homo sapiens
  misc_feature: GYAE6OF02IZEJ5.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtagaagaagccgtggggcctcgagtgaaggtctcctagcgaaggcttcgtggacttactaccgttacctctatagtactacacgtggtcgcgcgacgccgcgtacgacacgacgtgaggtggagaggagtcgggaccaaccgtacgacgtggtcgtacacgtacgttcgtacctaccgacctacgtccgtacggactacgtaactaccagtaccgaccgtaccgtaccctacctaacctaaactaaccacctaacgtacctaacgtacgtacggtaaggttacggaacggtacgtaccgtacgtaacgtacgtacgtacgaaccggtaccggtacccggttaccgttacgtttaacgttacgtacggttacggacggttaccgtacccgtacccgtaacggtaccgggttacccgggtaccggacccggtacccggtaaccggacccggttacggtccccgggtttaccgttaccgggttaccggttaccgggtcgggg

SEQ ID NO: 209801 - DNA, 803 bp, Homo sapiens
  misc_feature: GYAE6OF02JJME6.17.25.C03.1.454.CMB.1.raw
  modified_base (243)..(243): a, c, t, g, unknown or other
  misc_feature (243)..(243): n is a, c, g, or t
  modified_base (621)..(621): a, c, t, g, unknown or other
  misc_feature (621)..(621): n is a, c, g, or t
tcagcgtagactagcacgaccggtgctcgatttagtagtgtagatttgggtttggggactcaacaaccacatctgtcctctagagaaaaccctgtgagcacagctcctcaccagtggactggacctggaggactcctcttcgttggtggcagcagctacaagtcgcccactccaggtgcagctggtcgcagtcgtgggtctggtaggtagaagacgccgtgggcctcgagtgaaggtctccgngcgacggtcttcgtggattctaccgtttacctactaagtagtactcgtaacgtgggtcgcgaccggacggtcccggtacgtcggaaacgtaaccgtaccgtaggtacggttaggtacgtaggggtaacggttccggggaaccgttaaaccccgtaacgtaccgttagggttaccgtaccgtaacgtaacgggtttcgtttacccttaacccgaccccgttacgttacccggtaacccgggtaacaaccgttaaccttacgaacgtccgaacccgtaacgttaaccctccctaaccgtaaacaaacccgtacgtaaccgtaccgttaacgtaggttacggtaagttacgaagggacctccctaagtaccgtacgttacnccggtaaacctacccggtaccggtttacctagggttttaacttccgacggttacggaaccgtaccggggtaccctacccgggttaagtaaccggttcccgggtaatcccggttaacccggttacgacgggtacggttaccccggtttaccttttacgggtacccgttagggtaacccggggg

SEQ ID NO: 209802 - DNA, 902 bp, Homo sapiens
  misc_feature: GYAE6OF02JQHAV.17.25.C03.1.454.CMB.1.raw
  modified_base (617)..(617): a, c, t, g, unknown or other
  misc_feature (617)..(617): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcgttggtggcagcagctacaagtcgcccacctccgaggtgcacgtcgtggtgcagtcgtgggctggaggtagaagacgccgtgggcctacgaggtagaacggttcctccgtgacgaacggtccttcgtaggtacttccgtaccgtttacctccttaagttactaacgtacgtacggttgggtcgtccgcgaccggtccgtacgtacgggtaaccgtaaccggtaccgtaggtaccggtagggacggtcggggtaacggtaccggggtaaacccgtaaccccgttaacgtacggttcgggttaccgtaacgtacggtaccggtttcgttaacccgttacccgtaaccccgttacgtccccgggttaacccgggacttaaccggttaaccttaccgtaaccgtaacccggtaacccgaacccgttaaccctaccccgttaaccaaaaccgtaaaccctacggtaacctaaccgttaacgnggttaacgggtaggttacgggaaacgttccgtacccgtaagtaaccgtttagtacccggtaaaacggtaccccggtaaccggtaacccggtttaaccgtttacgttttaaaccgtcccggtttagaaccggggtaaacccgttaccggttacccccggtaaaccgttaacccggggttacggtttaacccccggtaaggtaccccgtaaccgggttaccggacggttaacccgggttcccggtttaacccgtttgggttaccccggttcccggggttaaccgggg

SEQ ID NO: 209803 - DNA, 889 bp, Homo sapiens
  misc_feature: GYAE6OF02F49DS.17.25.C03.1.454.CMB.1.raw
  modified_base (388)..(388): a, c, t, g, unknown or other
  misc_feature (388)..(388): n is a, c, g, or t
  modified_base (873)..(873): a, c, t, g, unknown or other
  misc_feature (873)..(873): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccggagctcgccagatgtgactactaccgaagtacgtccgaaccctacgtcctacctaccttcccctacccgttcgtcctccgtcccgttcgttggggttacgggggtacaacggtacggtaccctaacctattaccgtaccgttacgggacccggaacgtaacgtaccggaaccggttaaacctttaaaaacttaagttttaaagttcggactacgtaaggaacctaaacggtaaaaccgttaacgggaaaaccccnccccctaaggtaccccctcgttaggtaccttacgttcggttacggacctacctacccgttaccctacgtttaccggtcggtaaccggttaacgggtcccggttaccccgttaacctaaggttcgggtacgttcgtaacgggtcggtaacgtaggtacggtacgtacgggtacggtaaactttacgtttaacgttaaccgtaattccccaacgtaaccttacccgtaaccttaacccgtcgttaccgtaaccgtaacgttaaccggttaaggtacggtttactcggtaaccgtaaaccttaacgttaccttaaaccgttcgtaaaccgttaacgaacgttaaccgttaacgttaccccgtttacccgttacccgtaccgttccgtttaacggttaccgggaaccggtaaacggttactaggttaccgtaacggtacgtaaaacccgtacggtacttggggtaccccgttaaccgaccctacgtttntccgtttacgttaccc

SEQ ID NO: 209804 - DNA, 617 bp, Homo sapiens
  misc_feature: GYAE6OF02ITU9N.17.25.C03.1.454.CMB.1.raw
  modified_base (236)..(236): a, c, t, g, unknown or other
  misc_feature (236)..(236): n is a, c, g, or t
  modified_base (249)..(249): a, c, t, g, unknown or other
  misc_feature (249)..(249): n is a, c, g, or t
  modified_base (367)..(367): a, c, t, g, unknown or other
  misc_feature (367)..(367): n is a, c, g, or t
  modified_base (391)..(391): a, c, t, g, unknown or other
  misc_feature (391)..(391): n is a, c, g, or t
  modified_base (497)..(497): a, c, t, g, unknown or other
  misc_feature (497)..(497): n is a, c, g, or t
  modified_base (500)..(500): a, c, t, g, unknown or other
  misc_feature (500)..(500): n is a, c, g, or t
  modified_base (514)..(514): a, c, t, g, unknown or other
  misc_feature (514)..(514): n is a, c, g, or t
  modified_base (601)..(601): a, c, t, g, unknown or other
  misc_feature (601)..(601): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccgaggtgcagctggtgcagtcgtgggctggaggtgaagagccgtgggcctcgagtgaagtctccgngacgagtcttcgngtattctaccgtttacctctatagtactcaagttggtcgccgaccgcggcccgagtacggaaccaaccgtaccgtggaggtggaggtggagtcgggacctaacccgtacgacgttggngtaccagagttctcctaccacccncgttcccgacggaactacgtaaccttacagtaccgacccgaacgtacctacccactaaactaaacacacgtacctactagtcggtagttacggacgacctccgaanacncgttacacggaacnccgacgtccttacgttatcgtgcgacgtacgtacctacccgagtccggtaccgacgtacgacccggtagccgtacgtccgttacgtntaccggtcgggtacgg

SEQ ID NO: 209805 - DNA, 678 bp, Homo sapiens
  misc_feature: GYAE6OF02GTSZN.17.25.C03.1.454.CMB.1.raw
  modified_base (251)..(251): a, c, t, g, unknown or other
  misc_feature (251)..(251): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaaggagccgtggggcctcgaggtgaaggtctcctgcgaaggtcttcnggtattctacgtttacctctatagtatacaagtggtcgcgcgaggccgcgtcgaaccacgacctggacggtggagtgggagtcgggacgtaaaccccgtaacgcgttgggtacgtacgacgtaacggtttcgttaccttacccacccgtacttcccggaccgggtaactacgtaccgttaaccacgtacgaaccgacctaaccgtccctaaccaaataaaccctaccgaagtaccctaacgtacggttacgggtacgttcgggaacgtacggcctaggacctactcggtaccggtaaccgacggtaccgtaccgttacttagttacgttcggcgtacgacgtaccggacccgtacggtacctaccggggtacgtccgacccggtacggctaaccggtccgttacggttcgtccggttcggaccgggg

SEQ ID NO: 209806 - DNA, 912 bp, Homo sapiens
  misc_feature: GYAE6OF02JIGSE.17.25.C03.1.454.CMB.1.raw
  modified_base (195)..(195): a, c, t, g, unknown or other
  misc_feature (195)..(195): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctgggaggatccttcttcgttgggtggcagcagctacaagtgcccactcccaggtgcagctggtgcagtcgngggctggaggtgaagagccgtgggcctcgagtgaacggtctcgtgacgaacggtcttgacggtattccgtacgttttaccctcgtaagtagtactacgaacgttgggtcgaccgaccgtacggtcccgcggttaacggaaccgtaaaccggtaccgttaggtaacggttacgggaacggttgggggtaacgtaccggggaaccccgtaaaccccgtaaccggtaacgttcgggttaacgtacccgtaacggttacggtttccggtttacccgttaacccgtaacccccttaacggttccccgggttaaccggggaaccgttaaccgggttaaaccctttaaacccgtacggttaaccccgtaaacccggtaaaccgttaaaccccttaccccggtaaacctaaaaccgttaaaaacccgacccgttaaaccggtaacccttaaacggtaacgggtttacgggtaaacgggtttacgggaaacgggttaccgacccggtaagtaaaccccgttaaggtaccccgttaagggaaacccgtaacccgggtacccgggtttaaccctttaacgttaacgttaacggtcggtaacgtaacggtaccggttacccgtacccgaaggttccggttaacgggtacgtaacccggtaaccggttaacggaccgtacccggttaccgggttaacctttcccggtaaccggttccgggtaacccgggg

SEQ ID NO: 209807 - DNA, 740 bp, Homo sapiens
  misc_feature: GYAE6OF02GFBKJ.17.25.C03.1.454.CMB.1.raw
  modified_base (246)..(246): a, c, t, g, unknown or other
  misc_feature (246)..(246): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctcctgcaggcttcnggtattctacgtttacctctagtagtatacaacgtgggtcgcgaccgaggccgcgtacgggaccaaccggacctggaggtcgggatggggagtcggggacctaaacccgtaacgacgttcgggtcgtaccaacgtacggttgttcccgttaccaaccccgtcgtttccccggtaccgggggaacctacgggttaaccctttaacccgaacgtttaccgaacccctaaccggaaaccctttccctaacccgaaagttaaaacccaccgaacgtaccctaacgacggttagggtacgtttaaggacgggtaaccgtccgtacggtaacccgacttcccggtaggaacccggaccgtacccgggtacccgtttacttaacgtttaccgtcgtacggtacgacggacccgttacccgacggtaacgtcccgggttagaaccgtccggtaccggacgtcggtcccggttaccgttacggttaccgttcggtaccggggg

SEQ ID NO: 209808 - DNA, 653 bp, Homo sapiens
  misc_feature: GYAE6OF02GUFLA.17.25.C03.1.454.CMB.1.raw
  modified_base (185)..(185): a, c, t, g, unknown or other
  misc_feature (185)..(185): n is a, c, g, or t
  modified_base (247)..(247): a, c, t, g, unknown or other
  misc_feature (247)..(247): n is a, c, g, or t
  modified_base (302)..(302): a, c, t, g, unknown or other
  misc_feature (302)..(302): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtgcccactcccaggtgcaactggtncagtcgtgggctgaggtgaagacgcgtgggcctgagtgacggtctcctgacgaggtcttcgnggtacttcgtaccgtttacctctatagtatccgaagtggtcgcgccgaggtccgngtacggaaccaacggtccgtaggacggtggagtggggacgtcgggaacctaaacccgtaaccgcggtggtaccagtactggttcgttcctaccaccctacgtcccggtaccggaactaccgacttaccgactacgaacctaccgtacctccctacaaactaaaccactacgacctaacgagttggtaggtacggagtaccgtacgtacatactcgtacgacgtaccgccggttcgtacttagtacgtcggtgtaaccgacgaccgtacccgacgtaccggtcgggtaccgtaccggtcccgtacggccgacggtccggttaccttcgggacccgttcgggagggtacccgg

SEQ ID NO: 209809 - DNA, 870 bp, Homo sapiens
  misc_feature: GYAE6OF02GQUN7.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttctggtgcagcagctacgaagtcgcccactcccgaggtcgcagctggtgcagtcgtgggctggagtagaagacgccgtgggcctcgaggtgaaggtcctccgtgacgaaggtcttcgtaggtacttcctaaccgttttccccgtacttaagtacggttaacttaccgtaaaccggttggggtccgcgtacccgacggggtcccgtcgttacgggaaccgtaaacccggtccgttagggaggttacgggtaggtagggggaccgttcggggaaccccgtaaaacccctaacggtacgttcggtacgtcctaacggtaaggtttcggtacctttacccgaaccccgtacggttaccccggtacccggggtaactaaccggtttaaacccttaaccggttaaccgtacgggaaaccccctaacggttaaacccccgtttccccgtaaacgtaaaacccttaaaacccgtaaccggtaaacccgtacccgttaacgtaacggtaacgggtttaacggttaacgggtaaccgggtacgttaacccgttacggtacctaagtaccggtacggaaacccgaccgtacccggtacccgtttacgttaacgttacccggtggttaacggaccgttaccggtacccgtcccgtaaacggtccggttaccggtacggtaaccggcccgtttacgggcctaccgggtccggttacccgttcggttaccggttccggtacccgggg

SEQ ID NO: 209810 - DNA, 797 bp, Homo sapiens
  misc_feature: GYAE6OF02HKMDB.17.25.C03.1.454.CMB.1.raw
tcagcgtagactagcacgaccggtgctcgatttagtagtgtagatttgggtttgggactcaacaaccacatctgtcctctagagaaaaccctgtgagcacagctcctcaccagtggactggacctggaggactcctcttcgtggtggcagcagctacaagtcgcccactcccaggtcgcagcgtggtgcgtagtcgtgggctaggaggtagaaagtacggccgtgggtcctagtaggtcggtaaggttccgtaccgtgacgtaacggtcttcgtaggttacttaccgttaccgtttaccttaccttaagttaacgttactacgtaacggttggtccgaccgtaccgacggtcccgtacgtaccggaacctaaccggtaccgtaaggtcggtaggtaacgggtagggtacggttaccggaaccgtaaaccctaacgtacgttcggtactaccgacgtacgttcgttaccttacccgtaacccgtcgtacccggtaccggtaacgttaaccgtaacccttaccgtaacgtacccgaaaccgttaccctaaacccgttacccaaaccgtaaaaccttaaaccgaacctacgtacccgttaaacgtacgggtaggttagtacggtaccggacgtacgtaactaacgtcgtaaccggaccggaaccgtacgggtacccgtctttacgtacgttcggtacgtacgacggtactaccccggtaaccgcggttaacgtccgggtacctaccggtcggaacctcggtaaccggtccgttacgttacggtaccggttggaaccgggg

SEQ ID NO: 209811 - DNA, 712 bp, Homo sapiens
  misc_feature: GYAE6OF02GW2XH.17.25.C03.1.454.CMB.1.raw
  modified_base (138)..(138): a, c, t, g, unknown or other
  misc_feature (138)..(138): n is a, c, g, or t
  modified_base (150)..(150): a, c, t, g, unknown or other
  misc_feature (150)..(150): n is a, c, g, or t
  modified_base (411)..(411): a, c, t, g, unknown or other
  misc_feature (411)..(411): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatctctnttggtggcagcngctacaagtcgcccactcccagtcgcacgctgggtgcaggttcgtggggtcctggaggtagaagtaacggccgtcgggggcctacgtaggtcgtaagggtcctccgtcggacgacgggttccttcgtacgggtacttaccgtaacgttttaccctctagttaggtactacgtaacgtgggtacgtccggaccaggccgtacgtacgggacaaccggtccgtacggtaggcggtagtcgggagttcgggacaaccccgtaancggtagttcacactacggtcgttcctacgacctcgtaccgtccgacgtaagtaccttacgaacttacggaccaaccggtacctaccgtaccgaactaaaccgaacaccgtaacctaccgtaacgtacggtaacggttaggaacgggtacgactacgtactacgtacgtacgactaccggtaacccgtcgtaacttacgttctacgtacggtagtaccgactaccggtacgtaacggtccggttagacccggtacgacggtaccgacggtacggtccgttcggttaccgttaccgggtcggg

SEQ ID NO: 209812 - DNA, 653 bp, Homo sapiens
  misc_feature: GYAE6OF02HBOS3.17.25.C03.1.454.CMB.1.raw
  modified_base (438)..(438): a, c, t, g, unknown or other
  misc_feature (438)..(438): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagcctgggcctcagtgaagtctccgtgcaaggcttcgtggattctacgtttacctcctatagtactcgaacgtgggtgcgccaggccgcgtggaaccaacgcctggacgtggagtgggagtgggaccgaaacctaacagtggtcgtacagtagtcgtccttaccgaccctagtcccgtcgggaacacgtactaccatcgaccacgaactcctacaactaacacagtcctanagtacggtagttacggaggtacgccgtacgtactagttaccgtacggaaccggtaccgaccgggttaccgttaccgtttaacgttaccggttacggtacggacggtaccgacgttacccgaacggtcgttcccggggtagtcccggtaacccgtacgggacccttacgggtcccggttacccgttttacggtacccggtttccggtacccggggg

SEQ ID NO: 209813 - DNA, 877 bp, Homo sapiens
  misc_feature: GYAE6OF02FYA2P.17.25.C03.1.454.CMB.1.raw
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctgaggtgaagaagccgtggggcctcgagtggaacggtctccgtagcgaacggtcttcgtaggtattccacgtttaccctctatagtatacgaacgttgggtgaccggtcccgacggtcccgtcgtacggtaaccgaaaccgtacccgttaggaacggtcgggtaaggttacgggggtaggtacgggggtaacccgtaaaccccgttaaccgtacgttgggttaccgtacgtacgtaggttcggttacccttaccgaaccccgtacgttaccccggtaccggggtaactacggtaaccctttaaccgtacgttaccgaaccccgtaaaccgtaaccctccccgtaaacctaaaccgtaaaacccgtaccgaaccggtacccctaacgtacggttaaggggttaacggtttacggaacgggttaacctaccccggtaacgtaacccgtaccgttacggtacggaacccgttaacccgggtacccggtacccggtttaccgtttaacgtttaccgttacggttaccggaccgggtaacggttacccggttaccccggtaaccgggtaaccgggttacccggggttaaggtaacccggtaccccgggttaacggaccggtaccggggtttaccccggtttacccggtttacccgggttaccggtttccggggtaacccgggggg

SEQ ID NO: 209814 - DNA, 808 bp, Homo sapiens
  misc_feature: GYAE6OF02JA6C8.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcagtgaaggtctcctgcaaggcttctggacttctacgtttacctccttagtacgtactacgaacgtggggtcgccggacccgagggcccggtacgttacgggaacccaaaccggtacccgttagggtaacggttggggtaagttaggggggtaacgttaccggggggtaacccgtaaaacccccgttaaacgaaccggttgggttacggttaccgaacggttcggtttacggttccctttacccgaacccccgttaaccttccccggtaccggggaaacctacggtaacccttaaccgtacgttacccgaacccgtaaccggtaaaccccttcccccgtaacctaaaacgtaaacccaaccgtaaccgtacccttaacgacggttacgggtacgtttacggaacggttaccgccgttacggacctacgtaccgtacggaacccgtaaccgaccggtccgtttactaacgtttaccgtacggttcgaccgtaggtaccgtacccgaacgtcggtaccgggtgaacccggtaccggtaccggacgtaccggtaccggttcccgtttacggtccgtttcggtacccggggg

SEQ ID NO: 209815 - DNA, 725 bp, Homo sapiens
  misc_feature: GYAE6OF02JKPKR.17.25.C03.1.454.CMB.1.raw
  modified_base (498)..(498): a, c, t, g, unknown or other
  misc_feature (498)..(498): n is a, c, g, or t
tcagcgtagactagcacgaccggtgctcgatttagtagtgtagatttgggtttggggacgtcaacaaccacatctgtcctctagagaaaaccctagtgagcacagctcctcaccatggactggacctggaggatcctcttcttggtggcagcagctacaagtgcccactcccaggtgcagctggtgcagtcgtgggctgaggtgaagaagccgtaggggcctcagtgaacggtctccgtgcaagggtcttctggtattactacgttacctcctatagtactcaagtggtgcgcaggcccgtgcggaccgaaccgaccgtacgaggtggtacgtaggggacgttcgggggaacctaaccccgtaaacgtacgtcgggttaccgaacgtaacccgtaggttacgtcccttaccgtaaccctaccggtacccgttccgggaactaccggtaccttaccgaacgtacgcccgtaaacgaacctcccttaacgaaacctaaanaaccgtaacgtccctaaagtctaagggtaacgtttcggaagccggttactagacctagtacgtacggaacctccgacgggtacccttacttaacgttaccgtacggttagacccggtacgggtacctaaccccggagggtacccgttgggttacccgaccggttacccgtaacggccgaacggttccgggttacccgtttaccgggtacctttcccgggaccggggg

SEQ ID NO: 209816 - DNA, 743 bp, Homo sapiens
  misc_feature: GYAE6OF02GYHNW.17.25.C03.1.454.CMB.1.raw
  modified_base (475)..(475): a, c, t, g, unknown or other
  misc_feature (475)..(475): n is a, c, g, or t
  modified_base (620)..(620): a, c, t, g, unknown or other
  misc_feature (620)..(620): n is a, c, g, or t
  modified_base (664)..(664): a, c, t, g, unknown or other
  misc_feature (664)..(664): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaagtcttcgtggattctacgtttacctctatagtactcaactgggtgcgccgacggccgtacgtcggacctaacgaccgtgtaacggtcggagtcgggagtcgggaccgaaacccgtaacgacgtcggtacgtccaagtacgttcgtccttaccgaccctacgttcccggaccggaacgtaacgtaacctttacccgaacgttcggaaccctaacggtaaccttcccgaaccgttaaanaaaaccaccgaacgtttaccctaaacgaggttccgggttaaacttcggggaacgggtaacctccccggtagtaaccctacggttcgtaaccgggaacgaccccggtaaacccgggggtccttttaacggtcctttttaaacgggngtaccccggtaagtaccgggtacccgttaacccaaacggggttntccccggggttaacccgggaaccgttaccggacgtaccggtccggtttacccgttggtaacccgtttcgggaccggggg

SEQ ID NO: 209817 - DNA, 786 bp, Homo sapiens
  misc_feature: GYAE6OF02JFY7Q.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtagaagaagccgtcggggcctcgagtagaacggtctccgtgacgaaggtcttgtggacttaccgtacgtttacccgtaccttatagtaactcgtaacgtgggtcgcgaccgtacggccgtcgtacggaccgtaaccgaccgtaggacgtagggagtggggacgtacgggaccgtaaaccccgtaacgtacgtcggtacgtaccacggtacgttcgttaccgttacccgaacccgtaccggttcccgtaaccgggaacctacgtaacccgttaaccgtacgtaccgaacccgaaccgttaaccctaccgtaaaccttaaaactaaaacccgtacgtaaccgtaacccgttaactaggtaacgggttcgtaagggtaccgtaacggtacccgtaagaccgttacgttacgtaacgggttaaccgtacggttaacccggtcgtttaacgttaaacgttccggttacgtaacgggtacgaggtacccttcccggaaaggtcccggtttacggccgggtaaccgttcccggaaccggttcgaccgggtttacccgtaccggttttcgtacggttcgggtaaccccgggg

SEQ ID NO: 209818 - DNA, 648 bp, Homo sapiens
  misc_feature: GYAE6OF02JPT0M.17.25.C03.1.454.CMB.1.raw
  modified_base (169)..(169): a, c, t, g, unknown or other
  misc_feature (169)..(169): n is a, c, g, or t
  modified_base (215)..(215): a, c, t, g, unknown or other
  misc_feature (215)..(215): n is a, c, g, or t
  modified_base (343)..(343): a, c, t, g, unknown or other
  misc_feature (343)..(343): n is a, c, g, or t
  modified_base (498)..(498): a, c, t, g, unknown or other
  misc_feature (498)..(498): n is a, c, g, or t
  modified_base (518)..(518): a, c, t, g, unknown or other
  misc_feature (518)..(518): n is a, c, g, or t
  modified_base (546)..(546): a, c, t, g, unknown or other
  misc_feature (546)..(546): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagactgtgacatccagatcgacccagtcnccatcctccctgtctcgcctcgtggtcggggtacagtacgtcaacnctcctacgttggaccgtaacacgtccgacggtaacgtttaaaactactttaaagtcggtatccgagtaccaacgaaaccgtacggaaaaccgtccccaagtaccctacgtaacgtacttaccgttcgnggttacgctacctacccgtattccgaggacgtaacggtcggtcctaaccgtagttccgttaaggtccgagggtcgacgtgtacgtacttcggagtactagtacttacaacgtctacgaccattacccactcgtacgctacccgtacgtgaagttntcgtaatctaatctctatanaccagtataccgttactacccgttcctnttaaccgttcgttacggacccgttaaggaacccttagtacgaacggtccttaaacggaacttagtcggtacacgtaccgtcctacgtcgttaccttggtacc

SEQ ID NO: 209819 - DNA, 957 bp, Homo sapiens
  misc_feature: GYAE6OF02HIKZC.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtacagtcgttggggcgtgaggtaggaagaacgccgtcggggccgtcgaggtggaaggtcctcctcgcgaaggtcttcgtggtattcgtaccgttttaccttacctaacgttagttactacgaacgttgggtgtccggtccgaacgggccgtccgtacgggaaccgaaaccggtacccgttagggtacggttggggaacggttagggggtaacggttcgggggaaaccggtaaaccccccgtaaaacgtaccggttcggggttacgttaccgaaccggtacgttcgggttttacccctttaccctaaccccgtacctttaccccgggtaccccgggggtaacctaaaccggttaacccgtttaaaccccgacggtttacccgaaccccgaacccggttaaacccctccccgtaacccctaaaacttaaaaccccggaacccgtaccggtaaaccctaacccggtaagttaccggggtaagggtttacgggaaacgggtacccggaccccgttaacggtaccctaacggttaccccgttaggaaccccgggaaccggtttaaccccggggtccgggttttaaccctttaaccgttttaccgggtttacgttaccgggcccggtaaacgttaacccggggtacccccgaggttaaccccgggtaaccccggttagggttaaccccggaccggtttaccccggtaccgggaaccccgggttaggttcccgggtttcccggttaacgggtttccgggttaccccgggggttaacccgggg

SEQ ID NO: 209820 - DNA, 745 bp, Homo sapiens
  misc_feature: GYAE6OF02HZVBH.17.25.C03.1.454.CMB.1.raw
  modified_base (185)..(185): a, c, t, g, unknown or other
  misc_feature (185)..(185): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtncagtcgtgggctgaggtgaagagctgggacctcagtgaacggtctcctgacaacggtcttcgtaggtacttactaaccgtttacctctatagtactaccaacgtgggtcgcgaccgacggccgacgtggaaccacgtacctgaggtaggatgggagtacgggaacctaaaccgtaacacgttaggtcgtaacaacgtagggtacttaccgttaccaaccccgttaagttcccggtaccggggtaacaaccggttaacctttaaccgaacgtacccgaaacccgtaaacccgaaccgttaccccgttaaacctaaaaccgtaaaacctaaccgtaaccggtaaccccttaaagtacggttaggttaaaggttacggaacgttaacgtacccgttagaactaacgtcgtaacggaaccgaacgttaccggtaccttacgttaacgtttcgtaggttacgacggtaacgtacggttaccccgaaggtaccgttaccggttacgacggtaaccctcgggaccgtacggttcccggtacgttttacggtacttcgggtaacgggg

SEQ ID NO: 209821 - DNA, 992 bp, Homo sapiens
  misc_feature: GYAE6OF02GU9ZM.17.25.C03.1.454.CMB.1.raw
  modified_base (905)..(905): a, c, t, g, unknown or other
  misc_feature (905)..(905): n is a, c, g, or t
tcagcgtagactagcacgaccggtgctcgatttagtagtgtagatttgggtttggggactcaacaaccacatctgtcctctatagaaaaccctgtgagcacagctcctcaccatggactggacctggaggatcctcttcttggtggcagcagctacaagtgcccactcccaggtgcagctggtgcagtcgtgggcttggaggtagaaaggaacgccgtcggggcctacgaggtaggaaacggttcctccctaggacgtaacgggtccgtttcgtacgggtactttacctaacccggtttttaccctaccctttaagttaacggttaacttaccgaaaccggttgggggtacacccggtaccggaaccggggtcccgtaccggtacggggtaaacccgtaaacccggtacccgttacgggaaggggtttacgggaacggtttaggggggtaacggttcccggggggaacccgtaaaaccccccgttaaacggtaaccggtttggggttaccgttacccgaaggtaccggtttcgtttacccgtttaccccgaaccccttacgggtttccccgtaccggggtaaccctaacgttaaacccgtttaaccctaacggttaacccgaaaccccgtaacccgtaaacccctttccccgaaaaccccttaaactaaaacccggacccgaaacttaccccgttaaacgtacgttacggggtaacgggtttacggaaccggggttaaccttaaccaccggggtaaaccttacgttacccggttaaccggaaccgggtaaccggaacccccggggtttaacctttacgttaaaccgtttccggttagggtacccgtaccgggttaaacgttcccccggtaaccccggttaggtaacccgggttacccggggttanaacccggttaccccggttaaaggccccgtttaaccgggttccggtttaaccccgttttagtacccggggttccgggtaccccggggg

SEQ ID NO: 209822 - DNA, 691 bp, Homo sapiens
  misc_feature: GYAE6OF02IB175.17.25.C03.1.454.CMB.1.raw
  modified_base (268)..(268): a, c, t, g, unknown or other
  misc_feature (268)..(268): n is a, c, g, or t
  modified_base (308)..(308): a, c, t, g, unknown or other
  misc_feature (308)..(308): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactctcttcttggtggcagcagctacaagtcgcccactcccaggtcgcagctggtgcagtcgtgggcctggaggtagaaacggagtccggtgggggcctacgagtggaacggtcctccgtcgcgtaacgggctttcgnggtactttctaccgtttacctactatatctacacgtggcncgcgacgcgcgtcgaacacgacgtggacgtggacgtgggtagtacgggaccgtaaaccgtaacgtacgtgggtactaaccgacgtacgtcgttcctaaccgtaccctcgttacccgaccggtaactaccggttacctaactcgaaccgtaaccgtaacctaacccgtacctaaccctaaacgtaaacacaacgtaccgtaactaggtacggtaggttacggacggaccgaccgtacgtaactacgttcgacggaaccgtaccggtaccgttaccgtacgttacttaggtcgtacgacgacgtaccgtaccgacgtaccggtcggtacggaccgaccgtaccgacgtacggtccggttacggttcgttacgttccggtacgggg

SEQ ID NO: 209823 - DNA, 683 bp, Homo sapiens
  misc_feature: GYAE6OF02GMW5R.17.25.C03.1.454.CMB.1.raw
  modified_base (531)..(531): a, c, t, g, unknown or other
  misc_feature (531)..(531): n is a, c, g, or t
  modified_base (589)..(589): a, c, t, g, unknown or other
  misc_feature (589)..(589): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagcctggggcctcagtgaaggtcctcctgcaaggtcttctggattcgtaaccgttttaccctcctaagttagtaacttaccaacgttggggttcgccggtaccgacgggcccgcgtgggaaccaacgtacccgtggaggtggaagtggggagtcggggaccgtaaccctaacgacgttggtgtaccaacgtagtcgtccttaccacccgtacttcccggtaccgggacaacgtaccttaccgaagtccgaccaaccgaacctcctaaccaataaacccacgaactcctaagtacgtggaaggttcgaaggtacgctacgaacctntcgtacggaaccgacgtaaccggtccgtagtttactaccgtgtcgacggtacgtaccncccggtaacgtacggttaccggtcgaaccggtccccggtaaggcccgaccgggtcccggttaacccgtttcgggtacccttcggggtaccgggg

SEQ ID NO: 209824 - DNA, 772 bp, Homo sapiens
  misc_feature: GYAE6OF02IB2BU.17.25.C03.1.454.CMB.1.raw
  modified_base (248)..(248): a, c, t, g, unknown or other
  misc_feature (248)..(248): n is a, c, g, or t
  modified_base (362)..(362): a, c, t, g, unknown or other
  misc_feature (362)..(362): n is a, c, g, or t
tcagcgtagactagcacgaccggtgctcgatttagtagtgtagatttgggtttgggactcaacaaccacatctgtcctctagagaaaaccctgtgagcacagctcctcaccatggactggacctggaggatcctcttcttggtggcagcagctacaagtgcccactcccaggtgcagctggtgcagtctgggctggaggtgaagaagccgtgggcctcaggtgaaaggtctcctgacaaggtcttcgngtagttcacggtttacctacctatagtaatctaacctggtgcgccaaggccgctggactaacgacctggacgtggatgggatggggaccaaaccgtaacacgtgggtcacgtanagtcgttcttaccacccgtagcccgttaccgggaacctacggtaccgttaccgaacgtcgaaacccggataacccgtacctaccctaaaacgtaaaacccgaccctaaacggaccccgtaaacgttaacccggttagggggaaacggtttaacggaacggggtttaccggacccgtttaggggaaaccctaaccggttaccgtacgggaaacccgtacggtaacccggggttacccgttacgttttaaaccttaacgtcggttaacgggtgtaacccgggtaaccggtttccccgaaacggttaccgtaccccggggtaggtaacggtaacccccgggttacgaacccgggtacggttaccccggggaccccttttttaccgaaccggtttttcccggaacccggggggg

SEQ ID NO: 209825 - DNA, 757 bp, Homo sapiens
  misc_feature: GYAE6OF02FPDPW.17.25.C03.1.454.CMB.1.raw
  modified_base (308)..(308): a, c, t, g, unknown or other
  misc_feature (308)..(308): n is a, c, g, or t
  modified_base (400)..(400): a, c, t, g, unknown or other
  misc_feature (400)..(400): n is a, c, g, or t
  modified_base (640)..(640): a, c, t, g, unknown or other
  misc_feature (640)..(640): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagttcgtggggctggaggtagaagaagccgtggggcctcgaggtagaggtctcgtgacgaaggtcttcgcggtattctaccgtttacctctattagtatccaacgtggtcgcgccgagggccncgtcggaacaacggacctggacgtggagtgggagtcgggacccgaaacctacgacgttgggtctacgacgtagttcgtccttaccgaccccncgtttacccggtaccgggaacacgttaaccgtttaaccgacgttacgaaccccgtaaccgtaaacccgttcccctaaacccgtaaactaaaacccgtaaccgtacggtaaaccccttaaacgaacggttacgggtaacggttttacgggaaacgggtaccgttccgtacgtaacctaacgttccggtaacggacccggaaccggttacccggtaccctttaagtttaccgtttaaccggngttacggacgtaccggttaccgtaccccgacggttaccgggtccggttacggaccggttccccggtaggaccgtacggtccggtttacctttccggtaccggtttcggtacccgggg

SEQ ID NO: 209826 - DNA, 902 bp, Homo sapiens
  misc_feature: GYAE6OF02JZRH3.17.25.C03.1.454.CMB.1.raw
  modified_base (230)..(230): a, c, t, g, unknown or other
  misc_feature (230)..(230): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttgttggtggcagcagctacgaagtcgccctactccaggtccaggttggtgacatcgtaggggctagaggtagagaccgtcccgtgggttcccngggtgtagggtcctacctgactacggtcgttcgaggacggtcctaaccgttcgacgttcgaaccttagttacggtttcgaagttcgggtagacccggtacgggtctacggagtaaccggtacggtccttggacgtggaaggtggaacgtcgttcccgtacgtaacgttcggtaccgtaacgaccgaaccgtaaacgtacgaccgttaaacgacgtttaacccggtacggtaaccgaacggtaaccgaaaccttacccgtaaaacccgaacccggtaaaccggggtaaccgtaaacccttaaacgggtttaaaccgaaaccttaacccgttaacgttttaaacgggtaacccgtcggtaaaaccgggtacccggttaacgaaccggtaacgggttacccttaaccttaaccgtcggtttaaacccgtagggtaacggtaacccgggttaacccgggtttcccttaaacgttttacccaccgggtttaagtcgggtaaccggtaaccgggttaaaccgtttaacgttaaacggttacccgtaaaccgttcgttaacccggtttacgtttttaccccggttaaccctaacccgtttaaccggttttacggggttaccttaacccgggttaccgggtaacctaacccggggttaccccggtaaacccggtttcccg

SEQ ID NO: 209827 - DNA, 823 bp, Homo sapiens
  misc_feature: GYAE6OF02GLC5H.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtagaagagccgtgggcctgagtgaaggtcctcgtgcaggtcttcgtggattcacgtttacctcctatagtatcaacgtggtcgcgcacggccgcgtggaacaaccgacctggacgtggacgtgggagtcgggaccgaaaccccgtaagtaccgttgggtacgtaccaacgtaggttcgttaccttacccaaccccgtacgtttccccggtacccgggggtaacctaaccggttaacccttttaaccccgaacggtttaccgggaaaccccctaaaccccgggtaaaaccctttcccccgttaaacccgtaaaactttaaaaaccccaaccgtaaaccgtacccttaacgtaacgttacggggtaaggtttaaccggagggtaaccgtaccggttacgaactaaccgttccgttaacggaaccccgtaccggtaacccgggtacccgtttaccgttaaagtttacccgtttcggaaccggtaccgtaaacgggtacccgttacccccgtaagggttacccggttacccggggtaccggtaaccggtaccccgttaacccggggacgtaccgggttacccgggtttacccttttcgggttaacccgttcccgggtacccgggggg

SEQ ID NO: 209828 - DNA, 618 bp, Homo sapiens
  misc_feature: GYAE6OF02G0X6L.17.25.C03.1.454.CMB.1.raw
  modified_base (257)..(257): a, c, t, g, unknown or other
  misc_feature (257)..(257): n is a, c, g, or t
  modified_base (309)..(309): a, c, t, g, unknown or other
  misc_feature (309)..(309): n is a, c, g, or t
  modified_base (606)..(606): a, c, t, g, unknown or other
  misc_feature (606)..(606): n is a, c, g, or t
tcagcgtagactagcacgaccggtgctcgatttagtagtgtagatttgggtttgggggagtcagtctcagtcaggacacagcatggacatgagggtcccgctcagctcctggggctcctgctactctggctcgagctgccagatgtagacatccagatgacccagtctccatcctccctgttctgcctctggtggggtcagagtcaccatcacttgccggacaagtcgacggacttaaaactattaaagttagtatnacgacaagtaaacctaggaaaacgccccaagacctctagactctctgtgcancctactcaggcgaagtcgaccgtaccctaatccggtagttcagggtgactaggtgtactcggtacgggtaacgtaacgttaagtttacaaacgttctaccgaacctacgtaaccaccctaactcgtaccgacctaacgtacggacgtagttgtacgtaacaacttactaacttactactaacgaactagtaacgttactaaccgttccctaccgtcttacgtttcggacgtaacggaaccggttaagtaggacgtaaactaacgtaaacgtacgtaggtcgacggtacaccgtaacncttagtcgttac

SEQ ID NO: 209829 - DNA, 741 bp, Homo sapiens
  misc_feature: GYAE6OF02JRT6G.17.25.C03.1.454.CMB.1.raw
  modified_base (385)..(385): a, c, t, g, unknown or other
  misc_feature (385)..(385): n is a, c, g, or t
tcagcgtagactagcacgaccggtgctcgatttagtagtgtagatttgggtttgggagtcagtctcagtcaggacacagcatggacatgagggtccccgcgtcagctccgtggggctcctgctactctggctccgagctgccagactgtgacatccagatcgaccctagtctccatccctccctgtctcgtcctcgtaggtgggggtacaggtacgtccacctactcctagttccggaccggtacaacgtcgacggtaaccgttaaaaccttaatttaacgttggtactcgagtaccgaaacgaaaccgttaacggggaaaactaccccaacggtaaccccttaccgtggtaaccttccgtcgttgggtacgtacacgttacccnccttcgtagacggaacggttcggccgttccaacgtcggtacggttcgtacggtggtcgaggttcgagtaccgtggggtaactacgttatttaaccgaattcctaaccacctactaacaccctaacgtcctacgacccttaacgaggtggtacttcggtacgtaacttaaccgtacgttacctaacgtacctacgtaaagtaacggtacctttaacccggtaccgttccgttaccgtcgtttacccggttaacggaaccgggggttacgtaaacccggttaagtacgtaacgtaaactacccgttaaacgacggttacgtcgtaccggtaccaccgttacctattccggttataccc

SEQ ID NO: 209830 - DNA, 673 bp, Homo sapiens
  misc_feature: GYAE6OF02F461Q.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcgagtgaacggtctccgtgcaaggcttctggattcacgtttacctcctatagtatctaacgtgggtcgcgccaggtccctcgtacggacaaccggacctggacgtgggagtcggggatcgggaccgtaaaccctaacgtacgtgggtcgtaccgtacgtagttcgttccttaccgacccctacgtcccggtaccggtaactacgtaaccttaccgacgtcgtaacccaaccggtaaccctccctaacctaaactaaacccaacgacgtaccctaactagtcggtaagtttacggaagacggtcctaagacctagtcctaggaacctacgaacccggtccttacgttacgttacgtgtacggacgtaacgtcgtacccgacggtacgtccgggtacgtacgtaccggtacgtccgacgggttcccgttacgtttacggtacccgttcgggtaccggg

SEQ ID NO: 209831 - DNA, 669 bp, Homo sapiens
  misc_feature: GYAE6OF02I0NKO.17.25.C03.1.454.CMB.1.raw
  modified_base (288)..(288): a, c, t, g, unknown or other
  misc_feature (288)..(288): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagccgtgggcctcagtgagtctctgcaggcttctggacttcacgtttacctctatagtatacaacgtgggtgtcgccgaggccncgtcggacaacgtacctggagtggatgggagtcgggacgaaccctaacacgtggtcgtacacgtaggtcgttccttaccgaccctacgtcccgtaccgggacctaagtaccttaccgacgttacgaacctaccgaacccttcccgtaaccaaacttaaaccaccgtactaccctaaccgtacgtacggtaacgttaggaacggtaccggtactacggtaacctacgtacgtaggaacccgtaccgaccggtccgttacgttaacgttacgttgtaccggtacgtaacgtccggtaccctacggtaacgttcccgggtacgacccggtacccggtacggcctacgggtccgttcctttacggtccggttccggtaaccgggg

SEQ ID NO: 209832 - DNA, 794 bp, Homo sapiens
  misc_feature: GYAE6OF02HQMLY.17.25.C03.1.454.CMB.1.raw
tcagcgtagactagcacgaccggtgctcgatttagtagtgtagatttgggtttggggactcaacaaccacatctgtcctctacgagaaaaccctgtgagcacagctcctcaccatggactggacctggaggatcctcttcttggtggcagcagctacaagtcgcccactcccaggtcgcagctggtgcagtcgtgggctgaggtcgaagagccgtggggcctgagtgaacggtctcctgacgaaggtcttcgtggtattccgtaacgtttaccctacgtatacgtactacgtaacgttgggagtaccgccgtaacgggcccgtacgtcgggaacctaaccgggtcccttaggacgtagggtacgtcggggtagtaccggggaccgtaaaccccgtaagaccgttagggtcgtacctacgtacgtttcgtaccgtacccaacccgtacgtacccggtaccgggtaacaccgtaaccttacccgaagtaccgaaccctaacgtaaccctcccgtaactaactaaaccacgtacgtaccctaagtaagtcgggtaagtttcgggaaagacccgttagacgtaacctaaccggttcgtaacccgggaacccgtaccggtacgggtacccgtttacgtttaaccttaaccggttggaaaccgtccgggtaaccggtacccgttaccccggaacccgggttaacgttccccggggtaagtacccgtaaccccggttagggtccccgtaacggtaaccccggtttccgtttacggttacccggttacggaccccggggggg

SEQ ID NO: 209833 - DNA, 759 bp, Homo sapiens
  misc_feature: GYAE6OF02FPA6U.17.25.C03.1.454.CMB.1.raw
  modified_base (728)..(728): a, c, t, g, unknown or other
  misc_feature (728)..(728): n is a, c, g, or t
tcagcgtagactagcacgaccggtgctcgatttagtagtgtagatttgggtttgggggactcaacaaccacatctgtcctctagagaaaaccctgtgagcaccagctcctcaccatggactggacctggaggattcctacttcttcggtggcagcagtctacgaagtcgaccacgtcccaggtgccagtcgtggtcgacgtagtccgtggggctaggagggtagaaggaacggtccgtacgggggtcccttacggaagtcggtaaacgggttcctaccttgggactaaagggtcccgttttactacggggtactttaccgtaaccgttttaccccggtaccttaaggttacgttaacttaaccgtaaccgttgggtcgtcgtaccgagggccctcgtacgggacctaacggaccgtgacggtaggtagtggggacgttcgggaccgaacccgttaagaccgttaggtacgttaccacgtaagttcgtaccgttacgacccctgtacccggtacggaactacggaacctttacgaacgttacgaacccgtacgtaaccgtccgtaaccgtaaacaaacgacctaacgtaccgtacgacgtacgggtaacgttcggaagccgtacgaacgtactacttacgacgtaaccgacggaacgttccgtaacgtttagttcgcgtagcgtagcccggttacgacggtacgtccggtcgaacggttcacgggtacnccgggtcgttaccgtcgtacgtcggtacggg

SEQ ID NO: 209834 - DNA, 737 bp, Homo sapiens
  misc_feature: GYAE6OF02I72Q3.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcgagcagctacaagtgcccactcccaggtgcagctggtgcagtcgtgggctgaggtgaagaagcctggggcctcgagtagaaggtactccgtgacaaggcttcgtaggacttcaacgttttacctcctatagtactacaacgttgggtgcgtaccaaggccgacttcggaccaaaccgtaccttaggaacggtcggtaagtgggggaacttacgggggaccaaaaccccgtaaacacgtacgggtatcaaccgtagtcggttccttaccaccccaattccccgtaccggggactacgtaaccttaacccattaccgaacctaaccggaacctacccttaccaaacgttaaaacacgtaacgacccttaacgaactgggtaacgttcggaaggaccgtcctagtactacgttacgtacgaaccggtaccgtaaccgggtccgttaaccacgttttaaccgacggttcgggtacgtaacgggacttacccccggaacggtaacgttccccggggtaagtaaccggtaccccttaccgggacctaaccgggtacggtaccccttttacgtaccggtttcccgtaacccgggggg

SEQ ID NO: 209835 - DNA, 722 bp, Homo sapiens
  misc_feature: GYAE6OF02FIJWP.17.25.C03.1.454.CMB.1.raw
  modified_base (271)..(271): a, c, t, g, unknown or other
  misc_feature (271)..(271): n is a, c, g, or t
tcagcgtagactagcacgaccggtgctcgatttagtagtgtagatttgggtttgggagtcagtctcagtcaggacacagcatggacatgagggtccccgctcagctcctgggggctcctgctactctggctccgagctgccagatgtgacactccagatacgacccagtctccattccctccctgttctcgtcctcgtggtgggggtcagagtccacatctactcgaccggataacgtcacggtactttaaaaccttatttaacttggtancagcaagaaccgtaggaaaccgccccaataccgtcctatacttacgtcgtggtcgcacacctactctacgacgtaggtcgtccggtacctgcggtacgtcgtagtcggacgaggtggacttcggtggaactaaggtttacttacgtaacttcctacaaccgtctaccaacccgtcttacgtacggtacctaacgtcgggtaacggttatacggttaacgttaacctacgtttaaccttacgttaaccttaacgggtaccttaaacgtaacggttaactttacccgttacccgttacccgtttacgtaccgtttaccgtttaccgggaacccgtaaagggggttaaccttaaggttaacggtaggttaacctaaccggaaaaccggtttaacgttaccgggttagtaccgggtaccttaacccgaccggtttacttccgttaccggtttacc

SEQ ID NO: 209836 - DNA, 785 bp, Homo sapiens
  misc_feature: GYAE6OF02GQX77.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttctggtgcagcagctacaagtcgcccactcccaggtgcagctggtgcagtcgtgggctggaggtagaagagccgtgggcctgaggtaggaaggtcctacgtgactaaggtccttgtaggtatttaccgtaaccgttttacctccttaagttacgttactacgtaacggttgggttcgccgacccgtagggcccgtgtacggaaacctaaccggtacccgtaggacgggttaggaacggtggggtaaggtccggggaacccgtaaacccgtaacgtacggttagggtacgtaccgtagtaacggttcgttaccttacccgaacctcgttacccgggtacggtaacaacgttaccttaaccgacgtacgaacccgaaccgttaacccttaccctaccgaaaacgtaaacctaccgaacgtaccctaacgagttacgggtacgttaagggacgtaccgtacgtaacgtacgtactcggtaacggaccgtaaccggtaccgtccgttacgttacttacgttaggtacggacgttaccggtacgtacccgtaacggtaccggttaccgggttaacgacccggtaccggttacccggacggttaccggttacccggtttacggttaccggttaccggttccgggtaacccgggg

SEQ ID NO: 209837 - DNA, 779 bp, Homo sapiens
  misc_feature: GYAE6OF02HOFGJ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtggaagaagttcgtggggcctcagtggaacggtcctccgtgacaaggtccttcgtggtacttctaaccgtttaccctacctaatagtactacgtaacgtgggtcgccgccgacggcccgtcgtacggacctaaccggaccgtaggacggtaggaggtggggtagtacggggaccgtaaaccccgtaacgtaccggttggttcgtacgtacgtaggtcgtttaccttacccgaccccgtacgttcccggtaccggaacctaccgtaacccgttaccacgttaccgaaccccgaaccgtaaccccgtcccttaaccaaactaaaaccctaccgtaacaccccgttaacgtacgtacgggttacgttaacgggaaccggacggttacccgtaggaaccgtacgttaccgtacgggaacccggtacccgtacccgggttaccgttaacgttaccttaccggttcggacggtacggtaccgtaccgtcccggtaccggtaccggtcccgggaacgtacccgtacccggtacggaccgtccggtccgtttaccggttacgttcccggttaccgggaccgggg

SEQ ID NO: 209838 - DNA, 880 bp, Homo sapiens
  misc_feature: GYAE6OF02ILCQU.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctggaggtgaacgagccgtggggcctcgagtgaagtctcctgcaggtctcgtggattctaccgtttacctctaagttagtaactctaacggtgggttcgccgtaccgagggtcccacgtacgggaaacccgtaaccggtaccgtggacgggttacggtaggtaggggtacggtaccggggtaacccctaaaaccccgttaacggtaccggttagggtaccgttacctaccggtagtttcccgttaaccttacccgaaccccgttcgttaccccgggtacccggggttaaaccctaaaccggttacccgtttaaccgtaaccgttacccggtaaaaccccgtaaccggtaaaccccctttaccccggtaaaccccttaaaactaaaaccccgtacccgtaaccggtaaccccttaaccgttaaggttcggggttaaacggtttcgggaaaccggttaccgtcccgtaacggtaaccgtacgttaccgaaccgggtaaacccgtcccggttaacccggttacccgttttaacttaccgtttaaccggtcggtaacccgggaacgttacccgggtaacccgttacccggaaccggttcggttaaccccgggtgaaccccggttccgaacccgggtaccgcccgggttaccggttcctttacggttaccccggttgggtaccccggggg

SEQ ID NO: 209839 - DNA, 630 bp, Homo sapiens
  misc_feature: GYAE6OF02IVFFV.17.25.C03.1.454.CMB.1.raw
  modified_base (248)..(248): a, c, t, g, unknown or other
  misc_feature (248)..(248): n is a, c, g, or t
  modified_base (297)..(297): a, c, t, g, unknown or other
  misc_feature (297)..(297): n is a, c, g, or t
  modified_base (386)..(386): a, c, t, g, unknown or other
  misc_feature (386)..(386): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagcctggggcctcagtgaaggtctcctgcaaggcttcgtggnttctaccgtttacctcctatagtatcaacgtgggtcgccgccgaggccncgtaggaccaaccgtacctggacgtggagtgggagtcgggaccgaaaccctaacgacgttggtagtcacgtagttcgtccttccacccngtcccgtacgggacacgtaccttacgatcgaccaacgtacctcctaccgtaaataaccaccacgtaccctacgaagtgggaagttcggaacggtactcccgtaggaacacttaccgtaggaaaccgtaccgccgggttacccttactttacgttacgttggccgacggactacgtaccccgaaggtcgaccggttagaccctccgtacgctacgggccgtttaccgttctccggttcggcgggg

SEQ ID NO: 209840 - DNA, 821 bp, Homo sapiens
  misc_feature: GYAE6OF02GXLGH.17.25.C03.1.454.CMB.1.raw
  modified_base (183)..(183): a, c, t, g, unknown or other
  misc_feature (183)..(183): n is a, c, g, or t
  modified_base (185)..(185): a, c, t, g, unknown or other
  misc_feature (185)..(185): n is a, c, g, or t
  modified_base (241)..(241): a, c, t, g, unknown or other
  misc_feature (241)..(241): n is a, c, g, or t
tcagcgtagactagcacgaccggtgctcgatttagtagtgtagatttgggtttggggactcaacaaccacatctgtcctctagagaaaaccctgtgagcacagctcctcaccatggactggcctggaggatcctcttctggtggcagcagctacaagtcgcccactcccaggtgcagctggtncngtcgtgggctgaggtgaagaagccgtgggcctcaggtgaacggtctctgcaggctnggatctacgttacctcctaatagtactcgaacgtgggtcgcgcccgacggcccgtcgtcgggtaaccgaaccggtaacccgtggtaacggtgggtacgttgggggaacgttacggggacccgtaaaacccgtaacgtaccggttaggttccgtaaccgtacgtaaggtttccgttaccgtttaacccgaacccccgttcttaccccgggttacccgggaacgtaacccgggtaaacctttacccgaacgtaacccgggacctaaacccggtaaaccctttccctaacccgtaaaacccgttaaaaccgacctaaccgggtaaccccttaaaccagggttaaccgggttacggttaggtaaccgggaaccgtccttacgggaaacctcgtaaccgtaccgggtaaacccgacccggtaccgggtaacccctttaggttaaacctttacggcggttacggtcccgaacggttcccgcccccggtaaggtaacccctccggggtttacgaccgggttacccttacgggacccgaccgggttcccggttaccgtttcccggttcggttaccccgggtaccgggg

SEQ ID NO: 209841 - DNA, 807 bp, Homo sapiens
  misc_feature: GYAE6OF02GX0WZ.17.25.C03.1.454.CMB.1.raw
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggacagcagctacaagtcgcccactcccaggtgcagtcgtggtcgcgtagtcgtggggctaggacggtagaagacgccgtcgggtcctcgagtacgtaacggtcctcgtgcgtaacggtcttacgtagtacttaccgttaaccggttttacctccgttaattacgttaacgtaccgtaaacggttggggtccacgaccggtacggtcccgtacgttaccgggaaccaaccggtacgttacggacggttagggtagtacggggacgttcccgggaaccttaaaccctagtccggttaggtccttacgaacgttcggttcctaccgtaacccgtaaccctccggttacccggtaccggacctaaacgttacccttacgacgttaccgaaccaaccgtacctaccgaaacgtaaacaaaccgtacgactaaccgtataacggtcggtaggtacgacggtctacgtacgtactcggttaccgacggtaaaccgtccgtaaccggttacgttcgtttaaaccggttccgttcggtaacggacccgtaacgggttacccctaaccgggtacccggttacggttacccgggttacgacccgggttaaccgccggttaacccggccgggtttacccttttcggtaccgttttcccggaagggtccccggg

SEQ ID NO: 209842 - DNA, 709 bp, Homo sapiens
  misc_feature: GYAE6OF02FUUXI.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtcggggctggaggtgaagacgccgtcggggcctcgagtgaaggtcctccgtgacaaggtcttcgtggtacttccgtaccgtttacctctatagtactactaacgtgggtcgccgtccgacggccgtcgtacggaccgaaccgtaccgtggaggttcggaggtggggtagtacggggacccgtaaacccgtaacgtacgtggttacgtaccacgtagttcgttccttaccgaccctacgtcccgtccgggaacctacgtaacccttaccgacgtaccgaacccgtaccgtaacctccctaccaaacttaacccgaacaacgtaccctaacgtagtacggtagttaggacggttacgccgtacgtactacgtccgttacggacgtaccgaccggtcccgttacttaccgtttacgtcgtcgaaccgtacgtaccgtacccgtacggtaaccggtaccgggtacgtaccgccgttacggacgtacggtccggttcccgtttaccgtacgttcggtaccgggg

SEQ ID NO: 209843 - DNA, 683 bp, Homo sapiens
  misc_feature: GYAE6OF02ITXOL.17.25.C03.1.454.CMB.1.raw
  modified_base (560)..(560): a, c, t, g, unknown or other
  misc_feature (560)..(560): n is a, c, g, or t
  modified_base (618)..(618): a, c, t, g, unknown or other
  misc_feature (618)..(618): n is a, c, g, or t
  modified_base (627)..(627): a, c, t, g, unknown or other
  misc_feature (627)..(627): n is a, c, g, or t
  modified_base (642)..(642): a, c, t, g, unknown or other
  misc_feature (642)..(642): n is a, c, g, or t
  modified_base (674)..(674): a, c, t, g, unknown or other
  misc_feature (674)..(674): n is a, c, g, or t
tcagcgtagactagcacgaccggtgctcgatttagtagtgtagatttgggtttggggacctcaacaaccacatctgtcctctagagaaaaccctgtgagcacagctcctcgaccatggactggacctggaggatccctacttcttggtggacagcagctaacaagtcgcccactcccaggtgacagctggtgcaagtcgtgggctggaggtgaaagacgccgtgggcctcgagtgaacggtctccgtgctaaggtcttacgtggtactttccgtacgtttacctacgtaattacgtactcctaacgtgggtccacgaccgtacggccctcgttacggacctaaccggaccttggaacgttgggactcgggtaacgacgggaaccctaaaccctaacgtcgttccggtagaccacgtaggtccgttacttcccaaaccctcgtacccgtaaccggactaacgttaacccttaccgaagttcccgaaccctaacgaccctttaccaaaccgtaaactaaaccggcacgtaccttaacgagttcggaagttacgacggtaacncctaacgactaacgtcaccggtaacacccgtacgtacctacgtaatccgtgaccgtanacggtaccncctaggcgtccgganactcccgtagcgagaccgtttccaagttccgnggtaccggg

SEQ ID NO: 209844 - DNA, 769 bp, Homo sapiens
  misc_feature: GYAE6OF02JYSCT.17.25.C03.1.454.CMB.1.raw
  modified_base (161)..(161): a, c, t, g, unknown or other
  misc_feature (161)..(161): n is a, c, g, or t
  modified_base (178)..(178): a, c, t, g, unknown or other
  misc_feature (178)..(178): n is a, c, g, or t
  modified_base (184)..(184): a, c, t, g, unknown or other
  misc_feature (184)..(184): n is a, c, g, or t
  modified_base (263)..(263): a, c, t, g, unknown or other
  misc_feature (263)..(263): n is a, c, g, or t
  modified_base (538)..(538): a, c, t, g, unknown or other
  misc_feature (538)..(538): n is a, c, g, or t
  modified_base (603)..(603): a, c, t, g, unknown or other
  misc_feature (603)..(603): n is a, c, g, or t
tcagcgtagactagcacgaccggtgctcgatttagtagtgtagatttgggtttggggactcaacaaccacatctgtcctctagagaaaaccctgtgagcacagctcctcaccagtggactggacctggagactcctcttcgttggtggctgcgacgctaanagtcgacccactcccgnggtgcngctggtgctacgtcgtgggcaggtaggtacgaagaacggccggtcggggccttacggaggtaggtaacgtccttaccgntaccggtaacgtcttcgtcgtacttaccgttacctttaccgcgtaacgttaatctaacgtacggtggtcgaccgcggacgtccgtacgacggaacgacgtacctggtacggtagtggacggttacggacggaaccgttaaccgtacgtacggtacgttcggtaacacgttacgttcgttaccgtacccctaactccgtaccggtaaccggtaacctaacgtttaccgaaccgtactaccggaacgtaacccgtacctaccgttaacaaccgtaanaaccgtactaccgtaaaccgttcgtaaacgggtcgtacgtaaacgggtcgttaccgcgttaaacnccgtaacgtacggaccgtacgggaccgtttacccgaatttaccgtaccggagtaccgtaccgtacggttccaacctaacgggccgttaagggttcccgaaccggttccggaccggttacacccggggttctcccgggttttacctagggttacccggtacccgggg

SEQ ID NO: 209845 - DNA, 815 bp, Homo sapiens
  misc_feature: GYAE6OF02H5Q0M.17.25.C03.1.454.CMB.1.raw
  modified_base (522)..(522): a, c, t, g, unknown or other
  misc_feature (522)..(522): n is a, c, g, or t
tcagcgtagactagcacgaccggtgctcgatttagtagtgtagatttgggtttggggactcaacaaccacatctgtcctctagagaaaccctgtgagcacagctcctcaccatggactggacctggaggatcctcttcttggtggcagcagctacaagtgcccactcccgaggtcgcaggctggtgcagtccgtggggtctggaggtgaagacgccgtgggcctgaggtggaacggtctccgtgactaacggtccttacgtcggtacttccgttaaccgttttacctaccctaagttacgttaactcgtaaccgttggggtacgtccgaccggtaacgggcccgcgtaaccgggaaacctaaccggacccgtagggtacggtggacgggtacgggggtaacggtaccggggaacccgtaaaccccgtaaacggtaccgttggtaccgtaccgaacgtaggtttacgttcccttaccacccgtacgttacccggtaccggggaactaaccgtaccttaaccgngtttaacccgaacccgtaaccggtaccccttaccgtaaccgtaaaccgtaaaaccctactaaccggtaacctaacgtacggttagggtattacgggaacgtacgtacccgtagtacctacgttaccgacggtaaaccgtcgtaaccggtacccgttacgttaaccgttttacggtacggtcggtacggacgttaccgacccctaacggtacggtaccgggtaacgcccggtaaccgttacggcgtaccggggtacccgtttacgtttaccggttaccgtcggggtacccgggg

SEQ ID NO: 209846 - DNA, 760 bp, Homo sapiens
  misc_feature: GYAE6OF02FFGDT.17.25.C03.1.454.CMB.1.raw
  modified_base (220)..(220): a, c, t, g, unknown or other
  misc_feature (220)..(220): n is a, c, g, or t
tcagcgtagactagcacgaccggtgctcgatttagtagtgtagatttgggtttggggactcaacaaccacatctgtcctctagagaaaccctgtgagcacagctcctcaccatggactggacctggaggactcctcgttcttggtggcagccagctacaagtgcccacctcccaggtgcagctggtgcagtcgtgggctgaggtgagagcctggggcctnagttgaacggtctccgtgacgacggcttcgtggatttcacgtttaccctctagtacgcttacgaacgtgggttcgacgcctaggcccgtctacgggaaccaacggtaccttgaacggttcggaacgttcggggacgttcggggaacccgtaaacccttaacgtacttcggggtactcaacgtacggtcgttacccttaccgaccccgtaactcccggtaccggggaactaccgtaaccgtttccccgaagtcccggtaaacccgtaaccgtaacctccccgttaacctaaacggttaaaacccaacgaccggtacccttaaaccgacgtacgggtagttaacgggaaccgttgacccggttagacctactacgtaccgaaccggtaccgtaaccgggcccggtttaaccttaacgtccgtagggttccgaacggtaacggtacccgttaacccgaccggttaaccgtcccgggtacgaaccggtcccgtacggaccgacgggtccggttaccgttccggtacgtttcccgggaaccgggg

SEQ ID NO: 209847 - DNA, 770 bp, Homo sapiens
  misc_feature: GYAE6OF02IOX21.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccagtgcagctggtgcagtctggggctggaggtgaagaagcctgggcctcagtgaaggtctcctgcaggcttcgtgattctacgtttacctctatagtatcaactgggtgcgccgaggccgctaggaccaaccgcgtggagtggtacgtgggtacgtcggggaccgtaaacccctaacgacgttggtacgtaccaacgtacggttcgttaccctttaccaacccccgtagttccccggtaccgggtaaccaacgtaacctttacccgagtaccgaacccgtaaacccgtaacccttacccgtaaccctaaacgtaaaacccacccgtaaacgtaccccgtaaaccgtaacgttagggtaacggtttaggaaacgggaacgtcccgtacggaaacgtaccgttacgtaacggtaccggaacccggaccgggttacccgttacgtttaaccgtttaacggttacggtacggtaccggtaacgggtaccggttaaccccgaaccggtacgtttaccccggggtaacgtaccggtacccgttaccgggaccgtaaccgggtacccggttacccggtttcggttaacccgttcgggttacccggggg

SEQ ID NO: 209848 - DNA, 847 bp, Homo sapiens
  misc_feature: GYAE6OF02GRND2.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatcggactggacctggaggactcctcttcttggtggcagcagctacaagtgcccactccaggtgcagctggtgcagtcgtgggctggaggtagaagacggccgtgggctcgagtacgaaggtctcgtgacgaagtcttcgtggattccgtacgtttacctcttaactaagttactccgaaagttgggtcgccggtccgacggtcccgcgtacgggaactaccgaaccgtggaaggtcggaagtgggtaggtcgggaaccgaaacccctaaagtacggttacggtcgttaaccgaactacgggtttcgttaaccttcccgtaaacccctaggttccccgtaaccggggaactaacgttaacccgtttaaccgacgtttaacccgaacccgtaaaccgtaaacccgttaccgttaaaccccgtaaacgtaaaaccgtaaccgtaaccggtaacccctaaaacggtttaacgtaccgggttaaacggttttacgggaaccggtaacggttaaccccgttagaaacccggttaagttaacccggtaaccggtaaacccgaacggtaacccccggggttacccttaacgttttaaacccgttacggttaccggttagacccggtaaggttaccccgtaaccggtaaaccggtacccggttaacgggtacgaacccggttaccggaacggtacgaaccgggttcccgtaacggttttccgtacgtacccggggttaccggg

SEQ ID NO: 209849 - DNA, 753 bp, Homo sapiens
  misc_feature: GYAE6OF02FZNHG.17.25.C03.1.454.CMB.1.raw
  modified_base (619)..(619): a, c, t, g, unknown or other
  misc_feature (619)..(619): n is a, c, g, or t
tcagcgtagactagcacgaccggtgctcgatttagtagtgtagatttgggtttggggactcaacaaccacatctgtcctctagagaaaaccctgtgagcacagctcctcaccatgggactggacctggaggactccttcttcttggtggcagcagctacaagtgcccactcccaggtgcagcgtggtgcagtcgtggggtctggaggtagaaagaacgtccggtacggggcctacgaggtagaacggttcctccgtgaccgaaggtccttcgtaggactttaccgtaaccgttttaccctccgttaattacgttaactaccgaaaccgttgggggtacgccggaccgtaacgggtcccgtacgtacggaaccaaacggtacccgttggaaggttcgggtaaggtcggggtaacgtcggggaaacccgtaaacccctaacggtaccgttggggtacgttccaacggttacggttcgttacccttaccgtaacccgtaacgttcccggtaacgggaactaccgtaaccgttacaactccgggaacctaccggtaactcccgtaacaacgtaaacacacgtacctaacgagtcggtagttaggacgttacgcctagactacnccgtaacggacaccgtaccggtctacgttatcgttaggcgtaccgagttcccgacgtaacggtccggttacggaccggtctaaccggtacgacgtacggtaccgttcgtttacggtacccgttgggtacccggg

SEQ ID NO: 209850 - DNA, 874 bp, Homo sapiens
  misc_feature: GYAE6OF02H7F24.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggacgtggacctggaggactcctcttcgttggtggcagcagctacaagtcgcccactcccaggtgcagtcgtggtcgctagtcgtggggactgggaggtacggaaggagtccggtggggcctacgaggtggacggtctccgtggacgtaacggtcttcgtaggtacttccgtaaccgttttcctcgttaagttacgtaactacgtaacggtgggtaccgccgtaccggaccgggtaccgtcgttaaccggaaccgtaaaccggtaccgtaggtacggttacgggaaggtcggggtaacggtaccggggaaaccccgttaaacccgtaacgtaggttacgggtacggtaccacggtacgtttccgtaccttaacccacccgtcggtacccggaccgggaactaccgtaccttaacacgtaccgaacccgtaacgtacccttaccctaaaccgttaaacaaaaccgttaccgacccgtaaccgttacgtaagggttacggtaacgttacggggtaaaccgttcgtaccgttaacgacggtacggtttaccggttaacccggaaaccggttcccggttaaacccgggttcctttaacgtttaccgttacggtaagggtacccggtacgggttaaccggtacccgttacccgggtacggttaccgggttaccggtaccggtacccggttaaccgggtaccggttacggaacccggttcccggtttacggttttacccggtacggggtacccgggttaccggggg

SEQ ID NO: 209851 - DNA, 689 bp, Homo sapiens
  misc_feature: GYAE6OF02HH2PB.17.25.C03.1.454.CMB.1.raw
  modified_base (137)..(137): a, c, t, g, unknown or other
  misc_feature (137)..(137): n is a, c, g, or t
  modified_base (189)..(189): a, c, t, g, unknown or other
  misc_feature (189)..(189): n is a, c, g, or t
  modified_base (382)..(382): a, c, t, g, unknown or other
  misc_feature (382)..(382): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctnttcttggtggcagcagctacaagtcgcccactcccgaggtgcagccgttggngctaggtccgtggggctaggaggtagaagagccgtgggcctgagtggaaggtctccgtgacgaggtccttgtggatttctaccgtttaccctctattacgtaactcaacgttgggcgacgcccgcggccgtcgtcggaaccaaacgcctggagtcggagtgggacgtcggaccgaaccctaacgtgtacggtntacgaacgtcggtcttcttaccacctacgtcccggtaccgggaactaacggttacctaaccgtactacccggaacctaaaccggtccctaactaccctaaagtaaaccacgttaaccgacctacgtacgtacgtggttaacgcgaagttccagacccagtcctaggacccgtaacgtccgtaaccggttcttacgttaccgtggtccgagtacgtacggtcccgaacggttcgtaccggtacgaccggtccgtaccggtactccgggttcccgtccgttttaaccggtcggttccggtaaccggggg

SEQ ID NO: 209852 - DNA, 894 bp, Homo sapiens
  misc_feature: GYAE6OF02FOK1A.17.25.C03.1.454.CMB.1.raw
  modified_base (146)..(146): a, c, t, g, unknown or other
  misc_feature (146)..(146): n is a, c, g, or t
  modified_base (324)..(324): a, c, t, g, unknown or other
  misc_feature (324)..(324): n is a, c, g, or t
  modified_base (548)..(548): a, c, t, g, unknown or other
  misc_feature (548)..(548): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatctcttcttggtggnagcagctacaagtgcccactcccaggtgcagctggtcgctagtcgtgggctggagggtagaagacgccgtggggcctcgaggttgaaggtcctccgtagacgaacggtcctttcgaggtacttccgtaaccgttttaccctacttacttaacggtacttaccgaaacgttggggttcnccggcccgacggcccggtgtacggaacccgtaaaccggccctaggtaacggtggtacggtagggtacggtacgggaccgtaaacccttacgacggtggtactacgtaacgtcgttacgttacctacccgtaccctacgttccccggtaccgggtaacgtaaccgtttacccgtaaccctaaggtacccgaacctacccgtaaaccttccccgaacccttaaaanaaaaccccgtacaccgttaaaccctaacgaacgggtcgggttaaacggtttacgaaccggtacggtacccctgtaaacccttacgtcgtaaacccgtaaccgggcccggaaacccgggttttaccggttaacccgttaaccggttttaaccgttcggggttaaaccgggtcccgtaacgggtttaccccggttaaccccggttaaccggttccccggggtttaaccggggacccggttaacccgggggtaccccttaacccccgggggcgtttaaccccggggttaccggggtttcccccttttaaacggggtttccccggttcccgggggggttaaaccccgggg

SEQ ID NO: 209853 - DNA, 772 bp, Homo sapiens
  misc_feature: GYAE6OF02F1D6P.17.25.C03.1.454.CMB.1.raw
  modified_base (187)..(187): a, c, t, g, unknown or other
  misc_feature (187)..(187): n is a, c, g, or t
  modified_base (252)..(252): a, c, t, g, unknown or other
  misc_feature (252)..(252): n is a, c, g, or t
  modified_base (595)..(595): a, c, t, g, unknown or other
  misc_feature (595)..(595): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtcgcagctggtcncgagtcgtgggctggaggtagaagacgccgtcgggcctcgagtgacggtctctgacaggcttcgnggtcttacgtacctttacctcgtatagtactacgtacgtgggtcgccgtccgacggtccgcgttacggaccgtaaccgtacccgttggtaacgggtggtacggtaggggtacggtacgggtaacccgtaaaccccgttaacgtaccggtgggtactaccgtaacggtacgtttcgttaccccgttacccgtacccccgtaacgtcccccggtaacccggggtactaacccggtacccttaacgtacgtacccgaaccctaacccgtaacctacccctacctaaaccgtaacaccgtaaccgtaacctacgaacgttacggtagttacggacgttacgcttacncgtaactccgacgtaacggcccgtaaccggttccttacgttacgtttaccggtgttacccgggagttaccgtacccggtacgtaaccggtaccggttaccgggtaccgtaaccggtccgtaccgggaccgttaccggtcccggttacggttttacgtcccggtttacggaccggggg

SEQ ID NO: 209854 - DNA, 691 bp, Homo sapiens
  misc_feature: GYAE6OF02G8D47.17.25.C03.1.454.CMB.1.raw
  modified_base (238)..(238): a, c, t, g, unknown or other
  misc_feature (238)..(238): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtgcagcagctacagtgcccactcccaggtgcagctggtgcagtcgtgggctgaggtgaagagcctgggcctcagtgaggtctctgcaaggcttcnggattcacgtttacctctatagtatcaacgtggtgcgccaggccgtgtggacaacgacctggagtggatgggagtcggggaccgtaaaccctaacgacgttgggtcgtacacgtaggttcgttccttaccaccctacgtcccgtaccggggaactaacggtaccttaaccgacgttaccgacccaaccggtaaccctcccgtaacctaactaaaccaccgacgtaccctagacgttgggaagttggaacgggttccgaccgttagaacctactaccgttacgaaccggtaaccgtaccgggtacccgtttacctttagtttaaccgtggttaacggacggttaacggaccgttaccccgaggtaccggttaccgggtacgtaccggtacccgtacggccggaacgggttcccggttacccgtttccggttacccggtttcgggtacccggggg

SEQ ID NO: 209855 - DNA, 758 bp, Homo sapiens
  misc_feature: GYAE6OF02GA781.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtgcagcagctacaagtcgcccacctcccgaggtgcagcgtggtgcagtcgtcggggctaggacggtagaagaagccggtcggggcctcgaggtaggacggtcctcgtcgacgaaggtccttcgtggtattccgtaccgttttaaccctaccttaagtagttaactaccgtaaacgttgggtcgcgaccgaggccgtcgtcggaaaccgaacgtaccgtaggacgtggaacggtgggacgtcggggaccgtaaacccgtaaacgtacgttcggttcgtacgaagtaagttcggttccttacccgtaaccccacggttacccgtacccggggaataacccggtaacctttaccgattaaccggaacccaacgttaaaccccgtaccctaccgtaaacctaaacccgtaacgaaccggtaaccctaacctacggtacgggttaacgtttggaaacggttaccgttaccgtacgtacgtacgttacgtaacgacggtacggtacccggtcgttaccgtaacgtttaaccgtcgtacgtacggtacgtaccgtaccgtacgtacggtccgtacggaccgtccggacgcgtacggccgttacgttactcggtcgtaccggg

SEQ ID NO: 209856 - DNA, 758 bp, Homo sapiens
  misc_feature: GYAE6OF02JSYTM.17.25.C03.1.454.CMB.1.raw
  modified_base (177)..(177): a, c, t, g, unknown or other
  misc_feature (177)..(177): n is a, c, g, or t
  modified_base (548)..(548): a, c, t, g, unknown or other
  misc_feature (548)..(548): n is a, c, g, or t
tcagcgtagactagcacgaccggtgctcgatttagtagtgtagattggttgggactcaacaaccacatctgtcctctagacgaaaaccctgtgagcacagctcctcaccatggactggacctggagatcctcttcttggtggcagtcaagtctacaagtcgaccctactcccaggtncacgcttggtagctacggtcgtcgggcgtaggtaggtaggaacgacggtccgtcgggggtcctacgtaggtacgtaacggttctaccgttggacgtaacggtcttccgtaggtacttacctaaccggtttacctcctaagtacgttactaccgtaaccgtgggtctaccggaccgacggtcctacgtaggaacctaccgtaccgtggtaacggttcggacggtggtaacgtcgggacctaaacccgtagtaaccgttggtacctacgtaacgtcgtacttcccggtacctaccgtacgtacccgtacggtacaacgttaccagtacgtaacgaccaccgtaacgtccaactaacgtaacccgtacgtaacncgtaacctaggaaccggttgttaacggacgggtaacctcggtacgtaacgtcgtaccgtaagggaaccaccggggttaccacgttaccctagttacccgaggttaccgcgtaacggtactaccccgtaaggtccgttaaggtcgacccgttaacccggtagacccgtacggttaaccgtccctaagggtttcccgtaccgggtaaccggg

SEQ ID NO: 209857 - DNA, 660 bp, Homo sapiens
  misc_feature: GYAE6OF02H5X4Q.17.25.C03.1.454.CMB.1.raw
  modified_base (262)..(262): a, c, t, g, unknown or other
  misc_feature (262)..(262): n is a, c, g, or t
  modified_base (281)..(281): a, c, t, g, unknown or other
  misc_feature (281)..(281): n is a, c, g, or t
  modified_base (326)..(326): a, c, t, g, unknown or other
  misc_feature (326)..(326): n is a, c, g, or t
  modified_base (334)..(334): a, c, t, g, unknown or other
  misc_feature (334)..(334): n is a, c, g, or t
  modified_base (506)..(506): a, c, t, g, unknown or other
  misc_feature (506)..(506): n is a, c, g, or t
  modified_base (538)..(538): a, c, t, g, unknown or other
  misc_feature (538)..(538): n is a, c, g, or t
tcagcgtagactagcacgaccggtgctcgatttagtagtgtagatttgggtttggggactcaacaaccacatctgtcctctagagaaaaccctgtgagcacagctcctcaccatcggactggacctggaggactcctcttcgttgggtgcagcagtctacagtcgcccactccgaggtgccagtcctagggtcacgtacgtcggtggggtcttgggaaggtacggaacgacggtccggtcgggcctgaggtacgacggttcncgtagacgtacgtcttcgngtacttcgtaccgtttacactattacgtactcgaaggttggtacncggtaccncggccgtcgtacggtaaccaccgtcgaggtacggtgacggtaggacggaccggaacctaaccgtacgtcggtcggtacgaactcggtacgtcttaccgtaccaaccgtcgtccggacgtactacgtaacctctaacgtcgaaccgtacgtaccttcgaaacctaagaaaccncgtacgactagtacgtagtacgtacgcgtacncgtactctacgtacgtacgtaccgacggtaccgtctaacgtcgtcgcgtagacgtagtacctacgtcgtacgtacgcgtaaccgccgtgaacgtcggtacttacggttcacggttcgtcggg

SEQ ID NO: 209858 - DNA, 685 bp, Homo sapiens
  misc_feature: GYAE6OF02FIJKB.17.25.C03.1.454.CMB.1.raw
  modified_base (546)..(546): a, c, t, g, unknown or other
  misc_feature (546)..(546): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaaggcttctggattcacgtttacctctatagtatcaacgtggtgcgccaggccgcgtggaaccaaccgacctgagtggagtgggagtgggaccgaaaccctaacgacgttgggtcgtacgactagtgtccttcgacccctacgtacccgtacccgggaactacgtaaccgttaacccaagtccgaaacccgtacggaaaccctcccttaccgaaaactaaaacccacgacgtaccctaacgaaggtggtaacgttggacgggttaacgcctacgactagttccgtaggaaccgaccgtaccggtacccgttnttaacgttactggttagacccggtaagtcccgtacccggaaggttacccggttaccgggtaggtaacccggtacccgttaaccgggactacgggtccccggtttacccgtttcggttaccgtttcccggtaaccggggg

SEQ ID NO: 209859 - DNA, 654 bp, Homo sapiens
  misc_feature: GYAE6OF02HHTJX.17.25.C03.1.454.CMB.1.raw
  modified_base (441)..(441): a, c, t, g, unknown or other
  misc_feature (441)..(441): n is a, c, g, or t
  modified_base (546)..(546): a, c, t, g, unknown or other
  misc_feature (546)..(546): n is a, c, g, or t
  modified_base (586)..(586): a, c, t, g, unknown or other
  misc_feature (586)..(586): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcaagctacaagtgcccgactccccgaggtcgcacgcgtggtcgcagtcgtgggctgacggtgaacgacgcgtggggccttacgagtcggaaggttctcctagcaagcttcaggtattcaccgtttacctcgttaacgtacgttactccgtaacttgggtcgtaccgccgagggtccgcgtacggaccaacggaccgttggaacggtggacggtgggtacgtcggggaccgtaacctacgtacgttgtcgtacacgtagtcgttcttaccacccgacttaccgcgggtaaccncgtaaccgttaccacgtcgaacccgaacgtaaccgtccctaaccgtaacttaaaccgaactaccgtacctacgacgttacggaggttacgagacgtcgtacgtanacgtcgtacgcgtacgtacgtccgtacttagttactaggntacggcacgtccgacgtcaccggtagacgaccgtacgccgcggtccgttccgtatccgttcgtacggg

SEQ ID NO: 209860 - DNA, 783 bp, Homo sapiens
  misc_feature: GYAE6OF02HZJNM.17.25.C03.1.454.CMB.1.raw
  modified_base (136)..(136): a, c, t, g, unknown or other
  misc_feature (136)..(136): n is a, c, g, or t
  modified_base (161)..(161): a, c, t, g, unknown or other
  misc_feature (161)..(161): n is a, c, g, or t
  modified_base (305)..(305): a, c, t, g, unknown or other
  misc_feature (305)..(305): n is a, c, g, or t
  modified_base (575)..(575): a, c, t, g, unknown or other
  misc_feature (575)..(575): n is a, c, g, or t
tcagcgtagactagcacgaccggtgctcgatttagtagtgtagatttgggtttgggagtcagtctcagtcaggacacagcatggacatgagggtccccgctcagctccgtggggctcctgctactctggctccganctgccagatgtagacaatccgagtntcggacccagtctccactccctcctgtctcgccttcgtgggttacgggggcaaggtaccgtaccacctactccaacgttcggaccggaaccaaggtaccgaaccggttaacgttaaaacctttaagttttaaggttgtaacgtnacggacgtaaacgaaaccaaggaaaccgccccgtaacgacccttcggtaactctccgttcggtcgttacgacctaccgtcctactcgggtacacgggttaaccgtcgggaccctaccgtacgtaggttaccggtgtaccggtgtaaccggttagtaccgtgtaccggtgtaaccgtatttaccgtactaacgtcccaacctacgtacaccctaaccgttctacctacggaccgtaaacgtcgtacgtacggtcgtaactacgttaacctnttaacccgttaatcgtaaccattaaccggttacttacccgttaaccctccccgtttaacgtccgtttaccggtaaacggtacccgggtaaacggttaccgtaaagggtccccgtttaaaggaaaccttaaacccgggttagtaacccgggtaccgtaacgtccggtacccgaacgttttacccgaacgttccgttttacggttaaccc

SEQ ID NO: 209861 - DNA, 898 bp, Homo sapiens
  misc_feature: GYAE6OF02ILY7O.17.25.C03.1.454.CMB.1.raw
  modified_base (224)..(224): a, c, t, g, unknown or other
  misc_feature (224)..(224): n is a, c, g, or t
tcagcgtagactagcacgaccggtgctcgatttagtagtgtagatttgggtttgggggactcaacaaccacatctgtccgtctagagaaaaaccctgtgagcacagctcctcaccaatggactggacctggaggatcctcttcttggtggcagcaggctacaagtgcccactcccaggtgcagctggtcgcagtcgtgggctgaggtgaagagccgtgggcctnagtgaaggtctccgtgacgaggcttcgtggattctacgtttacctactatagtactacgtaacgtggggtcgtccgccgacgggtccgcgttacgggaaccgaaaccggtacccgtagggtacggtacggggtaaggttacgggggtaaggtacgggggtaacccgtaaaaccccgttaaacgtaccggttaggggttacggtaacctacggtaacgtttcgggttaccctttaacccgtaaccccgtacgttaccccgggttacccggggtaaaccctaaacgggttaaccctttaacccgtaacggttacccggaaccccgtaaaccggtaaccccctttaccccgggtaaaccccttaaaaacgtaaaacccccgtaaccggtaaaccgtaaccccgttaaagtaacgggttaaccggggttaagggttttaaccgggaaacggggtacccgtaacccggttacgtaaaccgtaccgttaacgtaaccgggtaaacccgtaccccgggtaaccgggtacccgttttattaaaccggtttcccgtagggttcccgaacggttaaccggacctaccccggaacggttacggcccgggtagtacccgcccggttaaagggccgaacgggttcccggttacccggttttccggtaccgttcccgggtaacggggg

SEQ ID NO: 209862 - DNA, 974 bp, Homo sapiens
  misc_feature: GYAE6OF02JHBXH.17.25.C03.1.454.CMB.1.raw
  modified_base (206)..(206): a, c, t, g, unknown or other
  misc_feature (206)..(206): n is a, c, g, or t
tcagcgtagactagcacgaccggtgctcgatttagtagtgtagatttgggtttggggtacgtcaacaaccacatctgtctctagagaaacctagtgagcacagctcctcaccatggactggacctggaggatccgtcttcttggtggtcagcagctacaagtgcccacctcccaggtgtcagctggtcgcagtcgtgggtcgtagngggtagaaggaaggtccgtgggggcctcgacgtagaacgggttcctccgtgaccgtaacgggtccttacgtcgggtaacttccgtaaccggttttaaccctcccgttaagttaaggtaccttacgaacgttggggttcgaccggacccgtacgggcccggtacggtacggggtaaacccaaaccggtacccgtagggtaaggtcgggaacggtgggggaacgttcggggggaaccctaaaacccgtaaacccggtagtttacgggtacgtaccgtaaacgggtcgtttacttcccgtttacccgaacccgtaccgttaccccggtccggggaaacccgtgtaaacccgtttacccggtaactaccgtaacccggtaacctaaccccgtttacccgtacctaaacccgtaaaccaaaccgttaccgaacccgttaacgtaccgtacgggttaacggttacgggtaaacgggttccgggaacccggttaacgtaccggtaaaccgtttcggaacggttaaaccccggaccgtaacccggggttacccgttaaccggtttaacgtttaccgtttacgggtaccgggttaacgggtaaccgggttacccgttaaccccggtaccgggttaaaccggttaaccccggggttttaggaaaccccgggttacccggttttaaacccggggcccccggggttaaacgggtccccgggtttacccgggtttttaacccgtaaccccgggttttccccgggggttaaacccggggggg

SEQ ID NO: 209863 - DNA, 848 bp, Homo sapiens
  misc_feature: GYAE6OF02J165K.17.25.C03.1.454.CMB.1.raw
  modified_base (162)..(162): a, c, t, g, unknown or other
  misc_feature (162)..(162): n is a, c, g, or t
  modified_base (188)..(188): a, c, t, g, unknown or other
  misc_feature (188)..(188): n is a, c, g, or t
  modified_base (485)..(485): a, c, t, g, unknown or other
  misc_feature (485)..(485): n is a, c, g, or t
  modified_base (498)..(498): a, c, t, g, unknown or other
  misc_feature (498)..(498): n is a, c, g, or t
tcagcgtagactagcacgaccggtgctcgatttagtagtgtagatttgggtttggggactcaacaaccacatctgtcctctagagaaacctgtgagcacagctcctcaccatggacgtcggacctggaggatcctctttcttggtggcgagcgacgcctaanaacgtcgccccactcccgaggtgacngcgttggtgccgagtcggtcgggtctggtaggtggaaacgacggccgtcgggggccttacgaggtacggtaccggtctaccgtggtacgaacgggttccttggttaacggtcttttacccgttaccgttttaacccttccgttaacgttacggtttacctaccggttaaccggttgggttccggaccggtccggtaccggcccggttcccgggaggtaaccccgaaaccggttaccggaacggttaacgggtggggacgtttaggggacgttacggggaaccccgttaaccgtaacnggtacgggttacncgaaccgtacggtttccgtcttaacccggccctaccgtccgaccggcaccttacggtcctaacgttccggaaccgaccgtacttaccctaccgtaactaacccacttaccgacgttaagttcgaggttacggttcgtacgggtacctactccgaattaccgtacgtccgtaacccgggaacgtccgggtaaccggttaacgttaccggttcccggttaggtacgaacggggttacccgaggttaccccggttaccgggtccgggttaccgttacggcccggtacggtacccgggaggtccccggtaacccggttttcgttacccgggttcgggttccgggttaccggggg

SEQ ID NO: 209864 - DNA, 664 bp, Homo sapiens
  misc_feature: GYAE6OF02FN83F.17.25.C03.1.454.CMB.1.raw
  modified_base (245)..(245): a, c, t, g, unknown or other
  misc_feature (245)..(245): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcgagtgaaggtctcctgcaaggcttcgnggattcacgtttacctcctatagtatcaacgtggtgcgccgaggccgcgtggaccaacgaccgtgagtcggagtggggatggggaccgtaaaccctaacgaacgtggtcgtaccacgagttgtctttccaccctacgtccgtccgggaacacggtaccttaccgatacgaccacgtaactccctaccaaataaaccacagtaccctacgatcgggtaagttgaaggtacgcctaagacctatccgtaggaaccgaccggtacgtccgttacgttaacgttacgtcggttagaccgggtacgtaccggtacccccgaacgggtaacccgtttccgggtaggaacccgggtaccccgtaagggtcccaacggggtttcccggtaccctttttagggtacccgttttcgggaacccgggggg

SEQ ID NO: 209865 - DNA, 973 bp, Homo sapiens
  misc_feature: GYAE6OF02JBMDE.17.25.C03.1.454.CMB.1.raw
  modified_base (141)..(141): a, c, t, g, unknown or other
  misc_feature (141)..(141): n is a, c, g, or t
tcagcgtagactagcacgaccggtgctcgatttagtagtgtagatttgggtttggggactcaacaaccacatctgtcctctagagaaaaccctgtgagcacagctcctcaccatggactgacctggagatcctcttctggnggcagcagactacgaagttcgccctactcccaggtgcagccgtggtacgtcacgttcgtcggggctaggtaaggtgaacggacgtccgttgggcctacgaggtcggaaacggttccctaccgtaggaaccgtaagggttcctttccggtggtacctttccgttaacccgttttaccctacgtaaatttacgtaaccgtaccgaacgttcggggtcgcccggtaccgacgggtacccgtcggttaaccgggaaccgtaaaccggtcccgttaagggaccgggttaggtaacgtagggggtaacgttccgggggaaaccccgtaaaaccccgtaaccggttacgtagggtaccgtaacccgaagtccgggtttacggttacccctttaccgacccccgttacggtttaccccggacccggggtacctaaaccggttaacccctttaacgaacccgtttaacccggtaacccgtaaccgtttaacccccggtcccctttaaaccggtaaacctaaaaccgaccctaacggtaccctaaacggtacggtacgggttaaggtaacccgggtaaccggtacgtaccctacggtaaaccgttcgtacccggttaaggaacccctaacccggggtaacccgttaaccggtttaccctaaagtttcccggttacgggaaccggtaccgggttaacgttaccccggtaaccgttacccggttaaacgggttttcccggggaaacccggtttaacccggacccccggttagggttaaccccgccggttttaaacccccggttcggtttttaaccgtcccggttttacccgggggaacccgggg

SEQ ID NO: 209866 - DNA, 682 bp, Homo sapiens
  misc_feature: GYAE6OF02HRDS8.17.25.C03.1.454.CMB.1.raw
  modified_base (248)..(248): a, c, t, g, unknown or other
  misc_feature (248)..(248): n is a, c, g, or t
  modified_base (287)..(287): a, c, t, g, unknown or other
  misc_feature (287)..(287): n is a, c, g, or t
  modified_base (611)..(611): a, c, t, g, unknown or other
  misc_feature (611)..(611): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcagtgaaggtctcctgcaaggtcttcgnggattcaccgtttcctcctatagtatcaacgttgggtancgccgaggccgctaggaccaacgacctggagtacggagtggggatcggggactaaaccctaacgacgtggtcgtaccacgtagtcgttaccttccacccctacgtcccgtcccggggaactacgtaacctttacccgaattccggaacctaacggtaacccttcccgtaacccaaataaacccacgacgaccctaacgtagtacgggtagttacgggacggtaacgtccctaggactacgttctacgaacgaccgtacccggtccgttacttaagtttccgtagtcgacgaacggtaccgtacccgaaggtacgtaccgggttnaaccggtcccgtaacgggccgtaacgggtacccgtttacccggtttagtacccggttcgggtaaccggggg

SEQ ID NO: 209867 - DNA, 674 bp, Homo sapiens
  misc_feature: GYAE6OF02G03W1.17.25.C03.1.454.CMB.1.raw
  modified_base (446)..(446): a, c, t, g, unknown or other
  misc_feature (446)..(446): n is a, c, g, or t
tcagcgtagactagcacgaccggtgctcgatttagtagtgtagatttgggtttgggggagtcgagtctcacgtcaggacacagcatggacatgagggtccccgctcagctcctggggctcctgctactctggctcgagctgccaggtatgtgacattccgagactgacccagtctccactcctccctgtctcgcctcgtggtgggggtcagtacgtccaccgtatcctacgttcgccggactaagtccgaacggtacgttaaaaccttatttaaagttggtactccagacaacgtaaaccgtaggaaaaccgtccccgaagtaccctccgtagtacttcgtcgtcggtacgacgtactcctacgtctacggcggtaacgtcggtccgtaccgtagtacggtacggttcaggtgacgtagtgtacgtcggtaggactaagtacttanaactcctacactactcccactactcgtacgacgtaccgtagtacgtgttacgacgtactaacttactacttacgtacgtacgaactacggttacttaccgtaccgttcccgtcgttacgttaccgtttacggaccggtaacgggtaccgttaagttcgtaacgtaacgtaacgtaacgtaacgtcggtacggtcgttacgaccgttacgtacgtttccgtcgttaccg

SEQ ID NO: 209868 - DNA, 734 bp, Homo sapiens
  misc_feature: GYAE6OF02HBMSP.17.25.C03.1.454.CMB.1.raw
tcagcgtagactagcacgaccggtgctcgatttagtagtgtagatttgggtttggggactcaacaaccacatctgtcctctagacgaaaaccctgtgagcacagctcctcaccatggactggacctggaggactcctcttcttggtggcagcagctacaagtcgcccacctcccaggtgcagctggtgcacgtcgtggggctggaggtgaagagccgtggggcctcgaggtgaaggtctccgtagacacggtcttcgtgtattacctaccgtttacctacctatagtataccaacgtgggtccgcgaccgcggccgtcgtacggaccaaccgccgttgagtggaggtaggaggcgggaccgtaaccgtaacacggttggtcgtactaaggtacgttcgttccttaccaccctacgtacccgttaccggaccgttaacgtacccttaacgacctaccgaaccgtaaccgaacccttacccgttaacctaaaactaacccgtaaaccaccgtacccgtaaactaacggttacgggtaaggtttaacggacggtaaccgacccgttacgaacgtagttcgaaaccggaccgacggtacccgttccgttacttaccgtttacgtcggtacgtcggtaaaccgccgttacccgtaacggtccggtcccgggtacggacccgtaacggtaccggacgtccggtaccggtttcccgttacggttccgtacgggtacccggg

SEQ ID NO: 209869 - DNA, 771 bp, Homo sapiens
  misc_feature: GYAE6OF02HTHH4.17.25.C03.1.454.CMB.1.raw
  modified_base (134)..(134): a, c, t, g, unknown or other
  misc_feature (134)..(134): n is a, c, g, or t
  modified_base (136)..(136): a, c, t, g, unknown or other
  misc_feature (136)..(136): n is a, c, g, or t
  modified_base (163)..(163): a, c, t, g, unknown or other
  misc_feature (163)..(163): n is a, c, g, or t
  modified_base (629)..(629): a, c, t, g, unknown or other
  misc_feature (629)..(629): n is a, c, g, or t
  modified_base (650)..(650): a, c, t, g, unknown or other
  misc_feature (650)..(650): n is a, c, g, or t
  modified_base (676)..(676): a, c, t, g, unknown or other
  misc_feature (676)..(676): n is a, c, g, or t
  modified_base (686)..(686): a, c, t, g, unknown or other
  misc_feature (686)..(686): n is a, c, g, or t
  modified_base (749)..(749): a, c, t, g, unknown or other
  misc_feature (749)..(749): n is a, c, g, or t
tcagcgtagactagcacgaccggtgctcgatttagtagtgtagatttgggtttgggagtcagtctcagtcaggacacagcatggacatgagggtccccgctcagcctccgtgggctcctgctctctggctcgancncgaccagatgtcgactacaccgaaggntaccggaaccctagtccctacctacttccccgttcccttcggtctccgtccgttcgttaggggtccgggggtaccaggtaccgtacctaaccgtactacgtacgttccggaacggtacaacggtacgtaaccggttaaacgtttaaaaaccgttaagttttaaaacggttcggtaaacgttacgaacgtaaacgaaaccggtaaaaccgttaacggaaaaacccggtccccaacggttacccctacgtaacggttaacctcttcggtaggtcacctaacctccctaacgtcgtaccggaagttaagtccggtccgtaaccttaggaccggtttagacggacgtaccggagttaggggtactaacggttaccggtaacggaagttaacttacctttaaactcaccctaactaacctacctctaaaccccttagtcggtaccaagttaccgagacgttgtacgttaanaatacccttactaaccgttanacgtaaactacgtaacgtacttaccncccgttaccnctaccggtttaaccgacggaaccgaagtacgtagataacgaatacgaacttgacggcgtaacnccgaactcctactcgttatacg

SEQ ID NO: 209870 - DNA, 629 bp, Homo sapiens
  misc_feature: GYAE6OF02JJ69F.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatccctcctgtctgcctcgtggtgggggtcagagtcaccatcactgccggacaagtcacggacttaaaacctatttaaatggtatcagaccaagaaacctaggaaaacgccccaagaccctctgatctacgtggtcgacactaccactctagacggaagtcggccgtacccagtcgtagttcgagtggcagtgatcgaggatacgttattacaactcctacaccacgtaccaccgtactccgtacgacctaacgtacggtaagtagttcgtacgtaactaacttaccgttacctacgtacgtaaccgtaactaacggtaacgttacgtaacccgtttcccgtacgttaccgttaccgttttacggaacccgtaacgggtaaccgtaagttacgaacgtaaccgtaacaaacggtaacgtcgtacggactacgacctaaccgtcgttactaccgttacc

SEQ ID NO: 209871 - DNA, 745 bp, Homo sapiens
  misc_feature: GYAE6OF02IU90M.17.25.C03.1.454.CMB.1.raw
  modified_base (246)..(246): a, c, t, g, unknown or other
  misc_feature (246)..(246): n is a, c, g, or t
  modified_base (287)..(287): a, c, t, g, unknown or other
  misc_feature (287)..(287): n is a, c, g, or t
tcagcgtagactagcacgaccggtgctcgatttagtagtgtagatttgggtttggggactcaacaaccacatctgtcctctagagaaaaccctgtgagcacagctcctcacatggactggacctggaggatcctcttcttggtggcagcagctacaagtgcccactcccaggtgcagctggtgcagtcgtgggctgaggtgaagaagcgtggggcctcgagtgaaggtctccgtgcgaaggtcttntggtattctaacgtttacctctatagtatactaacgtgggncgccgaggccgcgtacggacaacgacctaggagtgggagtgggagtcggggaccgtaaacccgtaacgacgttgggtcgtacgacgtaggttacgttccgtttaccacccctacgttcccggttacccggggactaacggtaaccttaacccgagtaccgaaccctaacgtaaacccttcccgaaccaaataaaacccgaccacgtaacccctaagtacggtaggtaacgttaggacggtaccgtccgtaagtacctaaggttctacgggaccgaaccgtccggggtacccttacttaacgtttaccggcggttacgggaccgtaacgggtacccgtacccgtaacgggttacggtacccggggttaaggaacccgttaccccggttaacgggccgtaccggggtttacccggttacccggttttacggtacccggtttccggggtaacccggggggg

SEQ ID NO: 209872 - DNA, 804 bp, Homo sapiens
  misc_feature: GYAE6OF02HFELE.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtgcagcagctacaagtgcccactcccaggtgcagctggtgcagtctgggctgaggtgagaagcctgggcctcgagtgaaggtctccgtgtacaaggtcttacgtggactttcgtaccgttttaccctccgttaagtacgtattacgaaccgttggggtacgtccgaccgacgggtcccgacgttggaacctaaaccggaccgttggacggtacgggtaaggttcggggtagtacgggggtacccgaaaccccgttaacgtaaccggttcgggttacggttaaccgacggttaacgggttccgtttacccgtttaccgtaacccccgttacgtttacccccggtaaccggggtaaccctaaacggttacccctttaacccgaagtttacccggaaaccctaacccgggtaaaccctttccccggttaactaaaaccttaaaaccggacccttaaaccggtacccgttaacgaacgttcggggtaaaccgtttcggaacggttacgtacccgtaggtaacctacgttcgtacggaaccggtaccgaccgtaccgttacgttaacttacgtcgtacggcgtacgccgtaccgaacggtgtacccggtacgcgtacccgtaggcgttaacggcccggttactttcggtacccgtggtacccgggg

SEQ ID NO: 209873 - DNA, 687 bp, Homo sapiens
  misc_feature: GYAE6OF02IVK55.17.25.C03.1.454.CMB.1.raw
  modified_base (191)..(191): a, c, t, g, unknown or other
  misc_feature (191)..(191): n is a, c, g, or t
  modified_base (234)..(234): a, c, t, g, unknown or other
  misc_feature (234)..(234): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggagctcctcttctggtgcagcagctacaagtcgcccgactcccaggtgcagctggtgcaggtcgngggctggaggtcgaacgacgccgtgggcctgaggtcgacgtcncgtgacaggtcttacgcgtattccgtacgttttaccgcctagttaacgttacacgtaacgttgggcaccgcacggtccgcgttacggacgtaaccgtcgtaggtacggtggaacgttcggggaacgtcggggaacctaaacccgtatacggtggtactacgcgtacgttccgtctaaccgtacccgtcgtaccggtaccggtacaaccgttacctaaccgagttaccgaaccgtaacgtaccgtcctacaaacgtaaccgactacgtaccgtagtacgtaggtacggttcgacggtcgtaccgtacgactcgtaagttcgaaccggttaacccgcggttcccgttaagttaccgtttaacggcggtaccggtaacgtccgaaccgttccggaacgttcgtaaccggtcgttacgccgtaggactccgtacggttccttaggtaccgtgacggg

SEQ ID NO: 209874 - DNA, 707 bp, Homo sapiens
  misc_feature: GYAE6OF02JHDWL.17.25.C03.1.454.CMB.1.raw
  modified_base (156)..(156): a, c, t, g, unknown or other
  misc_feature (156)..(156): n is a, c, g, or t
  modified_base (186)..(186): a, c, t, g, unknown or other
  misc_feature (186)..(186): n is a, c, g, or t
  modified_base (195)..(195): a, c, t, g, unknown or other
  misc_feature (195)..(195): n is a, c, g, or t
  modified_base (332)..(332): a, c, t, g, unknown or other
  misc_feature (332)..(332): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctanaagtcgcccactccaggtgactagctggtnctacgtcgngggtctagaggtagaagacgccgtacggggcctacgtaggtacgtaacggtccttcccggtaggaccgtaacggtccttacgtagggtacttccgtaccggtttaccctctaagtagtactactaacggtgggtacnccggcgtacggaccgtcgtaacggacctaacggcctggtaggtagggatggggagtcgggacctaacccgtagtacgtggtacgacgtagtcgttcgttacctacaccgtcgtaccggtaccggatacgtaaccttacgaacgtcgaccgtaacgtaacctcctaacgaactaaacgtcacgtactagtacgaggtacgtaggacgacgtacgtagactacgttcgaacgacgtaccgtacggtaccgttacttaaaccgttcgtacggtagaccgtaacggtaccgttaccgacggtaacggttccgggtacgaacccggttacgtaccggtacgtcgggttaccctcggtttacggtccgttacggggacggg

SEQ ID NO: 209875 - DNA, 627 bp, Homo sapiens
  misc_feature: GYAE6OF02GF27T.17.25.C03.1.454.CMB.1.raw
  modified_base (496)..(496): a, c, t, g, unknown or other
  misc_feature (496)..(496): n is a, c, g, or t
tcagcgtagactagcacgaccggtgctcgatttagtagtgtagatttgggtttgggggactcgaacaaccacatctgtcctctagagaaaaccctgtgagcacagctccctcaccatggactggacctggaggatcctcttcttggtggcagcagctacaagtgcccactcccaggtgcagctggtgcagtctgggctgagtgaagagcctggggcctcagtgaaggtctcctgcaaggcttacgtggattcacgtttacctctatagtatcaacgtggtgacgtccaggtcccgactcggactaacggaccttggagtcgggaatcgggatcggggaccaaccctaagactggtcgtacagtacgttcgttcttacacccgtacgtcccgttacgggactacgtacttaccgacgtacgacccgtacgaacctcccgtactaaacgtaacacctcgacccttaacagttgggacgttagaaccggtacctgaacncgttacgtcgaaccgtcgacccggtccgttattacgttacgtcggcgacgtaacgccgtacccgatacggccgttagacggaccttcggacctcggtccgttccgtttggacctttcggacgggtacccgg

SEQ ID NO: 209876 - DNA, 812 bp, Homo sapiens
  misc_feature: GYAE6OF02I40IG.17.25.C03.1.454.CMB.1.raw
  modified_base (312)..(312): a, c, t, g, unknown or other
  misc_feature (312)..(312): n is a, c, g, or t
  modified_base (417)..(417): a, c, t, g, unknown or other
  misc_feature (417)..(417): n is a, c, g, or t
tcagcgtagactagcacgaccggtgctcgatttagtagtgtagatttgggtttggggggagtcagtctcagtcaggacacagcatggacatgagggtccccgctcagctccgtggggctcctgctactctgctcgagctgccagatcgtgacactccgagatcgacccagtcctccacttccctcctgtctcgcctcgtgggtgggacagactcactctcacgttcggaccggaacacgtaccgacggtaacttaaaacgttattttaaagtcggtactacgacgaccgtaaacgaaaccgtacggaaaccncccctaacggtaccctcctagtcttaccgtacgttacggtctacctaactcctatcggtcgacggtacggtcgtacccgtacccagggttaccggtaggttaccncgggtagggacctagggttacggaacgttcggaacggtaactacggttaacttaactacgtacctacctaaccgacctaccacctaccgtacgtaccgaccgttacggtacggtaaggtacgttacggacccgttacgttaaccttacctacggtttaactaaccggttaactaacggttaacccgtttaccgtttaccccggttacccgggtttaacccttaccgtttaacccggttttagggtaacccggtaccggggtaaaaccgggttcctaacgggttttacgaaaccgggtttaaccgtaaaccggtaaaccggttaacggttaccgggtacggttaccccgtacgtaaaccgggtttacccttacggttacccgttttataacccccg

SEQ ID NO: 209877 - DNA, 718 bp, Homo sapiens
  misc_feature: GYAE6OF02FGF25.17.25.C03.1.454.CMB.1.raw
  modified_base (500)..(500): a, c, t, g, unknown or other
  misc_feature (500)..(500): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtacccactcccaggtgcagctggtgcagtctggggctgaggtgaagaacgccgtggggcccttcaggtgaacggttctacctggccgaaggtcttcgtggacttcgtaccggtttaccctcctattacggttatccgtaaacgtcggggtgccgccgacgggcccgcgttcggaccaacgaccgtgagtggagtcgggacgtcgggacctaaacccgtaacgaccgttggtcgtaccacgtagttcgtccttaccaaccctacgttcccgtccgggaacacgtaacctttacccaagttaccgaacccaccgtaaccttcccgacctaacgttaaaacccnccgtaacgcccttaaacgacgttagggtaacgtttgggaaacggtacgtcccgtaagacctatccgtaagaccgacgacccggtaccgttacttaacgttaccgtcgtaggaccgtaacgtaccgttacccaacgtcgttcccgggtaagtcccgaccccgtacggacctacgggtacccgttaccggtttcgacccgtttcgggtcggggtaacccg

SEQ ID NO: 209878 - DNA, 645 bp, Homo sapiens
  misc_feature: GYAE6OF02GVXZR.17.25.C03.1.454.CMB.1.raw
  modified_base (255)..(255): a, c, t, g, unknown or other
  misc_feature (255)..(255): n is a, c, g, or t
  modified_base (268)..(268): a, c, t, g, unknown or other
  misc_feature (268)..(268): n is a, c, g, or t
  modified_base (369)..(369): a, c, t, g, unknown or other
  misc_feature (369)..(369): n is a, c, g, or t
  modified_base (407)..(407): a, c, t, g, unknown or other
  misc_feature (407)..(407): n is a, c, g, or t
  modified_base (434)..(434): a, c, t, g, unknown or other
  misc_feature (434)..(434): n is a, c, g, or t
  modified_base (503)..(503): a, c, t, g, unknown or other
  misc_feature (503)..(503): n is a, c, g, or t
  modified_base (557)..(557): a, c, t, g, unknown or other
  misc_feature (557)..(557): n is a, c, g, or t
  modified_base (562)..(562): a, c, t, g, unknown or other
  misc_feature (562)..(562): n is a, c, g, or t
tcagcgtagactagcacgaccggtgctcgatttagtagtgtagatttgggtttgggggactcaacaaccacatctgtcctctagagaaaacctgtgagcacagctcctcacatggactggacctggaggactctcttcttggtggcagcagctacaagtcgcccactcccaggtgcagtctggtcgacagtcggtgggtctggtaggtacggaaggaacgccggtcggggcctcgagtcggaacggttctccgtnacgtaaggtcttntgggtattaccgtacgttttacctcttaagtacgttataccgtaacgtgggtcaccgtccgacggtccgtacgtgaccaaacgtccgttaggacggtcggngtgggacgtacgggacgtacctatacgtcgacgtcganagtgtacctcaacctcgtcacgggtcncgtaactacgacgttcgaacgtcctaactcctacgaacaacgactacgacttagaccgtaggtaccggngagggtaccgcgttacacgtacgccagacctacgaccgggtctacttgtacgtnaccgngaccgtcgtccctaggtcgtaccggttacaccggttaccgacggtacgtcggaccgtttaccgccgttacgggtactaccggg

SEQ ID NO: 209879 - DNA, 741 bp, Homo sapiens
  misc_feature: GYAE6OF02ITCAZ.17.25.C03.1.454.CMB.1.raw
tcagcgtagactagcacgaccggtgctcgatttagtagtgtagatttgggtttgggagtcagtctcagtcaggacacagcatggacatgagggtcccgctcagctcctggggctcctgctactctggctccgagctgccagatgtgacatccagatgacccagtctccatcctcctgtctgcctctggtggggtcagagtcaccatcacttgccggacagtcacggacgttaaactattaatgtatcagcaacgtaaacctaggaaaacgccccagacctaccagtatctcgtggtcgactacttaccacttctacggtaccggtaagggttccgggtaccgttcccgaacgttaccggtacgggttcgaacgggttcggacgtacggttagggacgttcggtacgggaactagtaactttacgaacttccgtacccaaaccggtactacccgtaaccctacttcgtaccgacctaaaccggttaggaaggttaacgtttgggtaacctaacggttaaacctttccgttaaacgtaccgtttacgaaccgtaaattaccgggtttaaacgttaccgttacccgttccccgtacgttaccgtttaacccggtttacggacccggtaaacggggttaaccgttaacggttaacggaacgtaaccgttaaaccgtaaagggttaccgtacgggttacccgagtacccgtacgtaacccgttaactttcggttaccgtttaaccc

SEQ ID NO: 209880 - DNA, 717 bp, Homo sapiens
  misc_feature: GYAE6OF02GQF7A.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactcggacctggaggatcctcttcttggtggcagcagctacagtgcccactcccaggtgcagctggtgcagtctggggctggaggtgaagaagccgtggggcctcgagtgaacggtctcctgacaaggtcttcgtggtatttctaccgtttacctccttaatagtatacaacgtgggtcgcgccgaggccgtcgtggaacaacgacctggacggtgggagtggggagtcggggaacccgtaaacccgtaaacgtaccgttagggtcgtacaacgtacgttcggttccctttaccgaccctaccgtcccggtacccgggtacaacgtacccttaaccagttaccgaacccgtaccgtaaccctcccgtaccaaactaaaaccaccaacctacctaacgtagtagggtacgttacgggacggacgcgtacgtactactccggtaggaaccgaaccggtacgggtacccgtttacttaacgtttaccgtggtaccgggacgtacggaccttaccccgaacgggtccggttaccgggacggtaccgtacccgtacgggacgtacggtcccgggttactttacgggttaccgtcgggtaccggggg

SEQ ID NO: 209881 - DNA, 721 bp, Homo sapiens
  misc_feature: GYAE6OF02JN6DU.17.25.C03.1.454.CMB.1.raw
  modified_base (179)..(179): a, c, t, g, unknown or other
  misc_feature (179)..(179): n is a, c, g, or t
  modified_base (193)..(193): a, c, t, g, unknown or other
  misc_feature (193)..(193): n is a, c, g, or t
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
  modified_base (266)..(266): a, c, t, g, unknown or other
  misc_feature (266)..(266): n is a, c, g, or t
  modified_base (599)..(599): a, c, t, g, unknown or other
  misc_feature (599)..(599): n is a, c, g, or t
tcagcgtagactagcacgaccggtgctcgatttagtagtgtagatttgggtttggggactcgaacaaccacatctgtcctctagagaaaaccctgtgagcacagctcctcaccatggactggacctggaggatcctcttcttggtggcagcagctacaagtcgcccactcccaggtgcngctggtgcagtcgngggctgaggtgaagacgccgtgggcctcaggtggacgtctcgngcgaggtcttngtacttccgacgtttaccncgtataggtactacgacgttgggcgtcgccagggtccctgttacgaccgtaaaccgcctggaacggttcggagttggggaacgtcggggaaccttaaacccctaagcggtcggtagtccaacggttacgttcgttacctcccgtaaccgaacgtttcccgggacccgggaactacggttaaccttacccgtacgttacgaaacccctaacccgttaactcccctacgtaaaactaaccgtaccgaccgtacccttaagacgttacgggtgttacgaaggtctaccgtgacctacgtacgcggtaacgaccgtaccggtacttacttaacgttntacgggtacacccgggttagacccttacccggattaacccgggttccggtaacgtaccggtacccggtacggcggaccggttaccgttccgtttaaggttccccgtttagggtaacccgggg

SEQ ID NO: 209882 - DNA, 895 bp, Homo sapiens
  misc_feature: GYAE6OF02F56MW.17.25.C03.1.454.CMB.1.raw
  modified_base (223)..(223): a, c, t, g, unknown or other
  misc_feature (223)..(223): n is a, c, g, or t
tcagcgtagactagcacgaccggtgctcgatttagtagtgtagatttgggttttggggactcaacaaccacatctgtcctctagagaaaaccctgtgagcacagctcctcaccatgactggacctgaggactcctcttcttggtggcagcagctacaagtcgccctactcccgaggtgcagtctggtgcagtcgtgggctggaggtgaagacgcgtcgggccncgagtagaaggtcctcgtcgcgaaggtcttcgtggtactccgttacgtttaccctcttagttagtacttacgaacgttcggggtacgtccgccggtacggtcccgccggtacggaacctaaccgaccggttaggtaaacggttcggtaacgggtaggggtaccggtacgggtaacccggtaaaaccctacggtacggttacgggtcgttaccgtaacgtaggtttaccgttacgttacccgaacccgttaaccgttcccggtaaccgggaacgttaacccgttaaccttttaacccgacgttaacccggtaacccgtaaacccggtttaaccccttaccccggtttaaacccaaaaacttaaaccccggaacctttaaacccgggtaaccctaaacggtttacggttaccggggaaagggtttacgggaacggggtaaccttaccggtaacgtaccttaggttacccggttacccgggaaacgtacccggttaccgtacccggtttaacggttactttaaacccggttggttaaccgtaaccgtcggttaccccgacccgttaaccggtaccgggtacccggtaccggtaaccccgtaccgggttaaaccgggttccaaccgggggttccccgttacgttttacccgggtaccggtttacggggtacccggg
